United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 30

SEQ ID NO: 384 - DNA, 2304637 bp, Homo sapiens
cacaagctctccatgtgagctgacaggcgagtggaaacccctcgagtcacgctgcccggcggcggagggagcgctcgcccgcagtggcaacagctgcaccaccgtccccgtcgctctgccttcctcttctgcagcctctgctcttctgattacctccctcccccgtcctttggtgatttttttttttcaagaaggagagggcggggtaggtgtccgttccctcccctcttccccctcctttgccttcttggtttgaatttcctcccccggcgttgcactggcacacagtgcaagaggcaatacccgcacggagggagaacgaaggctgagactcccctgccgctccaagcccggaagaactggagcctggaggggggtgaggggagaagaggaagcgggaggggcttggcttcctcgcgtatttgaggacagcccatctcccttcaagaaccctacggagagtcggactgcatctccgcagcgagctcttggagcgccgccggccgggaggcgaaggatgcaggcggctccgcgcgccggctgcggggcagcgctcctgctgtggattgtcagcagctgcctctgcagagcctggacggctccctccacgtcccgtaagtagccgtctcctcgctctgctctggagcagtttcagtgcggcattgatgtttggcaccagggtatcaactccgaagtgcatcgcagtgctggcaccctgatgtgtttgtgtctccgctgtcacacacttgcagccactgcagtagacaaactcgaaacccagcgtttctgttttggaagagacagggttgtgacgctggtgatgtttctggaaagttgttcctggtcttggtgatcggttggcaagagcttggctagagagactgatgtagatggcagcttcttaggagttgtttgtgcagggagagttaactgcatttggcttaggtaggtcagtgaatgaaaagtgaagaccatggcaaaaccaagtttcttatttttatttatggttataacttaatgagcacggggttgaggttaacaagaggagcatgttttaaacagtttgggcacctatagggtctctttaacctctcccgttcccttaaaaagttaatgcccatttagtacttgcttattaaaatggaaggcagcgaaattgtaactgaaattgctttaattctttgatactttgatatcatggatatgactgatgcagtacggtacttgggacactcagtgcaaagcgtcgttaatgtagtaataaacagattcttaatagggttttcaggaaaataattatattcaatatgtatatctctgcattttaatcaactgtgtgtgtgtgtttgtgtgtgtgtgtgtttaagactgcccctgttttcatgaggtttagaaagaaatggaagattctggcccattttctgcattcctttagaagtgcatactgtgcatgtagagaggaaatgcatgattgttcctttggttcagaaagagttaaacactagaaagactgcctataggaatcttaggataatattcataagcgcatactagtttctgagaatgagtaagttgataaagaattatcgtggagatttcagagtttaaaaggaagatttttttgtccatttaggaaaagaaaagtttaatattttccagaattcgtcatatgcgaagtagtctttgtttctaagattttgggatgtattaatgcatctttgttaataatgatcttattgtagtggtaaatatcaacaggaatagcattgaaaaaggacattataagttgtaataaggaatctactatataatatccggttatgagccagtattactgttttgacatatcttcctaagtacagtattagcttttcttttcccacaatgtgtaaagataaggagataaactaactggcaatctaagtttgtaatgaacttgaaaacattgtatagcattttttataacacaagttaaatcacaaagagttaaatattgttaatatttatgtcaattttataaatttaaacaaattttggggatataatgcttgctgttgatatttacacaaatatgtaactctatcactgggaaactagtttgatgaaatttctgtttccatttcaaggtctggttgtatagaatttcctgccacttttcctggaaaataaactcctcatatattaaatttattatattcactgattgaaggtcctcatatccagggtttttcctgggttctgtgttccatcattctgtatactttaattttgatgggtccatctgaaacatctgccatgagtagcaaatggaacactggcagcccttgggttaatgcattttaagataaaaaagttgttatttcataaatattttctgagttttcaactttatagttagaatttgaagacagagaacatagaaacaattacttttaagatggttaatagttatggccattaagattttttattaacttggctttcattctctattgtttaaaaatgtgtaatggcttaattaaggtggctttttatttcgtttgaatttaaactgtgtgaccaaaatgcaaagttgccctatatcctggaaatgaattaaataataaggatgctacagaactttattgattagaatgagtttcatggattcagtactttaaatatcaactgtactttacattaatgaacatttttatttacattatatatagctctgaagaaaagtatgatagttatattcttaatataaaacattcaaaggagaaaaagatggaaactacatgaatctaagataatgagcaactcaaccaggagaggtcatcacaagacaaaaagtagcatgaaaatctaaaactatcatttttctttggtacacatttttaaaatgtgatgagtatgctaaaactttctgttcctaaatacctttttaatatgagggacagaagatgtttatttcacaacaactgcatttcaaatatgtatttgcttatgacttatttctttttctctgtcgacagacatataaaaactgttaatactatgtgttgtacaagcagactagaataaacttgaaaacaaagctcatcactatggttatgtaaaaatataatctaatttctttgcagatagcgaaaatgaactgctgctgagctgatgtaacaaatcgtgtatcttcccttcctgtaaatgtagatacacgggacacacgtgggaagtttaaagaaaatatttcactcttagggagttgcatttatttgaacatattataaagaccttgatggtgcagttctaaatgatgaggagattaagctagcgcttaataaattcactttttagagttaactgaattttcacttaaataaatgatctctcataaaggccaatttacatcatttagtagaactattaacctataatttcattgaccaacacatttgggaaatgtgttttgaattaattcacatattctctaacaaatacgattttatacgtgtatatatacacacacatgaatatatatgtgtataaatatatatgtatttgttcatatgttttataaaaacatttgaatacatgttataaagtacatagatacatatttaatatagcacatatattaagtattatatgtaaaaatgtgtatatttatatattttctaaaacaccattcaaggaatttaagttgtttacaagtttatagaaaggtctttttccagtgcaattattttaagtaactaacgcaacaatattaagcaatagtatattagtctattttctcttcctcaattcatatacttctcccaaaatggtgtattttaaatgtaaaatatgtaaatgcatataaaagcaaatactgctggtttatagagaccttgaacataataatgaacttgtcttaatgaaaacaatttaaacttaaaaggagctttaggcaagcaaaattcattggttgataaagcatagcacattatttgcttaatgcaactaataattattaactaattggagagaaatgtataatctcgattttattataggcacggatattcaggaagtaagaatcattgttcaaattttactctttaccatcaatatatggcaaaattgggcaaaaaaattaatccacaaatttaatttaggtcttattaacctttatgcagttataaacctacaacgtatcattttagatgatatcaaagttgtttggtgcatatcatattttaaatcttacagttatgtgccccataatgacatttcagttcaatgatggaccacgtgtatgttggtggttccataaaattataatggagctgtcatatataggtgtgccatttttcatcttgtatattatatttttactgtatcttttccatgtttaagtatgatgagatacacaaagaggcattgtgttataattgcctatagtattcagtgtaataacatgcagtacaggtttgtagcccagaagcaacaacccataccaaatagtctatgctatgtgtgtagtaggctacactgtctaggtttgtgagtgtgtactctatgatgttggcacaaagacaaaattgcctaaggatacatttctcaaaatatatccttattgttaggaaatgcatgatgatatatgttttttgtctattttaagtgggaaaacctttcaagttctataatttctttgagatttaattcactgttccttattagtaaattcttctagacaaaaacttactcaaatgtcttaaagtttacataaagcttcctttttttttttttttttttttttttttgagacggagtcttgctctgtcgcccaggctggagtgcagtggcccgatctcagttcactgcaagctccgcctcctgggttcacgccattctcctgcctcagcctcccgagtagctgggactacaggcgcccaccaccatgcccggctaatttttagtcttgtgaatcttttttatgattgaaagagaagaaatgtgacatgtctacacatgtcatctgtttttaaaaagtagatttttgtatttgttgtaaatggtatacagaatcaggagagaatctaggctcagaaattcttaattcaaatgtgcttttctttaaaatattaaacatatggagatccaacttgtgcaagttgtctgtttagtgattgatgtcagtgggatgaagaaataaaacatgtactttaaagattttcccatctctagtcctgatttgtgaagtgctttactttatcattttttactacttgcaaagttataaaacagcgtatatagtaattttaagcctcaaaaccagtgttgtgtgaaataaaataaatttttatatttatatctgtaccagtatctgaaactggctgttacctgtttctagagagacacatattttaagataagtagttatcagaaacataaggtatatttctacaaccagtattgggctgctgaaataaattatatgcttatttttgccattttaataagtaagaataatgatgcaatcatttatatacagctgttaattttcaaatgaaagccttgaaaataatacttgtaacagagtgattcactaaaacactggattttcccatctcctgggctctgtagaagctatatgttttagttctgagcagataaggatgttggaatgtggaggtgcttcctctttctccatcctaacagttcattttatgggaagaaatgtccgtctatcacactcttagagtctatgtctacagttcattcgttccttcctatgttaggtagagttacttatctgtttggtgactatgggaaaaggacctagatgtgcttagctcagcccctcctttctccttccaggctgcctgcagaaagaatagattctgctgaacgatagataaaagtaggctttgcctctgcactaatagtgatagcgcgaagagccttatggtgttcggttcttcctatggcttgagactctgtttaattttagaaataaggttaatgaatcccactgtatcacacatttaagccttattcttttgtatcagcaatacttatataaagaatgttatttcctctctgtgagttattttctaatctagaactcagagaagggactgagattgactgtactcagtaaaaccacaaatatattgaaattgccaaaaataagattgatattaaactaaatgaacatgaaataatttctgcatagtttagaaactagtaaagaataagacttggtttttccattgatattgagttgaagatttggtgttactctggttaggacttccaaactctcccattcattcattcattcattcatattcctacccagtgctatccgtggtattattttacagagatgcttagaataccgtttctttatctgtggtaaataacattgccatttaaaatacagcctatttacaaactttagccagtacacatccaatttcatcctgtccatgtaactatttagtaaattatatatgcctttagttggctgttacatcatgatccttctgtaaaatcctgaaggttaaatgttttaagccaattattctttccaacaaagcatttgcacttagaaaacaaaattgattctttcttcaattgtaagttttgaaaaatatcttcttaaactcttctttagttcactttggaggtagctattcataataacagcttgaagtaactgattttttatgacactgcagattttaaagcctcccctgatagtaggaaatctagatataaagatgtggttgttggctctgaatttgcttgctgaagatcacatattttgggtatactgtaaaaatgttgaaaaaatacagaggagctcctgggggccgtattctgtatttaccttgtgatttaggtttgcttgaaataccctcataaacataaatagtgatatatgctttaatgtttttatgtttaggaaagaggtgaaattagattctgagaatacttttaccaggaaaaattccccaaacatatataagtttttccttaccttttctagtacattcacaaccttcttcatctgcactgggatggtgatctggaaatgtgaatcatagaaaatggcaggcaatagaggtgtgactggcatacgcactgtcaaaattactaaacctgtgttgtctggaacatctaagatggaatcaagttacataaagtttagttaaattcaggaaggatttgttcacctctatgcattagatgtcatattgaaatagtatgtgaaaaggaaaatcttgcctggactcacaatttttatttactgttataatgtcatctatgctgttcaattatagtattatttgaaaggaatacatgaaaaaaataataggcacagtttgtattgttaaaaaaacagtctgttaagtggtgaaataccatgatatgccaaataaaataataactctaagaaaattgtcttaaaattaaaggtgcttctatttttaatagaaaaggcttgaaaccaacccaaatgcccatcagtaatagactggacaaagaaaatgtgacaagtacacaccatggaatactatgcagccataaaaaaggacgagttcatttctttgcatggacacggatgaagctggaaaccatcgttgtcagcaaactaacacaggaacacaaaaccaaacgttgcatgttctcactcataagtgggagttgaataatgagaacacctcagcacagggaggggaacatcacacacccgggcctgttgaggggtggagggctaggggagggatagcattaggagaaatacctaatgtagataacgggttgatgggtgcagcaaaccaccatggcacatgtatacctgtgtaacaaaccttcacgttctgcacatgtatcccagaacttaaagtaaaatttaaaaaaaaaagtgcttattgtcacttctatatcatagactgaagtagttattttgaactaacagaaaacacatgtggattaaattttatcactgttaactgattttttctaagcagtcacctcttaatgggaaccaaattattaagtaacataagtacagactgtctatatatatatgtctttttcagacattggtcaaaaatttataaacagaactacatgaaaaaatttcagcctaattatgtcacatagtgaaattatagcatattttatgggtcttatttttaaaaatttattaagtacgtgttaaataatggcctatgatgcattaaattacttaattgctaataaattctaacttaaaatgtaaattgttacgtagcatatttgaaacattttttggttcaaataaaaatatgtctggactataaaatatgactatcaggttttcagattatgaaactattatactagcttagtgtttttaatgccaaccaactgaagaaaacatgattcgggtgtttttttctatgtattcatagcaacaataacacaatgagttcgatgctgccatcaatactaatgttactaattctcatggtattttactcagtggatttgaatgtggccatagaatctttctccacacaatatgccagacagccacgtataatcccatgagatttggtattcaatataaaactttacttttttactcaagttatatatattgccaccaccagcagtttttcagctaataaagtatacttatgatttaagtcacttggttaatgtcctcatccctaaagaatatgttaaaacgaatgcttaacttatagtagaagagattttcaatggcagtaatgaaatttccaaaaatgaaatttaatcatgcctcatgcacttctgtagtatatgtaagttttatttatatatcttaacgtaagcatttaagttattaagttatgactagttaaaaggaaatagtagcatagttaattgtgtttttgtatgtccacagtacagaattaagaataactattttggccaggtgcggtggctcacgcctgtaatcccagcactttgggaggctgagacaggcggatcacgaggtcaggagatcgagaacatcctggctaacacggtgaaaccccatctctactaaaaatacaaaaaattagccgggcgttgtggcgggcgcctgtagtcccagctacttggaaggctaaggcaggagaatggcgtgaacccaggaggcggagcttgcagtgagccgagatcgcgccactgcactccagcctgggtgacagagcagagcgagactccgtctccaaaaaaaaaaaaaaaaaaaaaaaaagaataactattttattgtgtcagttgacaaaaatagtaccgtgtcagagataaaaatgtgccgtggtggggtattaacattgcttctaccattaagaacataaacaaaaacaaccttattccaatattctagatactgagggggttatttttgtggaattgattccaaagacagggatgcttgatcaaagaagatgtttagtttttggctaataaatgttgcctgattgagttccacaaattctgtaacaatttacattttcagcatcaatcaatgagtgtccttttctagaactccaggcagcagtacatattatacttataaaacgttctgcttgtattacgtaaatagctaatatttgttgtgttgacttcttattaaatgtttcttcccagcctttcaaatcaggcactactctttatgtgtactaggtcatttatttcttataacaatgcttcagtttgcaaatgaaaaaatcagagacacatggagaagtaacttccctgggccaccagcttggcctatttccaggtccagtgctcttcactgtggcatagctggctgagagtgaagtgctgtctctgtgttcaagttctctaactaagaagtttcagcttacatctaggcaacattttaaggcttgattgcttgtatataaaggaaaaagcctattggcataatgtttctatctttttgtttacttattccttgatgacactgtcatatgttctggagacttaaaaattacattggtaaaaaataaagaaatatatttgaaataaagagaggaatgcagctctttcaatggtagcacattaaatcataatatatatgtcatttttgttcttcttcacaataaggtacttttgcagtgtagttctatcatttgagtactattgaaatacatgtaatagtcatgtagtgaaaacatttatttaaagctatgtaaaatatttcttaaaatgctttgtcaggtatacataaaagctgtctttaaatcagttctcaggaaatgttgaagtctgtatcgaaaactgtaaatatgattgctattactaaagttaaaagatggtaattgtttaatctataagcacagttttgagtattcatttcatacaatagctaatccatgaagcttttcttgagagtgctgttgagaaaataactttttcctttgctttcatggcagtgggaaaatatttgtctttaaaatatttgccagtcctaatgcttaaatatttcttgtatccatccgctgctctccattcctatcacagcttctatagttaagattttcagcatttccctccaggcattaatttagtagcctcctggtatgtctcccggattctaatcttccccctctagcttatcatctatatctatgccagaaatactttcccaaaacacaaatcttgttatagtactgcatttctctagttcttccctgtctcttaaatttagtctcctcctaacccaacatttgcaccctataatctaaccgaccatactgagatctttgcagtttctctaacacaacatgctgtttcgaatcatatttctcttataccttgttacattttgtcccctcctttcatttttcctgttttatctatgctgttttagaggaaactcatttacggtccaagcctcagaatcttggagcagactgatgtatcaacacctccctgtggcaatttgctctaatcacaggtgaaatactaagacgcagcaggcaaattctttggtttctgaacttataaggaacacagtgatcacaaataatgaaaaccacctccaattatctgatattaaagtgagaaattaccccatagtatcgacaacagaaggaaggcgagaaatatattttcaaagaataaaccacaaatattttcctcattttataagtaaatgtgtatctatcataagggaaatttgaaaccatgctgtgaaagcttacaacttctgcaaccctttttctaccggattttattttaaaagattttctctgcttttcttaagccacatgggtgatcacgtgcctttaaacccaagcctgactgtcctttccacaagctattatctgaagaattatttgttatctgcatgcaaattaaagacgtgtcaacaaaataattattgcatctaacaagtactttaaatagagtacttaagatgtcaccaaatcttctaaatgatagctgtagcttctgaaaaacttgataactatatatatttagtgtgtaataatccagcagatgcgttgatattgttgaagttgttatgaaatgtcaatgaatttcatttccacttttaatatgacaaaaatataattttataagtataaaaatagttacttctattctatttgtttatattttaaactccgtcttcatccttacctttgcaacttagtacacacttctgaaccatttcaaagttggccagtctagcgaagcctgtttcaaattttatattcttcacaatgatccctgcagtgatgcctactaaaaacacattactctcttttctattagtccacaatctgcatgagcagagcctgtattttttcccttaggctgataggtattagggaatggttgtattaaaggaactagactttagtaaacatgtttcatcatattaggtactgtactggttgcattataccattacatgaaattagcccaaatacctctgtgctgtaatattcaaagtataaggatgctcaagcattttaaagctcactggttccatctttatacagttcttacttttgtcaagtccttccttgcattgatacagatttacactcccataaattccagccagtagttctagttgggcttctcaaataaaagcttaatatttacccaatattctactgccgtaaaatacttgaagacaaatatagaatctaattaaatataatttaagacttagtcgctactacttttatagatagccaactaataccttgaagacaaacacattccttaaaacactgtgatttatatttacttatgtcctccaaattacccaaatatttctaggtacacaaccagtgttaaataaatacaattgaaaatggaattgaaatgggttagctctgtatacaaattgtttcttaaagtgcttatagctaggttatagcaacaaatatacattgttgtgttttgatagctaaaagcatcatactaagaagtattataattgtaatataatgttagttgcaaacaagtgtgtctgtaagtaatcttggtattacagaaaaaaaaactgccttaaaacttacatatctgtatgagtcaaaaccaaaaatgaaacagaaatatttaaagggactgttgtttaaaagtaataggacaactacagttattttaaaagatagtttatacttatttgctcagtgtgaaataaaacatttttaaattttaatttattatctactctttgcccaaagtatattagaaaaatgttactgcaatttgagtagtcttcatattgtgataaaataggtaattattatatgcaataatctgaggcattttcgttttacagagcatataatcacccacgtatcaatttttggaatttaaaatgtgttgttggcacaattagaatcatgtatctactttcaaagagagatttcagaatattgcaaataaaaatgacattgtttcttttatcaaattggcatcaatagggcctttttttcaaaaaaagcttttagatctgctatttgttcatttatatgtgtataattacagtattcagaggatctctcatgctgtgtttgtttccacatatggattttcaaatgacaaagtctcaagtggtggcgctaaagacaaaccatgctagctactcaagcatttccttcctggagttgtactgtgtcaactgctccctaagaaatgggtaaagagggactactcagaaacatgcattgagcatcagcatgtttttgaaagattaatcttctagacctggaactaaaagtatcttccagttattttctttattatccactttatcagcttccacataacacattcagttttctacattttagtttaaaaattgccatttaattctatgcttctatgaagtcacatatcctacttatgctttcttaatttcaaaattatttgcactgtccattttataatattttatctatcttaataatttaccttaaagttctcttttattgaataggtatgacaacatagaaattaaaattattgaatcattccaattagtccacaggtaaggtcatcagtgagtgattaaggaaactctttctgttataacattttagctaaaacctaaagaaaaagccaagcaaacagcaggaaaagactgttccaagaaaaagaggacaacctcacaattccaacattggccaagtttggaagtcactttgatgaggagatatttagtggttttggaattagtcttctgttaaacgtgtaatgaaaagaaaattttgaaagagtaaattatcccgcttaattgtctatcagcaaatagaaaagaaattttcactggttagaaatataggcagtcgggccgggcgtggtggctcatgcgtattatcccagcactttgggaggccgaggcaagaggattgcttgaggccagaagtttgagaccagcctgaacaacatagcaagactttctctctacaaagaaatatttaaaaactagccaagtgtggtggtgtgtgtctgtactgtagtcctagctactggagaggctgaggtggaaggattgcgtgagccccggagttcaaagctacagtgaataatgattgcaccactgcatttcagccagctgagacaagagtgagactctgcctcttaataatttttttaaaaagaatttaggtcagtattaaagtttgtgataattcaattatatttagcttagagaattttgctaataaaaataactttgataatttaacacatatgtatgttattgaaacagcaagcattttgaagaggcaattttctaaataacctttatttcaaagtgtattgtttattgctgtgttagtttgttttcacactgctataaaggaataccagagactgggtaattgataaagggaagaggtgtaattgactcacagttctgcatggctggggaggcctcagacaacttacaatcatggcagaaggcaaaggggaagcaaaggcacgtcttacatggtggcagatgagagagaagagcatgaagcgggaggatccccacacttaggaaacaaccagatcttgtgagaattcactcactatcatttgaacagcataggggaaccatccctatgatccagtcacccccaaccaggtttcacccttggcacttggggattaagagggttacaattcaagatgagatttgggtgggttcacagagccaaaccatatcaatcgctgactttaaagaaaacgaataatattgtttccaatctttacatagtttcacataacatttttgagagtataactgtaacccaacatttacaatatatttgtagttattttttaatgtgaataaaggtaatatgactcatattcttaagaatttccccttggcattactatgttctactgtttcaaaagtttgcttactttaataagatttcaattatttggattgttaatacattgagatagcgactgaggtttattctctcatttaacttatttttcatcctataaatgtaaggtgtacaatataatattttgatatacagagtaaactgattactaaaatcagaacactaatatattcattatctcacatagtttttattagagaggtatgcatttataagctgccaacaagtccaaggattgttttaaaatgtatctttcattcttattacatttgtgacttcctgggttccatgccaattgtttgtttttaagaaatgtagtgttataacaagattgtttcagaacttcaataatatgcaccttcaaatagaatattataggtcttgctttataatttgtaaactttcagcatctttgcggcttaactttgcaacatacttcaaagacttaggcttcatctaatttgacataaaataaacaataaccagcaagtactagatgattatgcatctgatatggtttggctctgtgtccccaaacaaatcttatcttgaattgtaatttccacgtgtcgagggagggaggtaattggattatgagcgcggtttcccccatgctgttctcgtgatagtgagtgagtctcaatctgatggtgttaaaagtggcagttgtttcctgtgctcgaatttactctctcctgccaccttgtgaagaaggtgtctgctttcctttctgccgtgattgtaagtttccttaggactccccagttatgtggaacagtgagtcaattaaactttctttgtttataaattacccaatctcaggtagattctttatagcattgcgagaatggactaatacagaatctgtaataaactcatgcagtatctgtatctcagattgtatctgagattacagtctctgctaaaatacgttctttacagatgatcaatttacttagaacataggccaataagtggttatacacagatgtctgttggccttgaataatagcactggccattgtcagagttggtattggggaggttggtgtataaagagtacgaacttcatagagcagcaattctcatatgctaatatgcatataaactacctggcagattctgattcagtaaatctggagtggaacctataatgtaacatttatttatttatttgtttatttatttttttattatactttaagttttagggtacatgtgcacattgtgcaggttagttacatatgtatacatgtgccatgctggtgcactgcaccaactaactcgtcatctagcattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgttttccaatttcatccatgtccctacaaaggacatgaactcatcattttttatggctgcatagtattccatggtgtatatgtgccacattttcttaatccagtctatcgttgttggacatttgggttggttccaagtctttgctattgtgaataatgccgcaataaacatacatgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcgttgtggttttgatttgcatttctctgatggccagtgatgatgagcattttttcatgtgttttttgtttgcataaatgtcttcttttgagaagtgtctgttcatgtcctttgcccactttttgatggagttgtttgtttttttcttgtaaatttgtttgagttcattgtagattctcgatattagccctttgtcagatgagtaggttgtgaaaattttctcccattttgtaggttgcctgttcactctgatggttgtttcttttgctgtgcagaagctctttagtttaattagatcccatttgtcaattttggcttttgttgcccttgcttttggtgttttagacatgaagtccttgcccatgcctatgtcctgaatggtaatgcctaggttttcttctagggtttttatggttttaggtctaatgtttaagtcttgaatccatcttgaattgatttttgtataaggtgtaaggaagggatccagtttcagctttctacatatggctagccagttttcccagcaccatttattaaatagggaatcctttccccattgcttgtttttctcaggtttgtcaaaggtcagatagttgtaaatatgtggcgttatttctgcaggctctgttctgttccattgatctatatctctgttttggtaccagtaccatgctgttttggttactgtagccttgtagtatagcttgaagtcaggtagtgtgatgcctccagctttgttctgttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctttttgaagcaattgtaaatgggagttcactcatgatttggctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttatgccagttttcaaagggaatgcttccagtttttacccattcagtatgatattggctgtgggtttgtcatagatagctcttattattttgaaatatgtcccatcaatacctaatttattgagagtttttagcatgaagtgttgttgaattttgtcaaaggccttttctgcatctattgagataatcatgtggtttttgtctttggctctgtttatatgctggattacatttattgatttgcgtatattgaaccagccttgcatcccagggatgaagcccacttaatcatggtggataagctttttgatgtgctgctggattcggtttgccagtattttattgaggatttttgcatcaatgttcatcaaggatattggtctaaaattctctttttttgttgtgtctctgcctggctttggtatcagaatgatgctggcctcataaaatgagttagggaggattccctctttttctattgattggaatagtttcagaaggaatggtaccagttcctccttgtacctctggtagaattcagctgtgaatccatctggtcctggactcttttttataatgtaacatttctaacatgctcccagatgatgctaatgctgagactgatctatggaccacacattgagtagcaatattttaaactttgaatctataatgaaagatgtcatagaaaatttcctacttattttaaaattaagaagcacactttagaggaagaaaattttaaaaatatataattatgatatctcatttttattttgggtataaatagaaggtataatagtgtagttctatgatatgattagacgaaaaaaattcagaaagatgtagatactccactaactagttggatagccttagacaatttatataatctctcagagtttaagtttttgtagttatgagagaataaaactagattatctctaaaatccattccagtttttaaatctatgattctagtctcctaggcttctgagtctgagaatggagaagcacctcttataaacctcagtcttgcttttatatctaactggagatttggaatagagtttccaggttatttatgaagtttaaataatattatacatatgagtgtggtgcttaacaaattgccttaccaataacaagtgcctaactaatgttattaatgtttcctattgacaatatttttacctaccttagtaaaactgaatcttagaaagtgagttaacttcttccaggacatacaggtttctagacatatgctgaatcactgtataataacaaaatacctatgtaattgataatatattagaaatatacctttaaataaagccagtaattataatgaaataagaaaaataccaaggaagaaaaaaatgcttgtctctctatgttcaagctggtaaaattccatcaaaatcaagctaatctcaattacccaaatactctgtcctcttgtttgatagtctgtgtgtgcatactcctttttattctaatataatagtgaaaatattaagcttaccgatatgtaaatagcccccaattatattgtgtgatgtcatgtttgtaaagcacacattcatttactaaaattattcattgtttattatttatagctattatttctactaataaaaagcatttccacacatgagcaaatgtatcaaaaaaagtctaagaagatgatcagattgatcagtgtactctatgcccttcttaatagtaactgagtgtgattttttacattgcatactgccagaaatcaccacatgtagcatggcagatggctgccaatagtcttgttatcctttcataaattatgtggcatttatgccattagggtgatttttcagtttagaaaagacaactaagggtcagtcttttctatgataatggactcacaagggacctcaaaactttaccatgaacatattttatatcttaagttatcttccagagactttgaatgtttgaagctggttgaggtcgggaagtcaggacagaagagggagtagagcacacctgctctaagtataggcatttcaacgttcagaggaaattagtgtggcgtggaggggcaccaggggtggtagagagttcatgctgtgctctctcgaggttggattctacagaagctcagcgttggtgtgattgttggttagtctggtgtggtttggtttggttctttagtaggtggggcccctaagaacctgagtaatgtccccatgcactagttctgtaaacgcggaagcaggtggtggcagttaagtgactcacactcatttaggctctaagccggccctctcattcaatatccagcaattcgatttctactgttgggtttacgttgctttgctagtctggggcctgcttcgaagtgtcaaaatagcagtgccattgttcgtggtgaatttccagcaaaagaaacagacagaatgttttagcaccaagttgtgtgatttgagattaaaatgctctgcatggctattcctcatgatggcacttttgagtgattactacaagaaaaacgaactgttaaaatttgaaaaggggaaaatgttggatacagctcaaatgatccatatcaactactcagttattcacctgtgttaggtatttcccaacttttcttggggtatcctttatagagtagcctttgtcaagtctcataaaaacagaactaatatacttccacagtatgcagtattaattttatatttcgatttgctctgaaactttgttctctcttgagactaacaagtaaatcataaagtgaatatttttcaatgtcgaagttgttctgaaagtataattttaaaagttctttcgggccataatatatgcctttggagaagttaatatattattgaaatatctacttatttcatctgccacatgaaaataggactgtttcatctgtccttaaaagcaaggtggaatatttgcttcttttgaaatgtctgtggcattttttttcttttgcatattctgcaacacaaagaaatatttaggacttgaaagaagaaggtgagctgcttgattacgctgtactagcaaactgtgaatttatgttatttacaaattataattaaaagcctaagaagaaaatgcatgcattattttatttaaagaaaagcctctgcataaaaacactcatggaagagttattttcaatttaaaaaatagatgattatgtgtaccataaaatagatgatttcatgtaccataaactactatagtaatttgccaagagataagaccaaggttaattttttttcaaaattaacttttaattacaatttaaattaaatcactttaagtaaaatcataatttaaaattattcttttaatcaaaaggtttttattttaaaaataaacatgtagaaaagaattatatatacttaatatttaattctttaaaagtttactgaaaggtcatctagttacttcttaatgagcaccatatttaaatatatttataatgaggtttgggtttttttattcttttcaaattaggtttaaatatttttcagttaaatttggtttttgcaaactacattccttgcacatcatgaggctaaagccagatatgtgacataatataagaaaagcatcctaagagagaaaacattctcaagctctaaaactataaaactttaagtataaattgatgataaatgtcacattgttattttaacattttttgtctgggaattctatgaagaagtaggtgcaaaatgttactatgtggaaaatgtaatgtactttgtgcattgaattttaaaatgacatggaaggtctgaagaacacagaaaggttgacagctcaccacagatttattaagtatattcaggtttttatctcaagatttttttaattacttgagtgttggtattgataaatttgttgttgttattactgagaacttaatatgttactatgtagatttcctaagttctctttcaatattactactgaatttgtaaatgataagtgatcatgaaataaacttatatgttgaacaatatagaccatatcattcacaagtattagggacatttcattatgggtaagaaatataacctttggacgtgtagaccttgtagtccatttcagtttgactaatcaacatgttcagtttataacatgtttgatcctctatatctctaagaatatatgtgtttttgtgtgtgtacatatgtgtgtgtgtaggcagattttatttagttgatatcatggggaaatctgttgctcacatagttgacatttctttataaatgcaactcacctcatcaaaatgacataccaaaagaactttaagaaacacatttgtaaatggcttacatattctatgctttcttaacccaaccacagtgtaaaaataattctgagtactttggaacataaccacaaacacttatcaaatatatgctccccagtttgcaattgggtccctataaatccactgtaagttgaaaatatagttaagtcgaaaatgcattgaatacagctagcctacagaacagcatagctaagcctcacctaccttaaacatgctcagaacactgacattagcttaaaacaaggcaaaatcatctggcagcatgatccactatagtgtattggttgttaaccctcgtgattgcgtgggtgactgggagctttgacccacttcttcctcccagcatgtgagaaattatgataacacagactgcaagcacagaaagagatcaaaattcaaaatttggagtacagtttctaccgaatgagtattgctttcacaccattgtaaagtcaaaatatcataagttgaacccttgtaagttaggggtcatttttatgctattttaattatgattgcaatgaccaatcaggtctgtggagctgttttttcccaccacaaaatggcttaagagtgctgtattttgctatcttttcttattgatattagaataactttttgactgttgacacttaaatttaaaagggtttctaaaaatcaatgagaaagattatggaagatgtgtttgtattagaagatgtagcaaacttccatttgaacaaaactctgcccaccttaagagtttcttctgtgtttatgattaatttgcttcaagatttctgtttgtggctgttgagttatcattctttttttttctcagtgtgctcattccttcattcagtcagttattttaaaaaatattaatttgttgcacaaatgtaatatgtctttgtataagacagacctaaattcaactaagggaccctatttaagaagtttgtggaaatagaagtgtttttaaggtccataaacatcagttttctcatttgtaaaataattggggcaataatacatgcttgagttcatagaaagtacatagcacagtgaatagcacaatttggggggtatttaacaaatgtcagtcatctttgcattatctttgtatgaaattaacatgtaattcataagcagttttaggtatctagcatttccattagctccagcgtccagtcaaagccctctgttggaatatctttgcagctacaggagtctgacttgatcaaatgtaacactttcatacctgtgtccctcccaccctttcatttgcttgactggcttctttgtatcagactatgactcaatggatttttccttttctattgctgaagaaagctccatttccaaaaattccattcaacaattcactacagcagacgacttataaaagagaaaatgagatatcatcctgtgttttcaagagtagataaagaagtagtagggttcttgcacagtcccagggttgatggcagagtcttcttcctgttcaatgtctcaagtttcatctgtccatctcctattcatgcacactgatgccatcctctgccatgctccctcatcacacttttgccacacgtgtctgtcctgaggcatctaatgtctgtggcaagtaaagtctcagaaccataccatgaagatctatggtgaatgaaataattaggtagatactaagacagagcatttaaaatatattctcatatattaattctcattcttagccattaaaatatttgtacttcaagtgttcggcttgaggttgaaaaatctgaaggactgacagcatctctcattatttcttttgggtagttaataaatgcttggatttcagttcttgatagggacaaacgatattttgttgataatggatcttcacttaaatcccatcatgcaatttactctctacatcacaaacaaccatgcgaagaaagaaaaagaatcagtgatttttctcttccctctaaggaagagattttcatagcggaaacaaagggaatattttggaaatttactgtggtgattttctggattattatgaagggggtggtggctgttgacatttagagggcgaaaatcggaaccactagaacatcttgcaatctgcacgtctggcctaccctacaaagaatttcccaccacccagtgactgtaggtttgtgcaattgcaaaatctctttacaaatttctgaatctggaaacaaactcaaatttgtatgtagatacaaagtatattgcatagttttaatgtgcactaattttctaaatataactacagtgtcagtggaggaaacgtactttgctcaggtcacaactgttttcaccatttcagaaagtcacagataccaatgctgctcatggtgtctaagtggcacaaagggcacctgtgtgtcagcctacatttgtcgttgttatattgaaggtgattctaggtgtgagtaaaacatctgactacttgattatgtcttctaatgtggtggtgcttgaatgtttacatatcaatatattattcgtgtagatcactatccttttattgcattgaaacaatgtttaaattttgtgtgtagatagactgtattttttatggatttacttcaggctgagggacagattgttctggtagccatttgttacttggttgtcaagaagcaagctaggttgatggtgaaacactataagaaatatagttttcattttctttaacatttgtatataagtgttctatatttaaataacaattacataattaaaagttttagattcacttgtgaattatttattaattgtaagattgtacctttcaagaaaactcaaccttattttttcctactttaggtggttttcttttcaagcattaaaaataatgttattgagttctattgatgaagttaaaaatctgatttccttttattttataattcattaggcattattacattttcactaaagttgcaacttgaaaattcctgtaagacacgcatcattccatataagaaaaatgtaaaattcaaatattgtgcaactcaaggtaaatttacaaaataaatttagtaagcattattaaagactcatagcctttaggttactaatatttaatattatagtccaccaggaaagatgatctcaaagagggctcagtattgatttgcttgttggtatttcagagatactgacagctgctatgacttctgctgttttttcttaactttgcccatactgagtttgctttgtatttccttgttattaacccacatctcaccatattgcaattaactttcacaataagcactccattgaatatattagaaatatttgcaatgtgaatagaaactcttaataagagcaggcctgctgctagatgataagaggtctgcatgaattagaaaaagttgcccttccatatcctgaacagatgtagccccaaagttcaggggttagtgaagagagggcttctttcttcactcccctcattcttttcctctggggagacactgtctttcacaacttcgtggacagcatgtggactaaatttcagacagacacttgccccttcagtgaggcatctttgtgcaaggtacaaactttatacacaggcatgatgatccctaacacaaatgtgtctatgaaagaaaagagaaaaataaagaacacccaagttttcatgaaagagcagttatacaggaatgaaagaagctttctaacaagaaggaaacagttgagagggaggaattaaagatagaaaaatctattgatagccaatctaatttccctgtttttaaaattcaagggtgattcactctaccacttatgagcagaaaacaaaccttagaaatagattacatgattacgatctatgtaaactttcacttcgtattaccctaattgggttctcttctaattctgtgtaaaataatacatcttttggtttatggtaagagagagccatcctactatgactgccaaattttgattattcccaaattgagagacaggaaggaaagtgtttacatttatcatattgtaaaatttgaaatatgtatttatagcccattttagaaatgtttcaatgtaagaaaatgacttttaaaaagaagtccaatgtctagaaaggcatccagtagttagtatgactgaagtacatagttagtttcttaagaactctgcctttttggtatttttccttttagggaataaataaaatcaagcctctcaaatgattttccaaatccagagccatgaagttacaggatgatggattgctaggctgccattgttatctgtgtcaatggtggtcttggaatcactctgtgtggctctatgttgtggccctctctgcacctcctaaagaatgacttcattgctgtttgacttttcaaatttccttccaaattgaaaactcaagacatttttcttcacattttattttctttttattatgccagtttaaaagtctttgaaaataaagaactgaaactcaccttcttctgaagtcgcaagtgagcaaacagaaataatggattggactttgttaatgatatgcctaaaattagatgttaagttattaaaattttagttttccatgaataaggacaaaaacctcatttctaaaaccttgtcacatttaaattacgctgtctcatttgagtctccagaaaattatgtccagtcttctgattgtcactcctataaacttatttttatttaaatgacataacctccagaagtataaaatgttgaaattcttttcagaatgacttgcattatagcttttccctcctgtggtattgaaatactatgtttcatattagaatgttttcaaatatctactctcctaaatagattagttaatggtattgtgtttcctgaaataatctgtgtaatgaatacgaacatttctacaataagtttacagtcttcttactttagagtatcatagatctaaattctaatttatttttttttttgaaatggagtctccttctgtcacccaggctggagtacagtggcacagtcttggctcactgcaacctctgcctcctgggttcaagcgattttcctgcttcagtctcccatgtagctgggactacaggcatgtgccaccatcccaggctaatttttgtatttttagtagatatgggtttcaccatgttggccaggctggtcttgaactcctgacttcaggtgatcctcccacctcggcctcccgatatgctaggattacaggtgtgagccaccatgcccagccctaatttactttcaataagcaaaattacactttgtgtcacactttccccacacacaagctttttgtgacttcctaaaatatttatttatttatttatttatttattttgagatggggcctggctttgttgccccagctggagtgcagtagtgtgatctcagctcactgcaagctctgcctgccaggcttaagtgatcctctcgcctcagcccctcaagtagctggaaccacaggtgcgcaccagcgtgcctggctaattttcatattttggttagagaggggctttcaccacattgcccaggctgctcttgaactcctgagctcaagccttctgcctgcttcagcctccaaaagtgctaggattatagatgtgagctactgcaccctgagacttttaataaatttaaaaaacaaaaaatagaaaacaaacaacaacaacaaaaaatttcattccttcctgttcccaggctaaaattactcttttgagttagtggatgagtgtatgtgtaaaactctagcttactttgctattgctgaatgggctgttgttatagccattgttattcattgacatttcagggctgagactatgtcattctagaacttcgactcatactctcatgttaatttggtataaaagaaacataatgaagaaagtgtatttatctcattattatttgttgtgttgtttcttcctgcctctctaaatcccacttttttgtacaactaattttttctttcatcaacttttctattaacagcttttgactttataactgcagctaaatggatgataaaacaaaataaggtgtgacacaaagaatgaaacagtgaatggaagggcttaggtataatggaaggaaatgtcaggaagaaagtcccagatgacttttcaaaacttcagggttggcagtagctcatggtgggagagatgtaactcagttgatggatttgatgaattttgtccaaacgttggaatttggactggtcagatacaacagaaagcccccagacagtgactctgcaaaataaatatacaaaatgtgatcctgacattcagaaactcatctttttctgagatgctttaggccatttttcgtgattgaaagaaagcgacaacagctctatcccccgtgtccatgatcagagaaagagaaagaatgaagattcaagggccgaaagcgtgaccagctgagtcacatttgaagccttcctgaaagcctcactcagtgacttctctttaaacagctttagctagaatgatggcacctggcctctcttacttccaaattagacgagaacatactacattttagctgggcacattactatcccaaaccaaactggggtgctattagtaaggaaggaaaagagtagatactgggcaggcaattagaaatctttgcagcaagacattcgggaaaggtattatttagaaaagtaccaaagtctttttgtgtccttgatgtggattgaatagagtgagaaaaattgcctgtgtgccggtttcccagtggaggtacatggagaaataagaattgtttccttctgcatggtaagcagctctccttgtccaattgtcccctattactgaccatggtcccacagcaatatagttctatttctaggaatggactaggaaaaaaatcccagaggagaaactcccacactgatttctacttctaaaattcaatgtatttgtacctcgcgtctctagaaaaattgtgttttagtatatcagcttttgaagacagctgtacctaaatccagccatccaaatgggacaaaggaagcagactttcaccttcagaagcagccatgagtttgtgtctgctgcattgcactttcaatatctaggacagaatttcatacttattatataattacagtaatacaatttgttattaaatagttgccaaacaaaatagaaatacaataaaaatttaaaccactaacctttaaatgatatattttgttttaagaatattgttcagctcagatatcagcagattaatgatgagtacaactaaaccccaatcagttgaaagaaatgtataacatatcattttaagatctctgtagtaatttattttttaaaaggaacttaatatcgtggattttaaataattgaaaatattttttacacttggactaaatgttcagatgatttttattatgcaaacatcacatctaattaaagatatttcaatattatatttcaagacattcagtaaccattcattaagggctgaatattatatagtgggataaactaaggccatagaatatttatgtccccagccataggaagttcgccatttattggaggagataaacacacacataactgaatttggttttgatcttcctctgacctattctattaattcaataatgtaggcctaatcattattgatatactttattcttgtcaagatttgccacattatttgccttgaagttatttattgcaaagggatttgttctctttaatggatggctctgcattttagcatatgcgtttgtctttgagaaaccaccaagaccaccaggctaagacattgaataattaacttgacataatatttataaagtagtgagctagaaagttttgaaagattctattaataaaaatggttcatcaaatttcgggggcaaatgccttaaacatttattaatagctaaacaatatatgaacttttcctgaggaagaaaacatttcttcctaagtagtttctaagtagtaaagtctaatccagatcttgttatatgcactgtagagttcttttttcagaaaacaacattgcatagtctatatttctttttataggacaggcagctgcgttagtgaatgattcactaatggtgcgaagtctttctgtcaaacaaacacacagttcacttagttgggcttcaagtactttagtttttttcctaaacaataactgtctttaaaagaaagaagctgtgtaaacattgaatacagactttaatttaagacagatgataacccggaagtgaccacttctctttatcatcaaaataccgctgaagccccagtgattcaattgccaggaattcttctttgcttgaatttgatcattcttctttctctttaaaatactgttgttaagcactggatcggcaatgtggcattgtctctagggattgaattatgtttaattgggaaggaagcacactctctcttgtttttagttcataaagtaagaagactatcaattagtaggcagtgcagcccaattggagccacgctgcactacagacagtttggaggagattcatagtaacaaacaagatttaaaatacatgtcttgtgaaaggccattataggtggatggctgggtttttcctgtcttttcatgctgtagcagcattatattagaatgtgaaggacactcatatccataaaataatggctttcgtaatgcagatgattaaagtaggaagcctacccacttctatttttccctaggcatataccaggatcaaatttcaattagtgacctaggaactgcaggctctgtattctgttatcaatccctttagccagctagaatcaaagattcacctgtcactctagactctcagtgactctaaggaggatttagaatagacatctgctctatcctgttacgttgacttctttatactgtctgtctacaaaatgcattatgaatatacagtgaacattacaaatattctaaggtccattaggaaatttcattttctgtggacaaggattttaatgttaaatattgatagtgatttctgctaatttattgttgatttgctaaaccaggccattttacggaaaaattttaaatatgccctgttgatcaggaaccaatatatatatttttcaaagtgtcagaatggttaccttgaaatcatttttagatatgaattgcagaattcctagaaagaaaatatgctctcttataggactgtgctttatcaggaaatggcaggttatctagttatattttaaagataccaaatttgtttagtgcagattttacttctatagtgctcaccttgatgagcatcacaatgatgttcttttatttttaaaatgatgcattataatcccattagagcctttgccaaccagtaaattattaataagacgatgatcatgctaattaagctactttattagattttgatggattttgtgccagaaattatggtggggtctttgaaatatatagagtattttctcttagagcaagtcgtctagcatcattgaaaactttactgaaaactcttcattactcataacattgctcgtctgtttcaaaatgacacgatagtcactttcacagaaacataatagtatgcaattcaaatgtttaatttgctgctgcaaaagaattcacaatagaattctcaatgtggggttaattacatagtaatgaaagagtaaacctattgggaaaatgctctaagtaacattgctctgtttcctactgataaagacgtgcacgcctgatttattttttatgctgggaaattcagaagtaagagaaaaccttgaaaaggtatgcacatgaataataaagttttttatcatttgtcaacatgatgagaaaatgatgaacgtggataattattatattacaaaggctataatcacaaaatagtaatgtataagaatatagcattctattatacacaggagaacatgatacattaaaatcattgataacataatctaaggaaagacatcgctaatcagaacaaaaaaaggaagaagtaatagagcaggcactcaaaattgtgtccatgttttctacaaataatcttcaccctctctgcctatgagtatagtgttatattgctaggtatgttatgtttactccatatatgtcaaagactccactgggggaattgaacaatgagaacacttggacacaggaaggggaacatcacacaccggggcctgttgtggggtggggggatgggggagggaaggcattaggagatacacctaatgtaaatgacgagttaatgggtgcagcacaccaacatggcacatgtatacatatgtaacaaacctgcatgttgtgcacatgtaccctagatcttaaagtataataataataaaaaatttggaccacaaaaaaaaatatggtatcttaataaatatctcaaaacagttataagattgacaatatgatccctactttgttaggtgaagaaaatgacacttttaaaaacataaaaagatttcctgtatgataggattcaaattcatatttgtttgtttccaagggctttttctcattcattatcctatgctgtcatgtaaattaatccatgaatattgcagcttgtatcagaagcttgaaagttcacagaaagaatcattttctacctaaatttgcccatcaaatttgggtggacagtgacagcagcacagtgttaggcttacttttaaatgacattatttaggatagtgagaggataaacaaatagactaaaagaacagaacggagtccagaactagatccacgcagatatggccaattgatcttccaaaaaggcaccaaagtgatgtaatggagaaaggaaaattgttttaaccaccagacctagaaaacttggtatccatataggaaaaaaataaatcttgatacttcataccatacacacaaaagtaattatagatggcacatagacctaaatataaaatcttaagctcaaaagtttctagaagaaaatatagaagaatatttcctggacctgagctaggcaaagatttcatagaaacacacaaacagcattagccacaaagaaaaaaaaaaaaaaaaaaagaccagtcaggcttcatgaaaaacaaaacaaggaaaacctgtgctcttcagaattaaacaaacaaacaaaaacactaagagaatgaaaaagctaagctatgggagaaaatattcacactatatatctttgacaaagcagttgtacccagcatatataaagatgtcatacgaatcaattgtaaacagacaacacagtaaaaatgggggaaagatttgcactgtttacaaagataaatgtctgataagcacaaaacatttaatgtaataagttattagctaaatgtaaattaaaagcaaaatcaaatactattgcacactcactagaattgctaaaattacaaaagattaacaataccaattgttggtgaagaggtgaagtaactaaactcacatactctgctggttggaatgaaaaatcatgtaactttgagaatctcttgggtaataactgacaaagttgagcatatagtcaccctatgacacatcagtttcacttctaagtatttactctgtagaaataaaaacatgtttacaacaggacttgtaaaaatatgtttttaataactgtttacagagagccagaatatattgcctaacattatttttatatataaaggttacagattttttatattaattttatatctttgtagattttttatttcttttattttaatctttagatctactactatatcacctacataggggcaatttaactcctctaattcttatatttctgattttgattctataattccttttattaatactctcaatagaacattaaatagtattgttgatagtggcccaactttaggtagaaatctactacattttttgaattgatgaatgaaaaattattttagacaatgtggaatgagtcaataatgcttattaccatatatatatcaccactaatctttattattttttgtaatgagaatatttaagatttactctcttattagtccgttttcacactgctataaagaaaaaactgcccaatacagggtaatttataaaggaaagaagtttaattgatactctattgagcatggctgaagaggcctcaggaaacttacagtcatggctgaaggcgaagaggaagcaaggcaccttcatcacaaggtggcaggaaggagaagtgtgtgagagtgcaggaaaaatctaccatttgtaaaaccatcacatttcatgagaattcatccactatcatgagaactgcatggaggaaaccacccccataatccagtcacttcccaccaggtttcttcctcaacatccggggattacaattcaagatgagatttgggtggggacactaagcctaaccatatcattctcttagcagttttcaactatgcaatacattattattaactctggtcatcatactgtacaatacattgtgagtatgtgaatatagtactcgtacttattcttcctgtactaactcaaaccttgtaccctttaatcaatattcctccatttggtgccacccacccaatacatagtaaccaccattctactctctgctttatgaattcaattttttttttacattttatatataaatgagatcatgtggtttttgtcttcctgtgcctggattatttcccttagcataatgttctctaggctaatctgtgtgttcattgaagcgttatttgcaatagccaaaatatcgaatgcaatgtaagtgtccatcactgatgaatggacaaagaaaacgtgatatatatatatatatatatatatatatatatatatatatatatatgtatatatatatatatgtatatatatatatatgtatatatatatatgcgcaatggaatactattcagccttttttaaaaatggaggaaatattttgagaacagtcatctacaaattttattttaccatcattgtttaatttacattattacttagaatagctatcatcagaaagacaaaagataataagtcttggcaaggatgtggcaaaaaggaaactctcaaacgctgttgggaatgtaaattagctcagccattgagggaaacagtatggaggttactcagaaaattaaaaaaagaactaccatatgattcagcaatgtcactactgagtatatagtcaaaggaaataaaatcagtatgttgaaaagatatttgtacttttatatttattgcagtattattcactatagccaagatatggaatcaatctatgtgtccatcaatagatgactggataaagaaaatgtgatgtatatacacaatggaatacaatttgaacattaaaaataatgaaatcctgtcattttcaataatatacctgaacctggaggaaattatgttaaatgaaataagccagacatagaaagacaatcactgcattatctcactcatatgtagaatgtaaagaagttgctgtcatagaagtaatgagcaaaagctgtgtttacaggcgagggatggttggggtactgtggagactggggagatactgatcaaaggatacaaaatttcagttagatgggatgaataagcccaaggggtctattgtacaacgtggtagctatagttaacaatatattgcattcttgaaaaatgttgaggatggatataaggtgttttcaccagaaaaagaataattatgtgaagttatccatatgttacccagctggatgtagtcattccaccatgtatatatatttagaacatcatcttgtactgtgcatggtaaatacatacaattatatctgtcagtttaaaataagataaaataaaataatataattactttaaagcttgtgaaggagtcaccacatggacaatataacagaaaatctctgctagattgaactttgtgatgaacacgaagtacttaataaacatatttctttgatctgtctatgcatggatcaatctgttcctgttgaggaccttataacttcctactgctcactcaacaggaaattgttctgaaagtgctctacccatcaaccttcaatataaaaatatacattttatgatttactcccagagttttgcagtggcacaactttacacaacaaatttgatcaaaatagaaatacttcaatcaattttctttggcgtaagtcaccttggtacttgtcctcatagggtttcgtgtatttcacattgagttgcatcatagtaaaatcaaggtgtatatcattcctatttccatttcacaaattatggaaatgtttcatgttactggttttgttttgctatttatttcagtgttgcttcatggaaaattgaacatagtaattaaaaatgacaaaattttaaaaatctatcatcttgaaatttgtacaatgttttcatgacattattaacaaaactaattatcgagtacagttacacgttccaaccagagctatgttgaactagagtacacaggagagctttttagtatgaactgatactcacacgtaagaattgcttatattttaggaagcgtggccaaatttctatatgaaacatccacttttacaaagtctgactgtattgttgtttatttggaaatagtagtcaaactgtaacaaaggtggaaaatcttttgcacggctgttgagaaatgggtggatcacgtagaataaggcttacaaaaccactagtgggttagcagccccaaacatctgagactatcagtacaaggaagaaatctctatttctgtagcctctgatttgctctatctcatatggagggcctaatgaaggaaagaaactgcattctaaatgatgcagagcaaataccctaaaagggaagtgcttggatctttattactttggagacctaaaagacaatgtactttgaagttagtttcttctggttaatctcttttacttgatgtagacacattacataaatccattgtcgtatgaataatacgtaacagcaataatctattatcataatgtttttaggtattcataaagtacattttctatgtctaaaggaaaagtagcagattattaaacttccagttttattttatgatctgctctgcctcttcaattcattccacctttttgttttgttttgttttttaaatacattcatatgaatgtatttttcaatttcttaccaaagaagcaatttggaaaacactgattgttcatttcccttttacctccttgtttcaatttatgttttgagtacagtacattagtttatagagactgtgattgaaaaaaaagagcttacaatcttcctcagatagctttgctctgagttttacaatggatggtttggaaaaatagtgtaataatgactgagcttctaaaatagtgaagtaacagttatttttgtgatgtaatatagtgatgtatatgtggctcaaaagggttgctatatattccccccaactccaattttatttttaatttttggttgtttttcagttttatgcaagacttgctatacctaattctacaagctatacagtgttttttaatattgattccagaatttgtttcatcatatgcaccagaacaaatacttcagtaaaacttcttctgcactttcttagacaaagacagcatgatacaggcacagctaagtctcttaagctcttaggtatccttaaaacattgacaaggaagtcaatattgaatttcagataacaactggaattttgacagtactcattagttagtttggtctgacccaggcttccatcagtgcaaactttatgccccaagagtctcacaaagcatttacagcatatgctacagaaacatagaaagggagcaggcaactggcagagtatgggcatgaggctgacagctcagagatgccactggacctgcctcatcagctctctgggcactactcactcttctgaaagtatttgaaaccttttgggctgttactttacacctggtaaaaagcatctatagaccagaagaacctgggaagagggtattccttcccttcagagccaaaacagagagttttatactcttcagggggtttccttcacaagacagttactcacaaatcaacgatattgaaattgtatatctgggatttgccctctactgtcactcatattgttcataagaacaggaacagataatatttattggtttgcaaccacacatagatataaactctaattgcttcaacagagttttatggtaagaattgtttagtactaccatttcacagatgagaaaattgaggctttgaaagcctgaataatttgtgaaaagatacaaagctcctatgtggtcagactggaattttaatctacttgtacctgacattggatcctagactcttcaataggttacacttccttcgaactgggaaaaggtagcacaaatcatttatttttaaatcaccgatactagttttgttgtttaaggcatttaatctaagttgacttccccaaaggactgtgcagatgttttctcaaattaaagtgatatttcagaacaacaagtactagaaaatttaattcaactaaacagtaaattctagaaactgggggatcttttggcctctcatacaattttattcgtataactatgtgtcccggccagtcatgataacatatacttgttcaattgataaaaactgaactgaattcaagtcatagacttactgtagaggcttgggcacatttgcagaatatacacttggaatatgcaatgaggaatagaggttaagaagaaaggaaataagtaattacataagtaataattatatagtaattacataagtaaatacaattataaataattgcataaaacaatatcattattattattattattattattattattcgaaatggagtctcgctcttgtcgcccaggctgaagtgcaatggcgggatcttggctcactacaacctcctcctcccaggttcaagtgattctcctgcctcaacctcccaagtagctgggattacaggtgcccaccaccatgcctgactaatttttttttgtatttttagttaagatggggtttcaccatgttggtcaggctggtctcaaactcctggcctcaggtgatcctcccacctcggcctcccaaagtgctgggattacaggcgtgagccactacacttgggcgacaatatcattattataaatacagaaaattcctgtttttttatatcagtcatcctagaacagagacgctatcagctcctggggataactcttcccacatcgtctggaacataattatatttaattaaaacctgaagtggtatctaaagataatgacaaagtattaaatgtgcagagggtttcagtctctcaaacaaatgtgagtttgttactatgttatgtaccatagtagtctaagggctattatgttgtttcttacattagtgtaaccatggtgaaaaccaaagagaaaataaagaatgattgttcatgttttaatgtataagagcacattgatacattgtaaaacacccagatcagttatttaatccatcttttgaaatcacagaagaaaactggtgatatacatgtgatgaggaatggcaactgtagtgatttatattcctctaattttttgcaaaaaaaagaaagttcactgaaaaaattacaactttcgcctatgctaaacttaatttatgtaaaatagtggtcacagctattaaattattgttatttattcacaaagttctcctctacatattgttttaaagtaataactgctttacagcatttttttttaaatggagtctcactctgtcaccaaggctggagtgcagtggcacaatttcggctcactataacctctgcctccagggttcaagtgactctcctgcctcagcctcctgagtagctgggattacaggcacctgccccacacctggctaatttttgtatttttagtaaaaacaggtttcaccatgttggccaggctggtctcaagctctggacctcagataatccacccgcctcgacctcccaaaagttctgggattacaggcatcagccactgcgcccagctgctttacagcatttttatagacgctcttctttgaacttactaagagttcattgaaatcagctgtgcagagtttaaatccagcaaggaaattcaggcacagacaggttggaggtaacaaaaagtaaaactggaaagtgaatcaaattttggctgaaaatttaatatatttaatagtatgtatgattcctcaatctaacttaggttaaaataatcaaaaataaaataaggtgaactactttttttttaatgggcaaggtggcagaaatggaatttccaaacatctagatcttaggtctttattattctaagcaatttttaatacaatttgagaatctttatttctgtactcttcttcaataataacattaaagcagaaggaggttccaagatggccgaataagaacagctccagtctgcagctcccagcgtgagcaacgcagaagatgggtgatttctgcatttccagctgaagtaccggcttcatctcactggggcttgtcagacggtaggtgcagcccacagagcagggtgggacattgcctcatttgggaagcacaaggggtcaaggaattccctttcctagcaaagggaagccatgacagatggtacctggaaaactgggacactcccactctaatacagcgcttttccaatggccttaggaaatggcacaccaggacattatatcccgtgcatggcttggagggtcccatgcccacagagcctcactcactgctagcacagcagtctgagatccaactgcaaggtggcagcgagactgggggaggggcgtctgccactgctgaggcttgagtaggtaaacaaagtggccaggaagcttgaactgggtggagcccactgcagatcaaggaggcctgcctgcctctgtagactccacttctgggggcagggcatagttgaacaaaaggcagcagaaacttctgcagacttaaacttccctgtctgacagctttgaagagagtagtggttctcccagcatggagtttgagatctgagaatggatagactgcctccttaagtgggtctctgacccccgagtagcctaactaggagacacctcccagtaggggccaactgacacctcatacagccgggtgcccctctgagtcgaaacttccagaggaaagatcaggcagcaacatctgctgttctgcaatatttgctgttcttcagcctctgctggtgatacccaggcaaacaggttgtggagtggacctccagcaaactccaacagaccagcacctgagggtcctgactgttagaaagaaaagtaacaaacagaaaggacacccacaccaaaaccctatctgtatgtcaccatcatcaaagaccaaaggtagataaaaccacaaagatgggaagaagccagagcaggaaagctgaaaattctaaaaatcagagcgcctcttctcctccaaaggaacgcagctccttgccagcaatgggacaaagctggatggagaatgactttgatgagtttagagaagaacgcttcagaggatcggtaataacaaacttctctgagctaaaggaggatgttagaactcatcgcaaagaagctaaaaaccttgaaaaaagattaaacgaatggctaactagaataaacagtgtagagaagtccttaaatgacctgatgaagctgaaaaccacggcatgagaactatgtgacgcatgtgcaagcttcagtagccaattcaatcaagtggaagaaagggtaccagtgattgaagatcaaatgaatgaaatgaagcaagaagagaagtttagggaaaaaagagtaaacagaaatgaacaaagcttccaagaaatatgggactatgtgaaaagaccaaatctacgtctgactggtgtacctgaaaatgacagggagaatggaaccaagttggaaaacacttctggatattatccaggagaacttccccaaactaatgaggcaggccaacattcaacttcaggaaatacagagaatgctacaaagatactcctcaagaagagcaactccaagatacataattgtcagattcaccaaagttgaaatgaaggaaaaaatgttaagggcagccagagagaaaggtcgggttacccacaaagggaagcccatgagactaacagcagatctctcgacagaaactctacaagccagaagggagtgggggccagtattcaacattctaaagaaaagaattttcaacccagaatttcatatccagccaaactaagcttcataagtgaaggagaaataaaatcctttacagacaaagaaatgctgagagactttgtcaccaccaggcctgccttacaagagctcctgaaggaagcgctaaacatggaaaggaacaaccagtaccagccactgcaaaaatatgccaaattgtaaagaccatcaatgctaggaagaaactgcatcaactaatgagcaaaataaccagctaacatcataatgacagaatcaaattcacacataacaatattaaccttaaatgtagatgggctaagtgctccaattaaaagacacagactggcaaattggataaagagtcaagacccatcagtgtgctgtattcaggagacccacctcacatgcagagacacacataggctcaaaataaagggatggaggaagatctaccaagcaaatggaaaacaaaaaaaagcaggggttgcaatcttagtctctgataaaactgactttaaaccaaaaaagattgaaagagacaaagaaggccattaataatggtaaagggatcaattcaacaagaagagctaactatcctaaatatatatgcacccaatacaggagcacacagattcataaaacaagtccttagatacatacaacgagacttagactcccacacaataattatgggagattttaacaccccactgtcaacattagacagatcaatgagacagaaagttaacaaggatatccaggaattgaactcagctctgcaccaagcagacctaatagacatctacagaactctccaccccagatcaaaagaatacacattcttctcagtgccacatcacacttattccaaaattgatcacacagtttgaagtaaagcactcctcattagaatcaaactagaactcaggattaagaaactcactccaaactaaacaactacgtggagactgaacaacctgctcctgaatgactactgagcacataacaaaatgaaggcagaaataaagatgttatttgaaaccaatgagaacaaagacacaacataccagaatctctgggacacatttaaagcagtgtgtgcagggaaatttatagtactaagtgcccacaagagaaagcaggaaaaatctaaaattgacaccctaacatcacaattaaaagaactagaaaagcacgagcaaacacattcaaaagctagcagaaggcaagaaataaccaagatcagagcagaaatgaaggtgatagagacacaaaaaacccttcaaaaaatcaatgaatccaggagctggctttttgaaaagatcaacaaaattgatagactgctagcaagactgctagcaaggctaataaagaagaaaagagagaagaatcaaatagatgcaataaaaaatgataatggggatatcattgatctcacagaaatgcaaactatgatcagagaatactacaaacatctccacgcaaataaactagaatatctagcagaaatggataaactcctggacacatataccctcccaagacttaaccaagaagaagttgaatccctgaatagaccaataacaggttctgaaattcaggcaataattaatagcctaccaaccaaaaaaagtccaggaccagatggattcacagccaaattctaccagaggtacaaagaggatctggtaccattccttctgaaactattccaatcaacagaaaaagagggaatcctccctaattcattttttgaggccaacatcatcctgataccaaagcctggcacagacacaacaaaaaaagagaattttagaccaatatctctgatgaatatcgatgcaaaaatcctcaataaaatactgggaacccgaatccagcagcacatcaaaaagcttatccaccaggatcaagttggcttcatccctgggatgcaaggctggttcaacatacacaaatcaataaacataatccatcgtataaacggaactaaagacaaaaaacacgtttatctcaatagatgcagaaaaggcctttgacaaaattcaacagcccttcatgctaaaaactctcaataaactaggtattgatgggacgtatctcaaaataataagagctatgtatgacaaagccacagccagtatcatactgaatgcgcaaaaacttgaagcattccctttgaaaactggcacaaggcagctatgccctctctcaccactcctattcaacatattgttggaagttctggccagggcaatcaggcaagagaaagaaataaagggtattcaattaggaaaagaggaagtcaaattgtccctgtttgcagatgtaaaatacctaggattccaacttgcaagagatgttaaggacctattcaaggagaactacaaaccactgctcaacgaaataaaagaggacacaaacaaattgaagaacatttcatgctcatggataggaagaatcaatattgtgaaaatggccatactacccaaggtaatttatagattcaatggcatcaccatcaagctaccaatgcctttcttcacagaattggaaaaaactactttaaagttcatatggaaccaaaaagagcccgcattgccaagacaatcctaagcctaaagaacaaagctggatgcatcacgctacctgacttcaaactatactgcaaggctacagtaaccaaaacagcatggtactggtaccaaaacagagatatagaccaatggaacacaatagagccctcagaaataataccacacatctacaaccatctgatctttgacaaacctgacaaaaacgagaaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaagcaataccattcaggacataggcatgggcaagggcttcatgactaaaacaccaaaagcaatggcaacaaaagacaaaattgacaaataggatctaattaaactaaagagcttctgcacagcaaaataaactaccatcagagtgaacaggcaagctacagaatgggagaaaatttatacaatctacccatctgacaaagggctaatatccagaatctacaaagaacaaatttacaagaaaaaatcaaacaaccccatcaaaaagtgggcaaaggatatgaacagacacttctcaaaagaagacgtttatgcagccaacagacacatgaaaaaatgctcatcatcactggccatgagagaaatgcaaatcaaaaccacaatgagataccatctcacaccagttagaatggtgatcattaaaaagtcaggaaacaacaggtgctgtagaggatgtggagaaataggaatgcttttacactattggtgggactgtaaactagttcaaccattgtggaagacagtgtggtgattcctcaaggatctagaactagaaataccatttgacccagcaatcccattactgggtatatacccaaagtattataaatcatgctgctataaagacacatgctcacacatgtttattgcaccactattcacaatagcaaagacttggaaccaatccaaatgtccatcagtgatagactgaattaagaaaatgtggcacatatacaccatggaatcctatgcagccataaaaaaggatgagttcatgtcctttgaagggacatggatgaagctggaaaccatcgttctcagcaaactatcacaaggacaaaaaaccaaacaccgcatgttctcactcataggtgggaattgaacaatgagaacacttggacacagggtggggaacatcacacactggggtctgttgggggtttgggggagagaggagggataacattgtgagatatacctgatgtaaatgaccagttaacgggtgcagcacaccaacatggcacatttacacatacgtaacaaacctgcacgttgtgcacatgtaccctagaacttaaagtataataataaaaaaattaaaaataaaaataacattaaagcaattgaatgtacataataatcagtgacaattttctagtataaaattttctttgttacattcttcatcagttctcaaaatatcatctaaaaggaaagggtgagccagacgaggtggctcacacctgtaatccgagcattttgggaggttgaggtgggaggatcacctgaggtcaggagttcaagaccagcctggccaacatggtgaaactccgtctctactaaaaatacaaaaataaaaatacaaaaccccatctctactagaaatatcacattatatatatctatatatatctatctatatctatatctatatatctatatatatctatatatatctatatatatctatatctatatatctatatctatatctatctatatctatctatctatctatatatatatatatatcagggcgtggtgacagacgcctgtaatcctggctactcgggaagctaaggtaggagaatctcttgaactggggacggggaggtagcagtgacctgaaatcttgccactgcactccatactgggtaaaaaaaaagaaaaaaaaagaaaaagaaaggttgttttaagtgtgtttgtaaggaagagggcagacaaaagaaagagatcattcaagatttacacaagattgtttttatttaggaatgcctttcttttgaaggtttataattggcgtttggttgagtttagtaagtgttccagacccagctctcttcagactgatggttcggaatccatctcagcctcatctccttttaccccagcctgtgacaagaagtgctttctctgaaaataaaaatcagtacacacagttctgttgatattatatttgcttctttgtcatatgtttaggtagaattagtggtaagttttctgagttttctcagtgtttaaaaaattcttccttaaaattggtgagtcaacatttatttccagttggactttgcagacatgttataggtgtataccttgaataactttctctttttaaggtttgctttctttcacgataaatgcagtaacatttgccctattaaatatgttctaagacttcattaaacacacactaaaaaacagaatcttaagtataggcattttctgctcatgtatcactcatctacttactccaagaaaagttgatcctgaagagatgaattactgttttttttgttttttctttttaaagttatttagggaaggcagtgtgtatttaggtaggtatgtacctatgtggttatttggttgttactatgttatggaccagccttctgtgataaattgtagagtttattttgttacgttgttgcagcaacttccttgacattattagaggggcagatttccatttcctgaacagcaacttaataacaactcttgatgaacttgaataccatcagtaggtctattctcagtttccttctcatttggctaaagaagtggtctcttccctgctttattgcataggcatgaacattgagttattttttcattgctttggacattgattctttctaatgacttccagtaggctacctttcagatcattcttctttatagttttacaaaatgcgtcatacattttaaacgcatcttccgtttctctatgtttcataaaaagacaatttgtgtttagatctcatctttctgggagttctttgaggcttatattcctaatctttcaggtgggaccagtcttcaggaagttattcggagtttgaaaagataagcagtttatgtgaagtgtgtgtgtgaaacaaccctaagttaaagcctaaagtaatctacaaaatagtatttttgtctctttgtatatatttctgtgaacattcacagtttggaattaaaatacggtgcccttacgaactataatctatgacaattatctttaaacgtccaagctgtgaagcagtagaaaaatctactgtgatttgggtaaacttttcttttcttaactttctttgttatcttggaaaaacataacatattactaatatatttttttaaaaatttgtcaatgttcagtaaagtacagaaggcacgcttttaaaataaaatgcttaatgtttaattcagcacaactaaaaaagaaaccaaagttttcttaattaaaattagttatgataattgtattatgaatcagcaatattcccaaaaggtggcatgcttgaaacgtggaatatgtttgctaccaaacagtcttaaaatctacaaagaaaagaggaatattattgaaagactcttatgacaattgtcttttttgaaacatttgtgcacattctaaaacaggttataaaagttatccaagtgtgatgctcttgattattaaaagctaaacatttcaagtcagtctgtcaattagtatttttgactgaataattgaaatctttttcagtaatgtttaaattgcactatggcttttccagattttatatgtatctaaatctgtatctatctgtatgtcttcaattaaaatccccactttattatgtcacaaaaatgaattaatgttggaaatatttgtgaatacataaaaactttatgtgagatagatacagcataaaacaaaagttagcaggttataatatacaaaaataaaatattttctttttggacctagcagcatcatttgtgtaatgcataatgataaaagatgcattaggtcatgatagttcccaacatgtattttaatggtatatcaacccttcttttccttgcagtatcatagtaatcacttgtgtgtatttgcatgttcaattttacaaaatcaaaacaatgtgtacctaatacctaatgtttaaaataattataaattataggtttattttgttactttgttgcagcaacttagcaacttccttggctcacattcccccacccctgtttttttggtggtggtgttcttgcttttgttttgagatggagtttcactcttgttgcccaggctggagtgcagtgggatggtcttggctcactgcaacctctgcctcttgtgttcaggcgattctcctgcctcagtctcccaagtagctgggattacaggcacccaccaccatgcctgggtacttttgtatttttagtagagatggggtttcaccattttggtcaggctggtctcaaattcctgacctcaggtgacctgcccatcttggcatcccaaagtgctgggattacaggcgtgagccaccacacctggccatatttcccccatttttaatcaatccattgctaagcatccaatggactgtactccaaaaagctaatttgttttgaaattggaatttgttttctatagactcagcagtaataacattgggtaaggtttcatactaacttcatgaacttacttaaatgataatgcaaatgaaatacacttaaaaattttctaatgtagcaatatacacggttgcatactagttattaatcactattcactagaaaataaacttggaaattaatgaacatttaagctatttttaaaaaacttactatgaatacttaaatccagccaaaaccccttggattgttaactctgtttaccttaaataagatcagaatcgagttagaagtggtcagacacagtggagcaaatctttctgtagaagaagaaacagaaggtttagaagatagcgggaaataatgcttgagcacccaagggctctgaaggcataagccaggtagtgaaagctcaaatctggtccaagagctgtgaaatggtaagaaattaaaaaagaagtccgaaaccacatgtgagtaacgtgaaagacatggaatgaagcaggcttcccacctgacatgtagggggaaggaatcaggcactttggagaatttcttcccagacatgaagctggggaattttaattgatagtgacaactgggcgcatagcagttgctctgtaaactcaaagagaaagaactttgtagaagtcttactaccaaccaacaagtacttttcctctttcttcaacagaccctgtaaccaaaccacaaatccataaatcatacaggtgaattcccatagctctagtatgaattacttatacattaaacattttacagataaatgacactcattgttggtcatataaatattacagtggacccatgttaagctattgtggaaacacagaagaagagactcaaatcaaattggagagaatatgaaagactttcagatggccacaatacttcagctgaaagttgaagagaataattttgttaatggcattgcagctgttgtgtgctgaggtattaatgagcccctacattggctcaggtgagaaatattataggattgatatgtagcagaaaggatgaagaggacataaactcaaaagttatttaagaatctaaaaatgtgtggttcagatgaaaaggagtttagaatgatgctttgatcttcttctagtacaactatatctttgttgttgcttttcaaagatacaaggaatacttgaggaggtgtatgtttgaggagaaagatactgaatttttgtttggacacagcaaatttgagttgatcattgcattagggttctccagaggaacagaactaatagtatagatgtatatatgaaggagagtctattgaatattgactcacacgatcacaaggtgaagtctcacaataggccatctgtaagctgagaggcaaggaagcaattacaagtcccaaagcctcaaaagtagggaagccgacagtgcagccttcagtctgtggctgaaggcccgagattcccctggcaaaccactggtgtttcagtccaagagttgaaaagctgaagaacttgacaggagactgatgtttgagggcaggaagaatgcagtatggggagaaaaatgaaggctggaagagtcagcaagtcagctccttccaccttcttctgtctgctttattttggctgtgctggcagctaattacatggtgcccacccagattgagggtgggtctgcctattccagtccactgacttaaatcttaatctcctttggcaacagacacacccaggaacaatactttgccttcttcaatccaatcatgttgacactcaatattaaccatcacagtcatgtattatacatgaaggaaaatttaatataatattggaaatgtatgctcatacattccctatcctatagataatgtaaggactcaatattaaccatcacagtcatgtattatatatgaaggaaaattttatatcatattggaagtgtatgctcatacattccctatcctacagataatgtaaggacagagactcccgttattttttctatatgttgaaagagatcttcccaaccctgcccctgtatgtaccatccttagatttctctaccacagattgtagccagtctgtttttctccagttgttcagtccaagaatatgaggtcttatttgactcttctctcctgctcacatttacttgaaagtcctgttaatgctacctaacattacatctggatttcaaacacttctctgtgcatccactttctcactcctttcaattcattatcatttcaaacctgaaatattgcaatgacctacccaatggtttaccagcttctagcttttacccaagaactattttcaatgtggcaaccagaatgaccccttaagtaaaagtcaaattatatcacttctctgctcaaaaccctgaaatggctgtccatttcactcaggatacaaaccaatgtctttaaagtgacttacacaaaatgcctacattacctcttccctcataacctactattctccctcctgctcactcagctccagccgcagtggcctttttccaggctttcgtacatactgtcatatttgaacctcaggacctttgcactggctgtttcatcttccaaatatcctcattagcagcacctttgccactttctgctatcagttcaattatcactttctacgctctgttcaactattctatttagaaatgcaatccaaccaagcacttttctcttctccacattttcttttccagatagaattctaacttacccaatttatttgtacatttttcctactgtctctgctattagaatgtaagccacatattagggatatttatctcttttttccacagaggtatgtcaagaatctaaagtagtacctgacatatagtaagtgcttgataaatatttttacagctttaggagataaaattgagaaatgaaaaatgtctatattgaaggcataatgtgatgatttgatgcaaatatacattgtgaaattattaccacaatcaagctaacacattggttatctcacgtagttaccttattttttgtgatgagaacacttaagatctattctcttagcaaatttcaagtatacagtatagtataattaactataggcaccatgttgtacatttgattctcagaacttattcatcttaaaacatttctccatttcccatacctctgatcccctgacaaccacccttcttctgttgctgtgatatgatttttttttttagatttcacgtatcagtgaaatcacatagtatttgtctttccatgtctggtttattttatttaacataatatattccaggttcatccatgttgttgcaaatggcaagatttccttatcttttaaggttgaataatattttattatatatatcattgtttctttattcatttattcgtggataggtacctagtttgttttccatatcttagctactgtgaataacgctgcaatgaatgtagcaatgcaggtatcacttcaagatattgatttcatttgccttggatatatacccaaaagtgggattgctggatctagacttcctttcttttctttttttttttttttttggagtggggtggtctcactctgttgcgcaggctgaggctggagtgcagtggtgccatctcggctcactgcaacctctgcctcctgggttcaagcaattctcatgccacagccttccaagtagctgggattacaggtgtgcaccaccacacccagctaatttttgtatttttagtagaatggggtttcaccgtgttggccaggctggtctcaaactcctgacctcaggtgatctgcttgccttagcctctcaaagtgctaggattacaggcattagtgaccgtgccaggcacaatagttctagatttctgatgaaactttgcagtgttttccataatggctgtaccaacttacattccaaccgaagggcacaagggttcccttttcttcacatgcttgccaacatttgttattactcatctttttgatagttgataaatacttgttgtattaaaaattagatgttgaatatcactagttttttttttacaggtgcaagccactgcacctcaccactaatatttttaaatatggtttttgtggtcatatgttaacatagaaaatatgaaaatattaagaaaactaatttttaaaaaattgaagaagaatatgattaggttgagttaaatatgaatggcttttagagctatgcaaacaattaaaactaactgacaagagagaatttgtaaagagattaagagtgattcataagtgctgggtatggtggctcacacctgtaatcctggcactttgggaggccgaggcaggcggatcacgaggtcaggagttctggaccagcctggccaacatagtgaaaccctgtttctactaaaactacaaaaaattagccagacatagtgttggctgcgtgtaatcccagctactcaggaggctcagggaggagaatcgcatgaacctggggggcggaggttacagtgagccgagattgcgccattgcacaccagcctaggcaacagagcgagactccgtctaaaaataaataaataaataaataaataagagttattcatatgtgtggatattcacctagcaagggaacagctttctggattttttgtgtgtttgttttttcattatattctgctatactgagtagagttttccattaaaatttttcctgattattatcaatggacaatcaccaatccttcttagctttaaataacctctctaggcaaacaagaactaagtagaaaaaaatatatttgagacaaaacaatattttatagtatagttaggtaattattgcgtttggtagtttttgcaaatttaattgtatttctttgagcctatttctttgatattcgttatttagaggtgctgaaagagggaagcaccaaaatgaatcacatatgacaagtatacatacaagcaggtttaaaaaaaaccagcaaaatattttaaatagctaaataattttctatttgtcatattttaaatctcacttaattataatcattataggttcaaggtttgttttaatcaactcaagtaatattttctggaaagctatgagcaagtgttttatgaattctaactctttggtatcaaaaacacaaattggcctgtttcgtttttcatcatgcatcaacaccagtttgggaattttctttggccaaaatttctattaatatgtaaaagaaaagatgtgttttcttaaatgctctggaaatagtatcataaaacatatataatgtgtaaatttaataaacttttaaaaatattgaaatgaacatcatatatttttgaatgatgtgttgatatcttaaatagtgctacagaggtaacaaagtttaaattaattaaaattatattcaccttgaatatggaatctatttcatgtcattaattcagctaaaaattagaaactaaataaattatattattgaaatttaaaacattgtagaaatttcaaaaaatgacaaatttgctttgtacctttatttcttctacaaattcttaaaaaatgctcttagtattttttttttttttttttttttttgcttatgatttaaaatatgatatttactttggaagtttcttcttttttttgttaccagttcgtgttatttcttgggttttctttttcacctaccatccttgtatttcttacaatttgcttctgaaaatacctatttcttctttttaaccaaatagctcaaggctgggataggatgcctcccaggaaacatctggcaatatttggagaaatgttttgttgtcacaattctggggagaggaatgctactgacatctagtgggtggaggccagggatactgctaaatatcctactgtgtacatgaccacccccaaagcacagaattttccagcccagcatatcaatagtaccaaggttgagaaattcttattgaaacatacactgcgcagccaccttagtggtccagatttctctacattccaaaaattttattgaatttattctcctttttgaccacaaaattcctgatttttctctcctctttcttgttttcatttctcagattaatgattctgactatgatgtgattgaggggcattgcctttggaaccattcagttaccaccacactagatcttcaataattaattaagttctgatcattacgtgttttcatttctgtgtggataactggaggaatcttgtaattaattagcaaccatgtgtagtacagtgttaacacttgctagaaatgagtgggctctttcagaattctcagtttaagaactcttccttagtgtttttcaacgcattttgtttggaatacagacatgcaagatattctgcaggggaagatcatggtctgatagatctggaaaatgctgactttttggtcccaagaagctctgtgatatttaccaatgaacctgagaggtcctgaagtactaaagcctgcttagtttggttttctgcagctgtgtgtgtgttttttttctaataaaattgttttgtttcgttttaatcccttaaaattcctattaacatcaggaaatattgatataatcctatctgctttcacaagattctaaatgttcaaatctcctcaccagaacaagtagaagtaaatctgctcaaaggatttttaaaaaaaactggcatttttagtgaattacgtgcagagaactttatatttagttttaattttgttcagttaccttaagccttttttatcttattatacattattagagtaaatttacatttttatctaatctcatattaaggattgaataatacactttttgaagtttacaatagtgtacatattatatgtatcttgttttaattttctccaggtgtttttaataattgaattttccagtttgtttgctgtaaacattgaccatttagaaaataaattgatgtaacactatctgcttcctcaaataatccccctcacctccccccacaacacacacacttatatcttgcttgtgtagtttatagcatagtaaatatacatgcgtattttagggtataaggctaaattcaaatctgtgatgctatatgccatatgtttcctgacctatttgacaaatttaattgccccttaaagtttctattgcttctgtaatgttataacttattttttgtaatagttggtatatttattttctttacagaacaataatttccatgagaactaggactctaaaaattgctcagtactgtatggtatgtcatatagagatcctgacagaatgccgtacatgcaaatatactcagcatgtgttagttgaaaacagatgatgagactcctaacttgtagtagcatgtaatctatatgtggataaaagtgtgctcaagcagtagctattaccaatgcacagctctgaatgactaaatatctcaatcaagaatatcgacaataaatccaggagctgtggctcaagcctgaaatctcaatgcctagggaagctgaggtgggaggatcatttgaagttaggagttcaagaccagcctggccaacagtgataccctatctctacaaaaaacaaaaataataaccagagatggttgtgcacatttgtagtcccagctattcaggaagctaaagcaggaggattgcgttgagcccaggggaggacgcagtgagctataatcctgccattgcactgtagcctgggtgacagactaagatgctgtctcaaaaaaaaaaaggaaagaaaaaaaagaaaaaaaacccaacataacaacagaataccgaatacccataataagaaatgtaagattctccatgaactccacatttttgggcttagtaacttgactcttaccacctaaattcaactcatttaaaactataggccaggagcagtggccacacctggctaatttttgtacttttagtagaaacagggttttgccatattggccagagtggtcttgaactcctgatctcaagtgatccgcccacctcggcctcccaaaatgttgggattgccagcatgagccaatgcacacagcctatagttttaaatgaattttgctgattctactataggctgggcgtggtggctcacacctgtaatcccagcactttgggaggctgaggctggcggatcacctgaggttggaagttcaagaccagcctggccaatatggcgaaaccccatccatctctactaagaacacagaaattagctgggtttggtggtgggcagctgaaatcccagctactcgggaggctgaggcaggaagaatcgccttaacctgggaggcggaggttgcagtgagccgagatcactccactgcactccagcccaggcggcagagcgagactcatctcaaacaaacaaacaaaaactataaagaaagcacccagaggaggaaataatcaataaattacatatttcctggacaaataatacttcatagatgcccccaactttcccattcattgctaaaatctcatcataaggttgtaaatccaggattacatggagcacaagtttcacagatgttgtttgactcattcattcattccttattcattcaatatgaatttattatattttaggtaccaagctatcggctgaaaccagctgttagaggatggagagtatccagattgttaaggaagaaatgggtagatcatctggtcagtagtaataatggtaatggatccccagaggcagagtcaccttggggaatataaaatgcattttaatttgaatcgataaggaggctgatattgtgaatcattaaaaaataaatttgaaaaatgtaaagtagtgacagaagcacatggtcaccaggcaagaaggctaagaggcagttttgaagccactgcaaggtattctttgaggaagtgaaggatgaaagctctgtgtttaggtttctggttctaatacatcctttaacaaggccatattgtaagagaatggttaaggtggggctgttcagttggagtgaaattgaccgttaatgatccatctcagtatgatgggcaaagatgtattacatgaacctggtatcagaagagtgtaatctttgtagctctcacctatgattacatgattgccattaattttagaatctacgtggaatcttaatgattgtgaatgactgaaaaccattaagaaaactttagagactttctggataaaatgcaatgactaagttattattcgatttatatgaataaatatattcttagtctttatgtgcttttcggtttccatatgcacaccctttagttctaagtttggattttcctctataatattacaattgctatttctttgtctgtctctctcttccctcctcactccattctttccagtatccttgtctatttttctttctttctctcttctttttctattgttgcatcactggccataaccctattgcagttgtgaaatatttagtggcctcagcttatgtccctagtgggagctatggaaagtacagaaaaatgaaaagtgactcacgttattctagtgtgtctctcactttccacagctacagttattgctacccttggggaaatttacatacactataaatagaaatatatactttagaaagacatttaaacttcttcttttacatgtcagaataaacaaaagtactagtaaagaaattatttctgcactaaataatgaattgatcctcataatgccctgtaggtatggcatattgagggacaaaaattataagtctgatttcaaacttctaagtgttgaagactcatgtttgataatttgataattgggggaaaaacagagcaaataattccctttttgtctatggatcatattgcctctcagttcctttagaaaaatacaagttaattaagcttagggactggaggcgtaaaggatagtaaaaggaagaaaaataatttagctttcagaagatcaagagtactaggggaagtgattttggctctcattttttattgaaataaaaattgacagagaatttggacatcctttggaaagccaggcaaaggaaattcagtttatcataaacaggataaaaatcagaatatccaattccctgggaatcagaaattctccatgaagctgaattctgcttcagttcatctctgactcattttgtcattcaaatatgtgggatacctactatgcaccaagcattgttttagctgccggagattcaatagaaatgatacggctaagttcctggcctccgtgaacccgacattctgatgtgactgctttattattagataatgtgtaagcaaatttgccattgtgtgttctaaattaagtaaattggatttaaaaaatttagaaagactatcttttggtattcttacaacttactatttaaaataatacaccatttgaaagaaggttttgtgcctctagctatagccacaagtggcttcatgccttcagaaggggtcagggaagacaagcagccaggaggcagtagggacagaatagttgctttgaatagagacaggtttagtccagttttgcctgagagggttagagatccattctgctctctgtccttgccatggattctgttgtctttcactccagccccttctgctcaacatgcatcattctttgtttccactctgcagtcctttcatgctgcttacttaggtgttgtaaattttgaatgactctaatgtctacagcatttcctgaattttacatctggacagtattgaagggcagcggggcctcccaaagagcctgttttgcttgactaagttcttttgctgtattgatttagtataagaaattctgggataatgttcaatttcttcatggttcttaaaaatttcaggcatcaacaaaggctgtgtattccaggcaagagatacaatatgaagaaaaaaaacaacaacagactattatcagcttgttcaaacacaaatctctacaggttgacattttcttaggattggttcccagaatgtgatgtattttcttctgtgggtgttcaactcatttgctcttacaactgaaaaaaacagcagtaaaagccaaattgaaccagtccagctgttatactattacttttaaagaatgcctcaaattcttagtgtttacttctagtttagttcgtaccggatttctcttcacatgtcaagctatgaaaaaacaagctgacaaatcaaaaggttgacttcccaatgtcttctgataaaaataatatttgaactattctatctgtaacacaagaatatgtatttatatgtaagaaatcctttggctcttccctcttttgttatttacaatattgggtgcattctcatgatctttctttgctattcattttatttatttttactttcctacatagagagttcttattgtttctgttgtttcataaattttagaagcctccaattttagaactaaaagaaccatattgtagagatttcatgatcgccaagtttaatccttcctcttacctatgagaatgcctgtaggttgcttgtattttattttatttcataaactactggaacatattctttatttttatttttatttttttattttttgagacggagtctcgttctgtcacccaggctagagtgtagtgacgtgatctcggctcactgcaagctccacctcctgggttctcgccattctcctgcctcagcctcctgagtagctgggactacaggcacctgccaccatgcccggctaattttttgtatttttagtagagacggagtttcaccgtgttagccaggatgctttcaatctaccgacctcgtgatccgcctgccttggcctcccaaagttctgggattacaggcgtgagctactgcacccggcctggaacatattctttatgtgcttgtatttcttttctgttaatatttagatctatagtttatttgcagctactgtaaattttgatacatcagatttatcgaacatgctacaaagagtaaattatgtcatagtttgctattttctcatttagatattactccatacaatacagaacataagctttgggcatgtttgattagtaatttaagaatcctttctatctatacaagtagtgacctacgcatcctccatttggcctccagtgtgcaattctgtgtgattaacattttaaaatttcctatttttttaatgctaacttttgtaatcttcaggtgtcagacgtttagatgaaaacagtacatctgctaaattattgctcaaaatattacatattttatgcaaaattgaatggttcacctacaggtagaatgaagagaaacaaacaggcaaaattattctttcagttctgttcttatcatcatacagttgggtctgcttattactaaggttagatcaaaggcctgagataatttagctagtttcctatctagataaacctagacttggtctaaagccacctagcagctctgtgacttgctatgatttagggctgctgttatctcccaaatactggttgtaaattaatgaatgaatccagaagttaaagataactgagacttttacaacatgaagattttcctgactgaaataaaccaggtcatgtgtcactcatttatattttaaattggtttaattagtctgctcctctgtgatcacctagtgaacataagctcttttggggaaacagaagttttgagagagaaggagatgaggggatagtaagaaagggatggttttggagtggataatgaaagctatgatcagatgaaagtgttgcagatgggaacatggccgttctggacagggtatcgccatggatgacttaataacttgggacatggggtaaataaaaatagaaccgtaaggaatacttggggagggggtgtaattgaccctaaaataattgtggaaagccaagactatctgatattttttgatatcaaagaaatataacctagaaagtcagaaaaaaactttagcatttagttcactaaaagaaataatgatccaaactaattgatatgcctgccttaaacacagttttctatgaattttaggctcatatacccttataggaaaaacatgatcacacacacacaaatagcatgtttttcgagaattattaaatattgggaacctgaaggtatcctagagatcctaagatccaaactcttcatttagtaagtgaagtaaacaagtcccagaagattaagtgaattggccaggtcatagagcccatcttcatgcaggattttatagtctgaagtgatatttcaaaattgggggataaatgcttcagacctttcaaaatttaattattgtagaatatagattagtgactaaaatgaaaagaaaaagtttcaggaagataatctctattattttggtataaatgttgacgaagaagagataaaaaatatttttatggcaacggcttgttggatacgttgccgaattttctttaaacaatatgaaatgatttttagtaggaaagtgtcagtgctgtatgtgtgtgtgtatatgttacactttctccgccacttccaagccattcacagttaaacaggatttcactcaaacattgtaacagcagttgccaaagcactaaactctgtatgtttttggatgtcttggtacaaagaataagtaacaggagaaacaccctcagggaaagtttagaaactctgtgtagcttttttcactttaataattacaacagtgttaattcacagcctctttgactagacacttaggatttaagtagcctagcaattctgccttcagctactagtgagttcttttgcatatttatcagatgtgcccgcctttctttttatttcatttttttctttttttctttccttttctcttcctttccttttctttcttcctttctttatccttcatttttctttcttttccttccttttaatttattttttaaagttgttaaactttaagataaaatcaatggggcatatatccattctctatcaaaatagatctgccttataaatatgtttcatttaaaagtcgataaatttttaaattcccagtattaatgtgtgattattttatttgcattatctctttttttaacctagtatattaaaatgtatgtattcaacacacagctgctgaggagctctctcccaccttcattcttcctcaatcaacagccctctctatactaggcactgttgtaggaagtaatgattgttgtagcctccatttattcttcataccaaatactaaattatttaggttcaatttgccgtaatgtaatcttcaccacagtctttgaagttgtatatcattgtcctcactttatgtattaaacaaaattttaaaaaatgttcaaagaagttaatatcaccaaggtcagtaaccagtaagtaagtttgtcgtggttcaaaaccagttcatctgaagttcagagtcgggtgtatgtgctgtgccttgtagactgtgtttgaacacaaaagcaggaggagggatatcatatgctactggttttcttccttctactctgcctactatcttctttcttggctccacttttcccagggcatagtctataaatttctgagaaacattttgcacttctgttatgagtaggaactctttcatgacttcaacgttgcatttgaatgcatatgcttctgcaaaatgtaccatcatcaagttactttaagcactttgggggaacaacatgatgactatacccaactttgccaacatacccatgatatgcatgattcactttcattattttagtataaatgatgccaaaataaatagaataaggaggttaggatttaggagagttgggtgtttcagctctgccactaaacatctctgatatttgggactaatatcttaatatttattggctttagctttcttatcagtaacagaaaaaaagttctagatgtgtttagggtaacatgccatgataaatttttattattatttctaataagagtagcacaaggcttagcatatagtaacatttgcaaatcttaagtgtctaaatcaatgcggttttacatatccttccataaccgtgccacttgataatacatttttttctcatgccatccaataactttttttctctaaaaataggactaggatagtaactgcagaataactaaagacttcacttttttactgctcagatgaacattcaaaataagtattatatggaattttgctgtagttttatgcttacttggcaacacaagcctggccttgtttctgtaactcaaggtttttgaccatgaatggaagttaaattttataatcagagcattttctaagtcttgtcccacaaaaaaataaaatataataaaatggaaactgttcaggccctagagagaatttgctggtcaagcacatatttacacaagtagagtgcatggcactcttgatattgtttctttttcaggagctgatttaatatcctgccttatgttgatgtgcaggctcattggtcatgtaggttagcttagagcttatattcccattcttattatttctggaatatattttaatgtccaggttatgttgaaacttattctaataataaaaatagctgcaatacagagtctccagtgctcacagaaataatgtagaaacaatactttatttaataaaaaagaaaaagaaaattttaaatctaaaatatttagtatcttcttccctgaaagcaaactggagaggaaatatgaatgagaataactgtgtacttgtgtgagaaaaagattctagagacaagagaatctttttgtttgtttgtttgattttgtctaggtaggatacttcactagtccaataatctttcctctaatgtttaacaacattcccacagtaacactcctgaaaatggctatgcaattgggaagctcaaaaatttgtaggagacatgtacatattatctgtacatattttcattcttaggaaaatagcaagtctacatataggcaagcagagaaccatttcctttctttctggttcatcacacttccccaagaatacatagaatgtgttcttccaaagcagcaaaagggatcctctcatgagttctttttttcacagcttgttacaactgcatgtttatgcatcttttcttatccatttccatcgcttcactttggatctctgcacaggattctgacaagctctttctccttctggcacagcagattaatccttttctaacacaacttttaccctttaaattattgatttgaaaatatccttcccaaatctaacttcattctgtttgacttcgtaggcactcacgtctgatccagcctcacacatcgaacttcctcactgttcccttgctaactcatgtctctctcactcttgtacctctcttgtaagatcacatttaaccacttcctaatatgctgtatctgtactccaattttctatctaggtcctgctcatctttctatgtcctattaaataccaccttttagtgagagcttctcttgtcattgttcgtatttcttgttcctttattttatacattaccatttaattctattaaaaattccttttagctaacaactacaatcacagttatcctataaatgttctcttcttggaatggtatttttggacattccatgttttgcaaaaggcttctgttttcaagatttaagcttgattctgctttactttataaatgtgtgccatgtccagtgcctctgttattacctcccaccagaggatgccaggccttgaagaaccctgcctgcatctcacaatataaggagaagaaaccagaacaattggtgtctgggattctagcaggacagatctcccacttggtcccatcagccatgggattcattagctgcagttaacccttcattggtcccaaactcttctctctgaatattgatgagaagatacctggaactttcatggccttccagcattttccccctggttttaatcaagcctttggtaatgagtttgtggcttgctctcttaatgaaccctatggtatgatgaaaactggtaccctcagtaaaaggccatccaactgtgactaaagggctcagaaacaagaggctgagtcagccagtgctgccgcagatctgctgtcagcaccatcaggagaatttatcaccacacaaataataataataataataataataataataataaatgtgtcactgcaattcctactagaaactcaactgccatcagagtgcacaaagtcccaaatttatataaggaacagctgggtcacttccatgacattcaagcttgggctggagtagcgacgttttgtctaagccaactcagaaccctttataatactcctcccacctataattttctgttttaggctctctgaaatatcctccctttctgttacctttacctgaccattacctcgaggaatctctcaaggctcacactcggaatcttttttactgcagcttgtagtccacagtagctggctctttactttgggcacagctattgatctctgcccggaagtatggacttgatcttgggacttccccctaggtctcaaggtctcccttgtgaaggctacctattttgttttccctttcttccatatgcccatgctcaactcccaagatcccagatgcagaaaagctccagctttgccccgaaccaactactcagtatgctcaaaagcaaaaatcacggactataagtatgaggaacttaggtgctgtactgaactttgcaactctcatagtatctaacagaatgaggttacatgttaagtattatttgattaatcaattgataaaatgtcttgtagataaacaaacaagaatccaaataggaccacaaaaatgaaacctgagacttccaaaataaccgaaatggcaggcagtccatgagatagtgtggaacataattgacactaaatagactccaaacaacaaaagattgtgtaatcctaaacactgaagcctactgtaagaaattataatactgtatgatgctaatatggagaattacagtagggattaattaaatgataagagctaagagaagaaacattagttaatagaatatattttaatttttatttttgtgttctgctctattctcttggtctcaggctcagctaaataccatacgtagaaggattaccaacctcttcctgaaagcttgaattacagttccccaggtggatattggtacttcatgaaggatggttggagttgctgaatattttacaaaggaaatgcgtgtggctcaaaggataatctagttatcttgatgaatttatcctttgtagttgaaagaagttttgaaacattagacttcaaagaaaagcaggaaagtgattgagcatttatgtaaatactccctaattgcaaaaaagtggttcttagacatttctaaattgagtgagataaacatcaaaagtgctacattattttctattttacaagtgtcactatctctctttccctccatattcagagatggtttttctgtatcatttctgctaaaagttaaagaaataaaaacgaacatcccatattccaaaaatcacgctcaaacatgggagatattttgaattcagaacacaggttgtccaaaaattaatattacgtccagtggtcagtttcccaggccaatccataaacattctataaaccctagactatagcttaaatctagtctaaacataacacatttgtattaaaatatgtagagtaagctatcctgtaaagattgtaagaaagaagattaaaaaacacaattgaaaaaaaaatactactttttagtgcgatggctgggaggaaagtatgtttaattagagcaaggaacagcaaaccaaactgcagactaaatcaggccacccacctattggtttatattttttccatggctctttcatcctaccatggcaaagttgagtaacttcgatagagaccatgtaactctcaaagccaagagtatttacgggttggaactttccaggaaaaaaaagaaacacacaaatgctggctctgaattgaaagaggaacaggagctagatggaactctctgtaaattttaatgttaacttctgtactgtgagctcctccaagggagcagtgctgtggctcgggcatcctctctccagagatgaggctcgtgcctggcacgtagtaagtgctttgatacagttctagtaaattccaagggcttgataaagcaattcctctagttctttctcatttcatttcagttcaaaaattacacatataattaaatattattttcagggagtgaactttttattattctttttttttttttttttgtagaacacaccgagcttctttctgtgggctaaagtaggcttcagttttctaaaccatgcatgggtatttggtgtaggtacttggaattaaaataaatattctgtctggagtatgtcctcagatataaatttttaagataaaagtcagtaattatcttattcagtaatctttccatcaggcatttttatttatgtaatgtatcataccgagagaggtgttaaaattgtttctctcaacttgtttggcaattgctgacaattattgcgtaatagatgtgtcagtgcatacagccagatttttgttaaggattgtaatcactgtcagtaaaacaaaccctctcaatcccatatcataaaatgtgtgctaaattctactctgcatattactgatattgcattcatgtttgcctatttccattttcttaattttattcagtggtgtttactgaatgcccccaataaagaatagggaattgtggctcatttttatcttacctttaccttcattcccccaaacagcagcaacaaaagcaacagaaggaaaaatgattttgtttttctgtcttctttcatgctgtacatatctttcttactgtacactttccctcaagaattatacgctttaaatttgatttgatatatgcttattcaattatacatgttacttgataactaacttttatcatagttattgaagtctacattcaataggtatgaatcataaactattcaattgaatctgtactttcttccagtttcatatcataattaaaaataacttaatcacttttatagtgtcttgcatttccttggtgtattatgtatttcaaatagactttctgttgcctttatatatgaatgacaatttggatatgaaatccttggtcacattcttttttctgcccaaatgctgtaatcttctggtatctaatattatggaagacaaatctgaaataacttgatttatttttgtattgtggatggcatgtcccttctacctggaagtttatggcatcctttatttttggaaccaataatcctttcacagaatgttttcatgtggttcattttcattaattttatgctatttacattttaagaatgcataatgcattcaaacaacttacctctattcaagaacctagtaaatattaaagctagggccagaaatcagtctcttatatcccgtttctatcctctttcttcctagttactccactagccctgcatcttaaaacactcattgcagtgtaattgtatttattcttgcagaaaaagtcttagtttagtctcaaacttagaaataattttttaaagtctagtcaggtcactagtattgttgagggaagcccacgaatggctttttcctaagggaagagtgattctgagagcaggtaattgtcactcagaatatcatcccacccaactctggtaaatgtgagtagaacatgaaagaaccctcaagcgttagcacccttgcttcagacatcttctgctctaacagaagatgggtcacagcagaggtgttacatgtgggaggtagaccacactgttggcaggcctgatggctgcttttggcaatggtagaagcaaaggaagttcacccactgagagccgaagaagagaaaatggcatgggccacaaagtagccaaggatattctactccatagcacatactatgtggaaaaattctgcagaatccacaaaactatacattatcacagaatcaaatcccataaatattgtcttgtgattctttgtgaccctgtgactttcctctttccaaatttgatatgacctggcttaagtaagatatattgttttctttttaccctctccctttttcttaccttctcccattcatatactctctctcctccccctccttccctctctttctccctctcctattcttttctctgaaaacttactaagggccatctttgtgataagaaattcaaccaacaacacggaactctctcttattcagattcaggtttattatggccacattttctgccttcctttgacaaatcatggattattatgaagcatgaaacccttcagtctgaaaactataataacaaatgtgaggtagtttttccacaacccattaatacgtttctattgctaacctgcctgttcccatgctcttgtgcatttattattaatactgtgagcagaacagttcctctgagatttggatagttttaaaactcacaattctatgcctttctctataatcgtaatattttagagtatgtattaggctatggataaattaaaacatatcacaatagaatatgtaatgaagaccttaggtgagtttatcacaaatgacaaaggaaaactatccctgaagaaaaaacaatccatattgaaacaggataagaacaaccacaaaaaattccataaggaatctgatgaacatttgagtgactgatactgaattcagcccattcttcttgatgtgagtgagatttgaaacagtacagtgagcttttccagtatagcatttttggaacgtgaattaccgtacataccactaacatagaactcaaagtatattaaggctgcaagagagcttggcagtcatttaatatcttacttttcagatggagaaactgatgcagataaaaggcagttgcacgccctaagcatttagctagttcgaggcagaacctgaactaaagccaaatgtaaagtctcttaatgccaagttttcttcactttatcgagtttccttctgtgtcctgcaacacatggcttagacaggttaatttgttctagaaaatgttagatataccttggactcatctgattctaggctattatgtcaaagtaatatgtcatttcaggtgattctcttaatatgagacataaaattattctcagcatgaaatttgaaatggtttaaaaattttgcaatcagcatacccaccaccaaccaaataataaagttcatttattttgcatcttatatcatgaatagactagagcacaccaaaccactgagttattgaacttgcatctggcagaaatcaatttgacatcccaatttggctatttctaggccatatgagtaatgtcataactgtgttacatcagtggtttttcaaatgtggctgtacattataaccacccaggtaaaattaaatcagaatctctggagggagggcctgagcttctgtttgtgataaactaattagagagttttactagtaatgatgtgttatagtaattatgaattttattacacaaaagctacttttaatcacaatactcagaaacacagattgataataaatctatttgtaatcataaagtaaaaatcaaagaatgagaaatgcttcaattttagacattttctaattctctcaggtaatgaaattcggactttgttctttgatccatactctctcaatctgtaaaatagaataacatttcttgtctcacaaaacaattacgaaaattatgttggccacatgataatatgccttacattgtgtacatagttaatgctcaattaatattatccttgatgacaatggtgatgatgatgttgattaataatacttaataatacttcagcttcaataaattaaataggtttccggtcctatgcccattcaaggcttgcatgaggattccagcttgcaatatagacatcttagtttaaattcttactaccacttatagattatttagtggaaagctaaaagtattagtagtttaagactaatggggcatcttagagaaacacagaaggtggaacaaagtctatacatatgcacaaagcagtttaaaattaaacagatttaagaatttagacattgtcaaagagaaagttaaagagtagattttctggtttgaccttttagcaagaaagtaaatgagaagagaagagataggaccatggaggtgacattttgcaggtgcgactgagtgagggcccttgaaattcaacataaatcatttgaatttcaacattcagatgtgattcttgaacacttttgctcatttaatgtaatcatttgaagccttatcacacttcaattgaaagtaacttacagctgtttatattgagagtttatcatgtagaacactcttttaacaatatgaaatactgtccaatcactctggttgccatatctaatgtttcttttgcacatgatcccataaattactttaatggaggagtaattttctcacataagtttgtgattttgtggctaatcttctgagaacatacgttcacagacactaaagacagcactctgacttataatatgtcaggtaataacggagatatacttcaaagaagcgatttccttactgacccttggtaagaacccaggaaaatgatgcaaacctcatgcgttcgtttgttaattaggagactgaacattcatttctactgccttttatatgtgcaggaaggcttctggctctggccattctgcaaaccaaggagataagcagtgacctgcagtggtgctctttccctgttctgggctttattcttctatgcaggaaccaatatcagcactgtcgttgagttgtacttcatcaacttagaaagactgttgaagtacgataaaggatgcacaaagctgttttatttcagtagaccctttttatcagtgtctgtgataattgtagcaatagcatggctctaccacatcaacaaaccatctgtgggccctttttcaccattgctctggccctttccagaaaaatgtgccacatccctgtggtaccaaaaccctttggcaggagatatcatggcttcaaaataagagtgtccaccttcgccttacaatcaggattgatgcattcagatttggtaaagaaacacataagaagcattctcaaaacttttataagtgataatggaaagtaaagcagaattgttacattcctcatgaagttcaagaggtatacatgaataccaaagtgacaaaatcctcttgctcacagcaccaatagtgacagtgaccatttaatacatgctttttttaatgaaaagaagaagacagatcccttctctctctttctaaacagacatctagtcattaagaacatgaaaaatgtcattcatgttttccctaaaaagcattttctaaaatttagtggtccaagaagtaaatgtccagtgtagcaacaaattacaacacagcaaaatttgactttaatcatatgaatctatcactcacagttgcagaggtttggctaagttcataatgtaggtattatgtgtatgtagtattctttctggtcaccaattattgggggaaccacccccaataattcaatgtaggttcttttcagatatcgggggaaccacccctgataattcaacgtaggttcttttctattttccctgagtgttggctggtctgagtaataaagggaaagagtacaaaacagacaaattttaaagctgggtgtccaggggggacatcatatgtcggcaggttctgtgatgccccctgagccgcaaaaccagcaagtttgtattagtgatttttaaaggggagggagtgtacgaatagggtgtgggtcacagagatcacatgcttcacaaggcaataaaatatcacaaggcaaatggggacagagcgagatcagaggaccgtggtgaaattaaaattgctaatgaagttttgggcacatattgtcattgataacatcttatcaggagacagggtttgagagcagacagccggtctgagtaaaatttgctaggcaggaatttcctcgtcctaataggcctgggagtgctacgggagaccagggcttatttcatcccttatcttcaaccgtatcaaccgtataagacagacactcccagagcggccattttagagacctacccctgggaatgcgttctctttctcagggctgttccttgctgagaaaaagaattcagcgatatttctcctattcacttttgtaagaagagaagtatggctctgttctgcccggctctcaggcagtcagacctaatggttatctcccttgttccctgaacattgctgttaccctgttcttttttcaaggtgcccagatttcatattgtttaaacacacatgctttacgaacaatttgtgcagttaacgcaatcatcacagggtcttgaggcaacatacatcctcagcttacgaagatgacaggattaagagattaaagtaaagacaggcataggaaatcacaagagtattgactggggaagtgataaatgtccatgaaatcttcataatttatgttcagagattgcagaaagacaggtgtaagaaattataaaagtattaatttggggaactaataaatgtccatgaaatcttcacaatttatgttcttctgccatcgcttcagccggtccctccgttcggggtccctgacttcccacaacaaccaataactttatttagtacgtttaaaatatagatttttctcttgactttagtgttcaaagcagcctgtaaatacttgtaacatggaatttttagcctgccccccaaaaaagcattctagtttcttttcacaacatactgctaaatcagaaaccctaagatattagcctgttctcatgctgctaataaagatgtacccaagattgggtaatttataaagtaaagaagtttaatgaactcacagttcagcatggacggggaggcctcataatcctggtggaaggcaaaggagaagcaaagtcacatcttacatggtggcaggcaagagagcatgtgcagaggaatcctctaacaccatcgtatctcatgcgacatattcactatcatgagaacatcatgggaaagacccacccccatgattcagttacctcacactggatccctcccatgacgtgggaattatgggagctacaattcaaggtgggtggggacacagcaaaaccatatcattctgccctctgaaatctcatgtccccacatttcaaaaccaatcatgccttcccaacagtcttgcaaagccttaacatatttcagcattaactcagaaatccatagtccaaagtctcaactgagaaagggcaagtcccttctgcctatgaatctgtaaaagtgaaaacaagttggttgcttcctagatacaatggaggcacaggcatagggtaaatacacctgttccaaatgggagaaattggccaaaaggaaggggctacatgccgcatgtgaagcaaatccaaaatccagagaggcagtcaaatcttaaagctccaaaatgatctcctttgactccatgtctcacatccaggacatgctgatgcaagagatggattcccatggtcttggacagctccacccctatggctttgcagggtacagcctctctcccagctgctttcatgggctggcattgagtgtctgcagcttttccaggcacatgctgtaagctgtcagtggttctaacattctggggtctggaggatggtggccctcttctcacagttccactaggcagtgcccctggggactctgtgtgggggctccaaccccacatttctcttctgcactgccctagcagaggttttccatgagggcccctcccctgcagcaaacttccacctggacatgcaagggtttccataaggcctctgaaatccaggtggaggtccccaaacctcagttcttgacttccgtgcattcacaggttcagtgccacatggaggctgccaagacttggggcttgcaccctctgaagccacagccgaagttgtaccttagccttttttagccatggctggagcagctggggcagagggcaccaagtccctaggctgcagagcagaagggccatgggccctgtccacaaaaccatttttacttcctaggccactgtgcctgtgatgggaggggctgccatgaaggtctccgagattccctaaagacattttccttattgtcttgctgattaacttttggctccttgttacttatgcaaatttggcaggcaacttgtatttctcctcagaaaatgggttttccttttctattgccgtgtcaggctgcaaattttccaaacttttatgctctgcttcctcttaatcactttgccaccttagaaatttcttccaatggataccctaaatcatctctctcaagttcaaagtttcacaaatctctagggcaggggcaaaatgccaccaatctatttgctaaaacataacaagagtcacctttatgccagttcccaagaagttcctcatctccatctgagaccacctcaacctggacttcattgtccatatcactatccgcattttggtcacagccattcaacgagtctctaggaagttccaaactttctcacattttcctgtcttcttctgagctctccaaactgttccaagctctgcctgttactgaattccaaagtcacttccacattttcaggtatcattacagcagcactcctctctactggtaccaatttactgtattagtctgttctcacattgctaaaaaagacatacctgagactaggtaatttataaaggaaagatgtttaatggactcacagttcagcatggctggggaagtctcacaatcatggtggaaggcaaaggagaagcaaagtcatgtcttacatggttgcaggcaagagaacgtttgcagggaaatttccctttataaaaccatcatatcttgtgagacctagtcactatcatgaaaatagcatgggaaagacctatccccgtgagtcaattacctcccaccaggtccctgtcaggacacttgggaattatgggagctacaattcaagatgatatttgggtgggaacacagccaaaccatatcaccaactgtatctaaattctaatgttaaacaagaaaattgtaaaatataggctaatctttgctttttatccatacactaatgagctttatttatgtggaaataataacaaagttattttatgctgctaaaactaacttatttgaagttcatgatattttatcctttaatgattctaaaatatgcttgcaaccacaatctgctgtcttttctgagacaatgttttctatatataagaagtagcaaaatgtagtaagaaaatgacagaactgggtctggagacctgaattctagtcctaaatacactgctggtcacttctccaatctggggtttccatttgtaaaattatattccacagatattgaaatatttaaatactaatctgtgaatgtttgtttctgaacctcactttgtcactttaaaacaaaattatgtaattattttacaataaagaatatgggagaattaattctccagctttgtcattttattctttcttctctaaaacagatgctgcaagtattaccaagtgtcttcagccttggaaagataaaacttcctttgcttgctgcagtatttatgtatacaattgattcattaaacaagggatgcatttttaagaatggcttgattttctttggaaaaaacggtttgcactaaaaacattaaatcaggtgcagtttatgtgccaatgaaccaaggaacagcagacagtaaataaagttgagaatactgcacattcaaacagaaagaaaatgagaagaggaaactgcaccagtattgaactaacatggagggcataaactaaacagtgactgacacagtttaaaattgctttcattctttctcaacacttttcactcagtggcttctttacagctttcaattaacctgctccctctgcttccaattgctctttcttactgccaatgatatttaaaagatacactaaattatagattcagaaatgtttggaaaagactctgttaatagttttgctatcctcagatggctttaaaattttgaagggtgcaaactgctaaactaagaacaatattggtgtcaggattcttggagaccagaacagtcaatcccagggtgaccagccagcccagcagatactgagatactgactgcactcctgccaatggaagaccatccaggcacaacctcctgaagccttggccctttgcctacaacgcacgcctcagaatgatgtcagcatttgaaaaggatttgtatttaccacatcatttatcattatatttgaactttttaacatgtactctggaaacatgtaagtcaaactcccttcatgaccacttccatcatgatggtgtgaatctcatgcctattataaagagatccatcatccatggcagtctactgctcctgcacctctagactggaattgacttgccatgtgagttgtcttggtctctttgtttttacaaagtttgacttctgcttccccaacctttagaatgctgtaataacaagaagtttgcatatgcatatggaatgctcatgcacaattacatttgagtgcacagtgagtaatgtggtatattaaccaacagtgcttaaccttaaaagacatttgacagagaatcacccacacttttcaatgaaattaaaatgaacagttagaaataacacttccatggaattaccttatttattttaggagcaaaatggaatgaaatgaattagagactcttacacaggcgttagttcatgtttgtcataacagcaaacagagccattggcatatgtataccaataactacaatgagaggtagaaagaaatgagcaccagccaagcacatgggagttttgagtggaggattagttacagttcagaagatcccaaaatgttttgttgattgtcatcatttaaggtaagcccaagactatagggaaaaattatatacagagagtcagagggaaaggagggagggagggagagagagagagagagaaagagagagagagaaagagaaagagagagaattgtgggacctagagataattacaggatagctgcttctagagaaaccagaagagaagacatggcatgtatagaaaactataaatagttcagcagtctagataatactaatatatttttatgtactgtcaaatataagtatatattcacatagaaagaaacatatgcataaagagacatacaccaagagttaacaggaggcttttgtattgtcgcactactattggaaatttcccagtttctttactttgtgcactcctagtactctaggaggcttcattttatttccactaatgacagtttatcttcaagttagtgtgaaagctgcaggctattatcattgaaacactgggtaatatttttgtacaaatttttttccccagtgaatttcatttatttcctcataacctctctgttttgaagatggtctctattcagtgtaggaaaatttctctactggaaaaaaaatggaaagatctgcaatattatacaggttgaaaagtttttccactttcatttttcctagtgtatgatagcataaactagcatttttttacgttgtaaaggcaagaatgatgtaaaaaccagaaaagaattaatgtacgtaagctcattgttattattcctcatagcaaataatatcacaaaagacaaaacaaaggaattatttgtaggaacttactaaagaatgtctgtttgcacaagtttaaaatttgctaagtcttctcatcaaataaatttaaacagcttactatgaagattgataggtatttaaactgaccttagaaatcaggtatataatttctgactttttggttttgtaattaagacgtgacagtgtgactgaaatttaaattcaagaaattagaccagcagctatacctttaaaagtacctgtagatttttgttccatgatactattttaaaatgtactcaaagcttgcaggtttaattacaggatcactaatttgtttccagatacaagagacttaaaatttaagtataactttaagccaatatttaatcattcaattgttcttcaaaatattaatcttctctgtatttttaaggaaaaatgacttatctagtctaacagtatgctgacttcatttcttttttccagcattaaattacatataaaccagtttttcaagctttaaaaatatggctcaaattaaaagccggtttcttgaggttttcaggtatattagcccattttcacactgctataaaaatactacctgagactggataatttataaatgaagaggtttaattgactcacagttctgcatggctgggtaggtcgcaggaaacttagaatcatggtggaaggggagggggagcaaggcatgtcttacatggcagcaggagggagagaagaggcggagctccaggcacttatcaaacaaccagatctcatgagaactcactcactatcatgagaaccgcatgggggaaatcacccccatgatccaatcacctcccaccaagtccctccctacacatgtggggatgacaattcggattataacttgagatgagatttgggtgggcacacaggcaaatcatatcatcaactatcactaatattcctgcttacaattcagaaatataccccattttggtacaatttggaaatatagggaaagtgatatattctctgagcacttttccctaaaatgtcaattataaattgaagattcagaaaatgtgttgatttttccaaagttgtgtcaaataggtagatatatgactggaacgattaactcaaaagtgaatgacttattcgttatattgaaaatagaaagcccaagtcccaaaataagagatatattctaatttctatgtatcccccaggatttgtgcctcccatttgtttaattgggtgttgctagtgaaatggcagtcttattagctttaacgtatttaaatttatgttcctgactcatgtgccttgttttcaaaccagttcaaccatctacgttatggtatcatcttacatcttctatcttaaatgttatacaaagtgtgtaagatctcaacttgtcttcatcctaagaaaaattcctgcaatgttgtcaaatttgaaatcctttttcttatattctaggtttcagtttttacagtgccaataagaagaaaaatgaccctggcatagaactttttttttttgttttatcattggtgctatatgtgaattccaaggtagtgttttgatgaggaacatgtttagtgagaataatttcattgatttcttggcatttttattagtatatattgaagatccagaaccatctattctttcaagaattatcttaatatatcaacatatactacatttccctaatctctactctgtattcatttagtcaacacaaccaaattcataatcttctttgtatctacatttgtcgattttttccaagacccctttattttccactatctccttctccaaataatgatggttgtaactgtaagttcttattcatatccacctaatcatcaagtatttctgttaattctccctttaaaacatgcctaaaaattattccatctctgttacttgttggggacacaataacctcttagagatagaatccagcaaatggagtggatgtcatttttttcttgaaatatcaatctaaattttagtagagaaatagcagatataattgtttacttgaaatcaatataatgcactaatccaagatgccagggactaagaacttgagacagttcaacaggctgagtcataggaatgggcctgtagggatgggtagaacagaagattgcacagggcaggacagaggaacaaatgagataggaaggaataagaaggaaagatagagatcaaggtgggagtacctactataacatacagagaatgaaaaataagatcagttaccacaggagttaaataattaaggttgtaattttatcactgcacatgactggaaggaaaatatcctgttttgtccctttttacttgtatacaaatgtttcagctgtaataatttactgtggccataaaaataaatgttccatttgaaaacactttacccccaccttttaaagggtgtcgacttcattcaggtcaatagagaaattagagagggtagaaggaaaaaattgaagatgtgaaaggtgatgtagaatcaatgtgacaatgtaattcatttaccttttaataaaaattacacacaacttctcattgcttttcttttcttaaagatcatgagctgaaattttaatatttctgtttctatgcttgaaaaacagtctttctcccttgcccctaccataagcagtggctagctaaaataaactaatccaaaaagtttcagttctttcctcaaaaaatcccattcaatgaagtccgaaaattagttctaaggatatctcaatttatgagtgacagcttctggtagtgtgaagaagtagaatctgtctaaaatattcacatgataactgttttctttttccaagactagagccattataagctgaaatataggtagagccaggtgcttcacaacaatgtttcagtgatggaccacttccacatacacaaggatggtctcataaaattataatactggccgggcgtggggctcacgcctgtaattccagcactttgggaggctgaggcgggcggatcacgatgtcaagagatcgaaaccatcctggcccacatggtgaaaccccatctctactaaaaatacaaaaattagctgggcatggtggtacgtgcctgtagtctcagctgctcgggaggctgaggcaggagaatcacttgaacccggaaggcggaggttgcagtgagctgagattgcaccactgcactccagcctggtgacagagcaatactccgtctaaacatatatatatatatacacacacacagacacacacacacacacacacatatatatactgtgtttttactatgctttcctttgtttctatgtttttagatacactaatgcttaccattgtgttacaattctctacagtatccaggagagtaacatgtaccaatgtatagcctaggagaaataggacatgccatatagcctaggtgtctagtagattatgccatctaggattgcgcaaatgcactctgcgatgtttatatcatggaatcccctggaggacacatttcttaaaatgcagcccatttttaagtaacacatgactctgtattccatcttctaacccttctgcttctggaaaagcacagacttcaggccaatactgagtatggcctctgaacagaaccaaaagagacgttgcagggtaaaaaggagttaatgaaaagttttttgtttgtttgtttgtagcctggataatttgggttaagataatgtttcaacaggaacagaccctgaattactgaatccaaaagggatgtcttgggttgtttctcacgagtggtcatcagatttgtatttctgcaaaatgagattttccatatttttgttagacttcagccaaaacttttgctgtgtagaaaggggaatgcaatttttcttatggtatcaatgagtgagaacatacaaatatataaaacattagtgttaatgaaaagaaaaaaaagctaaaaagtgtaaaagtgaatcaccctgttaacatttatctgaactttctgggggagaaacctgatgtcatagaccacaattagaaaggactgcacttaataggaactttgagtaattatatgaaacaggacaaaatatttaaaatacttttaagtatcctaaaaaagaagaaatatcacattaaaataacattcagagatgattattggcagctcctaattgccaatccctctgctggatgttcaagatacattaatgcaatatagacaatagcctgagccttaccttccacaagtttactgtttgttggattttccagcatatttaaaagtggaaaatgataatgcaaaagaagaggatcaatatatcctgaaagaagaaaaaattccaaatgaaacagaacttttttttaaatgtcccacgagtgtgtgtgtgtgtgtgtgtgtgtgtgtgtgtgtgtgaatcagaaaaaaatatttattaaggaagaactgaaaattgacatattgcttcaattacattgtgtttggaatcatacataatttttctttagttaatactttgtgaaatatatttaaatatactcctgaatttaactggtcacaaatcactttgtcaacttcataatatgccaagttagagaaacacacaataaaataacatctttggacagtcggtcttctttagagcaattgtagtaaggttagtgatacagcaacaacacaaaacaacaaaaaaccaaatcaaatcgacaaaaaagtcacttttgctttcacattttccacatagtagggccttagggatgacaatcctgatggtggtgagtgagattctcatttgtatataaaacatattgtcttcatttatactgcatccttatctgtgcttgtctggagaagctgctaatggagattatcaggggctcacatcacatcatgccacctttttgagttgccacagttgagttgccataggcaaattggtatattttcatgccacatagctacatgaaaatacaccagtaacagtgtagaagagttttttactggtctctattcataacctacattatctgatttcagccaagatatttttttaactgatggctaaatgttattgaaaattaaatctcctcttaaggataaaactagatcagtcgtctcttgagtgaatttctcagatttagttgtagaaaatatcatatgtatctaattctaatttgaatgttaaaaatgttaaaaaacttaatgcctgtgtataaagagccattaaaaagaaaatctcgccttgactcagccattacacttccggcaatccaaactatatagaaacctatgcccccagaatttattgttgtatgtttaagacaattaatttaaatagccaaaatatttaaaaatggtgaacaactgcacagaatataaaatgtctactagatgaaatgctactagatacactgttatgtagctattaaaattgcattcataaaatatttataataatatacaaattaaatctgtcatggttaattctattatcatataaaactgcataaaaataatgagttcaactatgattacagaaaatgtacattatagaggcagaaataattacatcaaaatattgacaacagttgtctttggtagtgggaatttgaatccattatcttttcctatttttttgtacttcatacaataagcatattttgatgtgtaaatacataaacatcttaactattttgtaaatcctgttctctgatacactttagagctacaagcctttggttagtttctgcaaaagttttttgttctgtgttgctttgttttcgtctctataaaagaacaaacttttctctatgctcttacatcacaacaatcaacacagaaggtttttgtgaccaagtgagcttgggttttcccacacacatcaagcaagcaatcaattctgcagcagacacaggttgagtgtcctctaattcagttcaattctaacactatccatctggagttagcatcagatcccagggtgaggactcagttttcaagaatgccccctcccaccacttcagaagtcaacagaaaggtctgcctctttctgatggacaagctacaaatcattcctacaaacccttcctttgggttcagttaatttattagagctgcttacagaactcagggaaacatgcttacttgtttatcacaaaggaagttacaatggatattggtgaacaccagatgaagagatgggcagggaaggggatgagtgtggcagtgtacagcttccatgacctctccaggaccctccagaagcccccaagtgttcgaatatccggaagctctttgaacacttctttttgggttcttacagagttttcattacaaaggcatgattgactaaatcactggccattgctgatcaccttaaccttcatcctctttctcctctcctgggggtgggttggggcagaaagtcccaaccctctaatcctgccttggtttttctggttaatagccccatcctgaagctacctagggactgccagccctcagtctactagtcaactcagtagcatacagaatttattactttgaagattccaaggattttaggaatcatatgccaaaaactggggatgaagaacaaatatatatataatatcacacaccaaattctgaaattgaaaataaccaaccctgcttatgaaagcatagttgtgattttttggggggaatcctttaattcgtaaattatatactgtacctttactacatatatgacttttcaattatttaataaattattgatggcatcatagcattagttttaatatattcatgttgacttgctatcaactcaaggacttcctttcagctaaataaaatatatccatggggaaaattcttgtaaaactttgttttatgcactattttatttacatctcagagatctaaattatctattctaagattaattgggccaacaatatcttaagaaaagaaatgacagactctaaattggaaattaaatatcagtccactaattagttaatagatcttttaatactgtctctaagtgatcaaaatgttctgtgcttctgctgacttctagcactgaaacttgttcttaaaacctgtaatcagaggaaagagtataatgggaattgtaataggtatacctttttttattagctattctctgatatgcactgatatggatgctttgcatatgtcacaattatgagtaaatatacattatatctcttctgaagtagatatttacatgcctagtttacaaacagaaacaacagtagaaaggttatgaaaattgcccaaattccaaaacccagaaaactgacagattatctttgtatggagtctctctcatgccagtcgtttgttggtggtggtttaatgtggtcgtggatcatatagtaaatacttttcaaatgtttcaaccatagagttaaaacatcttagatatttaaactacatttataattcatattaaaaatatcagctcataattttgtcatcccccagtgtttttacaactgattattgtatataactaatggccccacccttcagcaaaatgtctttaatattttaatattcctatttttaccatgcaatgggacaggcaatgtaaggagtgccatattttcaaattgaagccagacatgggaacattacataaaatgtataaaatatacttccctaaaagaaaacgaactctccaagagataaaataaggaaatatactgaggcattgacagtaatttgccttcacagtgtcctccataactggagacttaagaaatatgagtgaagatatatgtcagtaaattgtaggcaagtaagcaagtgttttaattatcttcctgtgattttctgtctaaatatgaagatatctagaatccctttctctattccaagaacacatttattattgttcactgacagcataagtttctccctaccatcacatttattattgtttaattaaacagagacaagtcaagtggttcagaaagaaaccaagtaaatgaatccccatcagtctttacataattaatgatattctctgtagactgcacaatttattaaattgctgagcagaaccacttcagatacacatatttatgtattctgagtcaaagactattctagaaactgtagaacattggaaactaaaataagtcagtggattttttttaaaaatgtgtaagtatgacaaaatttaggagagtaagaactattaatagtgccccattacttcttttttcattttcagaacctttaatgtagtgctatagcaattttgaaagtaaaatcacttaagaaaaataatatgaaaaattaagatattggaaataaagtatataataaaaaagtactgatttctagggaaaaataaataattccccacactcagaccagatacttttctccctatggagtaaattacaagtgaaattttacatttgaatgaatccggccataggatatatattgtaattattaaaagtctaacatagcaacttgaatgtttcaagagacttgctattttatatttaatatgagtgaaaatatgttttaggaatatgttttttgttccttaagattaagttttgtatacagagtcatagacagaagttttattctttctgtctctgggagagcacagcagtaatgattctctatgaggctaccaacatagcaaaattaaccaggaaaaagcaggctcctatgcagagcctattaataaagaaggtaatgacctctaagcattttatttgtgtttcgtttaggcagaattctgttttgtcgtattttacacattattcacaatactgtttttcaaggacatatcacagactaaaatcactgacccagatgacaaaaattataacataagtttgtattgtgaatgtcaatcatagctgttaaaactaatgtatgctgttaaagaaagagtgtgttgaaccattccagcaaaatttttagtgggaaaatccattaaataattcaggagaaattgtaataattaatcattggccttgaataaattgctagaagaaaacaacatactatgttgtgcttaatgaaacatatacgtgaaattattttcaatttctgaaacgtatcatttcaaatataatgagaattctttcattcatgagtcatagataatatcaaagctgtcttggatgctgttaggacacagtatttctgggatactattaatcaaactgaagaaagtaaaaataggtttataaagtagtctagacccaaaagggaggatagacattaatttcttgtgtgatatattggatacattaatatacaatgcatctttagtacttgaccttaagtgtcaagaatataatgcaccatttctcttttataagcagtactttaaagaggtgtttctggtcaacattattttgtactgcaaggttaaaatgatgaaatgcataaaaacatgaaatacacaacttattaaaatgcaattcaccagtccatgttcaggtgtttctttaatgtcagacctcaacaacaacactttcagataaaaattaatcatcaacatgatgctgtatggtaatggcatgaattttatttccatttaaatgtttacatttctctcaaatcaccaaattaatagtacctttaagtctacaatcaaaatacatatttagatttgtttcttttatgctatttttgcagcaatttttattgatagagtatgtgggtccttagctaacaccaagtattcattggtaatgatatcaaggtaagagctctcaaaaaacaacattggcctcaaatattcacccaaaacctagctgtatgattactgcttgaccaagtgcctttgacaaaatctatctaaaaaaaatcagaccttacctcccttttccagtggagccttttaaggtattcacagctttcattctaatttattgtgaccccatatatctacaagtgtaattggactcttaaagtttttagaccaatccaccactagtagcatagtagaatgtatcatgcggtaccgtgaaaaataatgggaactgaaataagaaagacattcatttatatcctgtctaaatcaattactctcttggagacttggttttctttaatggggattaaaatgctttccattcaagatgtactgagtttaaaataagcatcatacaaataatatcttggtgtatggtaggtttccataaattttatctagcttccttcaaataacattatacaaataacatactacattcctactagatttccatcagttttagttgaatcctttcaatctccttcttttcatttatcaatcataacaatgtgttagacaacagaaattttttttagttacaaaatactttcttcaaacagaacaggactgtgttttttttttttttttttttttaactcattcatgaaacaaacattttttgaggcatggttattagcaaaaacattccaaataacgaaagagtggaggatggataaatgaacctgctgttggtttctccctttgttctaaataatagatgtagacatattttaataatagcgattagatgaaagtctgcattatatagtttaaattactttaaaatctctgatggaacttaaaacaagagaacaagtaacaggaacttgagagttagaaaaatattttttaaactttaggcagaaataaagcccaaaattttagtatatttcctgccagattattttatatcctagagataccattaagaaatgaaatagaaacaaaaagctgttgtaatgtagaaacagttaccacaattcagtaaatacataagtaggacttaatttttttagttcctaaagtatgttcttattcatactatatatgactttagcagacttatttacttatttatttactttgaaggagggagtggtggtgtttgggtatataaataaatgttagctgatgacaaagcaactcttttaatttatgaataaaaactgctaggcattaaaagttatttcctgaattatctatttcccaaggtttaaatctttaacttaatactcaatatgtaagttttcatcctgtgaaaaaaaaaattactaagtgtaacagaatttctatatttcactctcttctgtcaagaaaaatttcttttaaaagactaattatttatagttgaaataagactgattagtgttgcttgttccaatgactaattaatgaggaaatggcatgtccttaccctttgatttcttgctgattaataaatcaataaagtattactggaaggaaaaaaaaagcacagaaccacactcatataatgagataatggttgccctttttcactttctgaaaactcatagtctgaaaaaaaaaaaagtccacatcataaatgaaattagctgggcccattgccagacttttgaaggaggactagaattgatggctcatgaagattaaattatttattcactcctggaacatgaaacaccaggacagagttgggacacagccattatggtcgcagcttgtcattgcccttgctgctgtgggtttcatttcttaatatacaggaatttcaaacttcaggtttgttattataggtcagttcttgagatgggcctcaatctagtccacatcttcatgacacatccaagataaaaataactgctaagatttttggtgtttcccagtctgagtttctaaagacatcacagagtaataaaaaaaaaagtaacctatataatgtaggcaggcattagccacctttgagccttttatgctgtgtggatataacagctccaaagtgaggaattaggggcttcattgtaaacccctaaaacttgagctcctttgatgcctctttctgtaggtgatgctgtcgccatttaaatacctggaaatgagccatatgaggtgcagagctaatcttaaaatccaagtagaaaagacttcagccttccattggccctcaagaagtcacagtcagaaccggtttgagagacaggtaggctacctcacttacaaccctacgagtaggctgtctccctagccacaggattctctgggtctcttatgggcactgcatgcaaaacttccttcaccttggatctcttaactttagcctcctgaatcatcctgttcttatgcaacatcagctatcattttgaactcaactagtccattgcctgaagcataagagtcctaaagtgtcaaggccagttgaggcctcacccagctttgtgattttaaggctgcacttttatagatgccactgaaatattctttagatttcatgaaattttgagttcacaagactaatatttataccttaaagaagaatgcttatagatgatctggctttattgctgcagacagaataaattagacattttttacaaaagtcaaatgtaaaagtatagtatctaggatttttgtgctagtacttaaaataaaggaaatgtttgaaataaagggaaatttatccaaaatataattatgtaatcaatcaattaattcaaactgattttagtaaaacttccatctatagaacagctttcttttaatgaataaaatcattaatgaaggcatattgtaaacataaatatatggacagaatagtccagaaaatacagaatttggatgcgttgcgtgagttgtcgaggtgaagaataaagcatcttggacaacaggttgagcatttcaacaagaagaaaacttactgtacagggcctggctgctgtgtgctcccctagatgcctgaaggttctgtctcaaatataccattcccacctcctcccttctcccccagattaaatctgttagtgttttgaaatacccaaacttttcatgtttttaatagacattttgagtaactctggacaaaaaggcattgctagattatgatgaatatatgcactctggagttactatatctgaattcaaaaggtgccctgaaatttgctcattctgcagcctttgtttggttacctaaactctttaaacctcagtgctaccatatgtgaagtgaagatgattgtcttcctattaagactgtgtgggacttgagtgatgtagtacacaaaagcacttaatacataagatgacttggaagagaagagatactaaaatggtgtattttaatttttctccgcctcccgggttcaagtgattctcctgcctcagcttcctgagcagctgggactacaggcatgcaccaccatgcccaactaatttttgtatttttagtagatacggggtttcacaatatggaccaggctggtttcaaacccctggcctcaagggatctgcctgccttagcctcccgaagtgctggaattacaggtgtgagccgttgtgcctggcctgagtatactgttaatatagttttccaccaccggttaccaggctatacctatatcataaatcaagtaatcctataaatctcttatcagaaaaatatagctattatccccactaaccattgcaagactgacggaattctaatatttaccagagtactttggtctaatggcaagggggccaagttctctgttgcactgtgaatgggttgtcgggtaagacagacaagactacttcatttttttttttttcgtggtcacatgtgtctaaccctggacggtcatctcatttccacacacttttgttttaaggtaagaggcctaaataattaagaaccaatcaactaccctgagataagattttgcctcaatagtggaacataacacctgaaaggaaagtgaaattgaatgttgattttggagaaaagaaagaagaatgaaagcaaatttttatgtgttgacttagatagaggccttgcaaacataaacacatttaaccagcaaacaactctagggccctttgcaccaaacgatgcaaaataaaaatgcattaatttcattccaaaagctgcatccgtgcactttatgtaagttgcttaaagattaggaaatcagttactgtgcataaagttgaccttcatttcagacatctgaaaaaaatatagttttaagttaggatgatgataattttcctccggcaatttcgaaagaggtgtaattttgtagctaaagtcgaaatcttgaaagaaaagtctacctttcaaatatgaattcttaatcattaccttgatgtaaaatcaattaccattaccaagcaaaaataagtaagtgctcacttttttgtgaaggtgacattattcttttaatgctgtatttttaatattttcctttttgctttataatgggcccacttagatgtatttttgttttccttagtccaaattttagtaacagttttgtgctttggatcctgtcctgatgggtttgtaataatttttacagaatttttaaagagatattaccctaaaatattagagttccatataggttcttgaccacaaactagcagaaatgtgaataggtatattggaatagcttggccacttcagaattagtgagtcaaacatgaggaaatactataaactagagacagcagacctagaatttatatattatttattcaacattaacagtattatcagtaaatattctaaaattacagtaatgctattaaggaaagaattttctgtagagtatataaagacaaattctatattttttaagtttattaattaagtatattaaaatttcttatcacagaatgactatgaataataataattcatccatagatagatacagcttttctggtctgtagaaactgctaaaatcttatcggattcatatactgaaattttatattttgtcatgctgtaatgctcattcaaagatattaagattctgataagaagtgttttctaaaagcaaaataatatttttgaaaatccaggatatatagtttaatatacagagcttcttaaaaatacatccagatcgcagagtgtattcaactaatagtgtgtgaaacaattaatcactgggggtcagttttctaatttaaagtgaggtggtttggcctgaagtacattattttgaagcccctactatgattctgtgaactatttgacttactaaataaatgtggatggaagacgtagcattcaccaatggtccaggggatgctaaaaacaacagaacccttgctagattgacctaattgggagtctggtgtgtccctgttttaagatggtgagttatctaacaggcacagaacattcagcccaggtatgtaccctacctttaatcatctggacgtataatgattttgagcattagattcccaaagtcatgaatcctgttgaaagagcaccaatgaaattccaaattgaccagagtattttgccataatattatcaggttattttatgagtaattacattttattatagcaattaagacatctaattttgccagtatggaacaactaaatatgagtttaagtttgaatgatgagaagatttcaacttcatcagggtgatgaaaaggtacatagaatggtcatgaagtagaatgaaatacagttagaaaatactgatcactccagcatgtctagggcatggggcccttatagacacaaacaaaatgctcttcataggtgatgcttggtttctgttcagtacattgtgttcttccaggtgactaaaattgattatttgatgatgcctgctaatatctcccccttactggagttaacctgaacatgagatgctgtgattgccagggctgtcttgtgcttaacagtgttcctcattgattcagtctgaaagtctaaagtgctctcaacagtgtagccccttatgccattggacggctactgtagaagtgtccttggaaaacactgaattttatcaacgactggggagtagttgattaatttttaacgtacttgcttctataaatctaagttgccatttccagattaatttcatttcagcagagttgtttatgtgcatataaaggtataatttttaaaaagtgaaatttcaatacatgtccaattctgttggcaaacctcaaaatttaaaagaagctttctttatatttttaaattatgcttctatggtagccataaatctcagtgcacttttctgagtggaagccttggctattgatcaacctttggtcttctgcagctgagttaaatatcatggaaacattagtgttgaaaactaaatagatgaaattgtaaaacctactttacttaactcagtgacagtagtatttgtcatttatttacatgacgacactgaaaatcaatcaaatgtcagattccttttaactactttaacagaatatgtgagattgttgtatgttgggcaactcaagaagtaatttattcaaaccctaatgctggaaattaaataatatgactagaatgactactctggttagtagaacacttttcatcagaaagttgtgagttaaaagattttaagtaacccaatgggaactagattcaaatatcccagttcccaagccatgttctctaattcagatataaatattagcaataaggatgagtacctcataatctttgtgtttccgtctgtagaaatagcttaatgccacctgtcaaccaatgtctgaataaactaaatttggtaaataagatgccatcattgtttttccatggaattcagaggattcggttactgaaatccatggcattaatttttctgcctaacagcctacactctatattgatttttcatatagattaaatttcctttttaaatttgcattgactctttaggcttcggtttcctcatctgaaaagctggtaaaacaatagtgctaggaagaggcttcattgtgaagtcaacaaagattacacctcaaggctacatttgcaagtgcctacacaatatatgtgcattgctatatgttgttgtaaaatttttgaataagacattaatgcattcattttcttaaagaaggactctcatattctttaaaactcagaccccacaatacccagatctacttttatacaaaatccctaaggatgtgataaggactaaataagatcatgtaaatgctctttttttgcaaagtatgtgcttaaatataaactgttgtcattatgaaagtcattcagtgtagggttctatacagttcaggagtcaaaatactcacttgatacagtgactgtcattgtatttaccattcaacattgtttacatttacatacctggctttgttatttccagaagggaaaatccacgttcaccttgtttgcctttcaaccccagacactaggatggtgcatggcacactgaagacactcaataaatatttattttattaatgaatatgaaatatgacttagcagtacagaataatattcaaattgtgaaataaaatacactgaggatcaacactgttatttaaaagattctgttgatcctaaattttacaatgagtcattaaatgtattgctcagctttcataatcttcaatctataatggtttatttttcaaaaaggctttaatttccttggattgttgtaaagttcagagttattcctttaagaaacaggctatattgcattgcaacaataaccccagaaaaataacattagtagaaataatataattaaatattcatataagataattgacttatctgctttactcaaatggattttaatgataatattggactaaccctatgtgacagcatctgctgcttttatgcactgtccccttacctccctcggccccctgctttgccaatccttccgaacataccctggaacatttggcttaaagtttcagaaaatctgctccgtttgataatgtcaactcatcacatttcagttaagcagacatcaaatcaaatgactcatgtcacagatacataaatattacgtacatggaaaggaaatttttagctataaatgcataaaatcttctggtttgtaaacctgaactacattttaaaattttgacagtaagaggaaactgatgtgaaactaatacataactctcaaataatccaatggccaactgatttggaagctactcatacaaaataatacttgcgttaaaaaatgtcctttccttaaagttactatcttaacaaatgtacaatcataaatctactaaaggtaaacatcatttcttataagaaggatatattgaactgcatacacatcttactgtcttcaaattccttcaaaaatataattaacccatccaccttatcagggttagctcaaggaaattcgaaaccatcataagctaaaaatcgttatgtgattgaacctcatcactagataagtgattctgacaaaattgccattttatggaattgatcagaaatgccattccaagaaagagggttcgccttatgaaaaaccatatatatttttatatctatattatcttatatgaataatatatatatatttttttacttgcctttggaaagaactttgtaaaatttgttaaacttcctgtatggaatgaagtaccttattacacatttctactcttgttaaataactgggggaaatgtgttatatctaggcctcactttataaatatttgttgaacttattgaattcagacaaggaaggccagaggggtttgtgtgagctgttctctgccgtcggctgatatcgcatttgctttgataaataatattttaccttcccatttgggtaatgcctgccttaggttgagttcttcttaaagcagattcttagatgaagattcatacaagtggtttatttgtgaattgaaagaaatacatggggttatggggaaatgagacagggaagggaggccagttgctaaagtcaaaacaggtgcctctaagctagctgccacgggaagggaatgtagatgagtgtccatatgtcaatgccattggtcattagatgtttttgatgaggactgctccatgatggttcatttcctggctcttgcaggctgtcatgaaggtggcaaatgagtcttcagggacaggagagcaccctcaggaaaagaagccaagaagccaggggttggctttctcttggaagttaggcagtggttgatgaggtgatcaaggtgggagatatgagtggagaacaatcagcgtctgccagaatgacaaccatttttcacatcttccttaatattttaaaaaacagatatattctaagacttttcttataatgactagagagggttttaaaaagtggttttatatttgatggaacccttgttggtgctgcagttaaagagttacttcaaaatcctgcctcagcacaccctgttcctttttctttgcactccccgaagccaatgtttcagaagcaactgccgatcagcagaattcatctgtttctcccacagggctaatccctgaccgacctggaagccaagccaggctctaacctggcagactcactcttctcctgctcctcttttacgtaatcccatgcttattgattctctagaaaatctgttttccttttgctcaaagcagagtacaaagcaagaaactgcctcgcactctggagaaaacacatgaaatcacaagctaaccagtgactgtcattccataaaatagcagttctattaaagtgcattatgtaaaaatgggatttgtactagagttgttttataggaggttggtttatatcatcacctgtttcattgaaaatttggtcggtgatgagtcatccataaaactggcagaataaaacttcaggagtggctgttgtaaagttcttctaaggctcataaaaccgggttatgcgcttccacagttttgatattgctcaaacatttcatcaaaagaacgtgaatatcatcagtgctacattttaatttgatttttaggaactttcatttttaactttccttccatgacccctgatcttttatttgaaagtatgggaacacttgacccattgttcctcttcacattggatcagagaatacaaaagttaaactcttacacactgctatagataagagagagtttaaatgttagttatagaataagaaccttaacgcttttgtgattatataaaaataaaagctagcatttgctgaacatatgtactgtttcaaacattacattgacttatgactcactgtttacgttcattgcatcacatactctttatgacaatcctgtgaaatagttgctcttttcttaacttttatttcaggatcggggtacacatgcaggtttgttatacaggtaagttgcatgtcacaggggtttggtatacagatcatttcatcacctaggtaataaacatagtacccaatgggtcacttattattatccacacgtattaatacttagaagaaacctgaggcgcagggaaattaaataaccatttaaggtaagagtcaggaatcaaaccctagtttctctacacgaaagtatgctttaaaaaactctactgtgttatgaaataatatgtgcccatgtgaaagaaatatatagacaaaattaatctaggatggaaaatatcacagtggtggttgcctctgggtggggggattgagactgacctggagggagcatgagagaactttccagggtaattgaagcctcctatcttaaccagcacatagttatatatagattgtaagagtatatgcatttgtcaaaacatattcggtggtaacacttaagatcaatgtaatgttgttcccctcttaacttatggatactaggcttaatatatgggtgatgacataatctgtaaataaacctctataatacaggtttacctatgtaacacacctgcacgtatatccctgaacttaaaatacatgttttttaaaaagatcaatgtatggaccaaaggcaaattatacaggcacaccttcccaggtgtgctatcctcccacctctgtttttagtcatagaatctgaatggaagcagccactgccctcatcctgatccccaaaccacgtgagagttcaaacgttgtgcacaagacccagtccagccagtaagaatccttaccaagaacttttattaaaacattgccatcggccgggcgcggtggctcacgcctgtaatcccagcactttgggaggccgaggcgggcagatcacgaggtcaggagatggagaccatcctggctaacacggtgaaaccccgtctctactaaaaatacaaaaaattagccgggcgtggtggcgggcgcccgtagtcccagctactcgggaggctgaggcaggagaatggcgtgaacctgagaggcggagcttgcagtgagctgagatcgcgccactgcactccagcctgggtgacagagtgagactctgtctcaaaaacaaaaacaaaaacaaaaacaaacaaacaaaaaaaattgccatcaaggttaaaataaataaacgaaaaaataaaaatatatatatttcttttttttcccctgtggtgagaaatctgtaaggacatgagtactacttgctgacaaccaagtcctccacttttggagaaggtagtctaacacttcaaatgtggctaattcaactaatgaacttttatttaattttaattaatttaaatttaaatagccacacatggctagtagctaacacacggaatggcaaagctttgggagaatgagtcagatatccacagggtgtaagacataagtaataagaagaaagagccctgatggaactggatctctctggaagggcagctccacccctgcccttcttgtaatctggagatgtaagtgtattagtccattttcacgcattataaagacactatctgagactatataatttatagaggaaagagatttaatggactcacaggtccacatggttggggaggcctcaggaaacttaacaatcatggcagaaggcaaaagagacgccaggaccttcttcgcagggtgacaggaaagacagaaaagttcaggggaaattgccatttataagaccatcagatctcacgagaagtcactcactatcatgagaacagcatgatcataaatcacctcccaccaggtccctccctccacacgtggagattatggggattacaatttgagatgagatttgagtggagacatagccaaaccatatcagtaagctaatgaatacacatgccttcatctctgcaaatgattcccctccagaatattaccctttaaagttacgattaataacataaaaatctttataatgctgtttgtaaaaagcataaaatgcaaatgtgtgggctgaggtaacacttcactataactaagtttccatttatctaacaaataattagtagataaacccaaatggctaattattgtaaacttttccatcttcataaaaatggaagataatataaatagacgaacagcactagcaccttcagggcaccaagaagacaggaggctgaggcttggaaagaacaatcttcacaactttttctaggattggttgtgttaattttcaaaagtctcaggtaaatgagatgggtctggagcaatacctttgcatgatttatgtgattttttttacacttgaattacttcaaggagctttccaaagaatgttttaacatactgtgaccaataatgtcagagctgatggcagcatctgtgattatacttttgaattctggctggtagtgtcagatttgtagactgacattattatttttataatagaagttataagaacacaactctaaagattatggctcatagaattttagaggtggaagaggcccttagagaacatctagtacagccccttaattttacagatgaagaaacaaaagcccaggagaggcaaactgagttgccacaggtgatgacacctaattactgatcgagctgacactaaatccagttctcctaatccccaaagcttgctgtcagtgagccaatcccaatacatcataccattctgacttttgccttttcaaatgatgtcttaattaccgttgatatattttataattttgtaggagctgacaaatttgtcaggacaaaatttcatataatgtgatatattttgtgactttggcgtcaaggaatgcttgtataagatgtttgcccttcatgaaaatcttgaagtattggggaatgcatgctaaaaaaaaaaatcactagttttcaatgaaattttccagctaggtctaatatcaatgtatgcaaaattatcttaaaattgtctgtatttgccacctatatcatcatttacagtatgatagttgcaggaaggacacaagctcagatttgggtagaccaggttcaagtcagccacagcaacttcttaactgttcaggctttgtttgttcttgtgaaaaagagattaaaattgtactagtatagaaagcacctggtattatagtttgtcctatagagataataaatatatagtaaaacttaatgaattggattatacactagaacattttcacatttgaactaatagtgtgattgttatgtaataaatgtggttaataaaatattgatacagtataaaatatataatatctgattaatactaatataattctgttacacaaaaacttttaaaacgttatgaatgaaaaaaattagttataagcatttgagaagattttgcctgggatttggaattattggaaacctagtagatccatcttcttgcagacctagaatagaaacactttggaactgaaaagagaacaagagataaaattttgttgcactgctttctgttcaccttcctcctgacccttcaaatatttcatcccacccagtctgaggcctatgcccaaagtttgattatacattgttattagataatgtttgtgcctatcatcactgagaagtacttccagagtccagagtcgtcttcacttgcattataccacaggttggtccttaatccgtgtgagaatgaatctgcatgagttgaatcactccatttctgaatggaccctgcaggtcctcttcccacaaccatgaacaactttaggatattgtcacttttgtaacttttttctttcccacatcctcacaatatcctccctttgtgtccttcccaataatgctcacacatgattcaataactgcaacaatttatactgaaggctatatatgcaacaatatatactgcaacaatatatactgaaggatatactgaatttatacagaaggatatacgtataaatatacgtttaaatatacttttaaatatacttatatttaaacaatatatattgcaacaatagatactgaaggatatactgaatttatacagaaggatatacatatccactgcttcagatccttgtcttaaaccaatctggagatattcaaattattgataaccctccagacctggaatctgaagctgtagacctgaagattagcctgatatatttattttcccaatatttataatcaatcagataaagagtccgatattttctgggtaaaatcctaggtaaaatatcaaataaaattcactggaagtactcattatatagcagattactgaatgactaaaaaacctaatagagaattctgttgtgagagcacttctaacataaatttattttataatggcaaatttcattagaattcagaaaatgtaatgtctattcaggactgtttacttcttaacatattaaagacaaactatattttgctaggtgaacaagtatttttcttaagtcaatacaaaggattggaaaattaaattttcattgcattcaaggaaaagacaatgaggttcctatcatttatgtatcctcagtgcctagcatggtagcagcacatcactaattcacaagtgtttgtgaaaggaaggagggaggacaaaagagaaaaggaaggaagaaggtttgttacagcatgtcaagaaggtggaaatagaacttagattcaagactctggtttttgatttccctttgaaatacccattttttaaaaatgcttatgttacctagaagtggtaattactaagtcattcattctagcaagaaacatctgagctgctactatgtgcagacacctctggggatacaatacaggtgaaacacaagccactgccctccagatatccacaggctgacaagagaaaggatactttgtacatttctgtaaactgctatcaagaacatagtaatgtcctgtagcccaatgatggaaggaggctggaaaatggcaagagagcaaataaatttggagaataattgcttgagcaaaatttgaacacttaagagaaaatcaatggtcagatatgttaaaaagatggaattcctggtagagaggatggcaaatgaaaggattggggcatgaaactgtggtgaaatttccctaaacattcagttagtttggtatgactaaagcatagtgtgtgtgtgtgtgtgtgtgtgtgtgtgtgtgtgcgtgcacatgtatgtaggtatatgtgcatgtgtatgcatacatggatgtatagaacatagggtaggggtgggaaaaggtaaattttttttttttttttgagacggagtctcgcttgtcgcccaggctggagtgcagtggtgtgatctcagctcaatgcaagctctgcctcccaggttcatgccattcttctgcctcagcctcccaagtagctgggactacaggcgcccgccaccacgcccagctaatttttttatattttttttagtagagacggggttttaccatgttagccaggatggtctcgatctcctgacctcatgatccgcccgcctcggcctcccaaagtgctgggattacaggcatgagccaccgcacctggccaggaaaaggtaaattttttaagatgacagtgaggacacttggtcaagatgaaacaatagtaagatcagggactatgtatgatgcctatatgtgccaggcactgttgtaatcattttatacacactaacttattcaatgaacacatagacacaaacccacacacctttgagctatatcccattgtgatcatcctgaggtacacagaaagtgctttgttcttgtcacagagctaggaagcagcagaggcaagagttgaaactagccagtctgtagagactcgcatatttcatgccaagatgtttggacaagagaggaactgaagcatgctaataacgtgattaatatccctagattctgactaagtttgtggaagttatttataaggaggaaagctggagaaccaaggcaacaggtcttcttggggtcagatgcagtagctcaagatagcagaaagaggtcagtgaagagactttgatctagaacactgagacctggtcactagcttcagtaagagtggacatggggaggactcactgtcacccttctgtctagtttaggtgaatgagtgagaatgaggagtttgatttccttagtgaacctccataggaagtgtctggcacacagctggaatgcataagatacagctctggcaatcttgactctagacaaacatggagttactatcttcttaactggaataggtagaaatataggacaaataccactgtcaagcttcccgcttttcacttttatttgttattataatgtagctatggaagatatgcaaagaaggaaaataaagtaacctccacaccaaagtattattattaataaaaaataaacacctagctcttatcctaaagaggttattaccaagtggtgagaaatagttataaagtataataagtacatataagccttaaatttccaaacagatttgcataatttagcatagcttgtgggtaatgatgatgataaaatcactaaacatctgctaagcatttaaacaacattttccttccgttagcatcagttgctggaaaataacatactttggctcaaattgtcctgttaaaaatatagtttggggccagcagaattttattcatgcttttatatggagtctccacttttttctgtaaatgtatttatagccaaaagctttcaccagttaggaaatgcagcagatgccaataagtacattcattattttgattatggcaatgtcagactttcagaaaacttcctccatctctatctgtagcacaacctcacatagggagggaccatgtgctggtcaggaaataaacagctttctggcaggagttaaatgaaaatactgtttattactcttataagatgttataattgacggttttattgtaatacaatagcgattatgacatgttgtcccaaaccctaattttgttgttttgtagcaagttacgtttttatcaaggaacacagtggtttaaaaaaaaaaaaaacccaaaaaactaagatttggggccgggcgcgatggcttacacctgtaatcccagcactttgggaggccgaggcgggcggatcatgaggtcaggagattgagactatcctggctaacacggggaaaccccgtctctacaaaaaatacaaaaaaaaaaaaagtagtaataataaaagtagccgggcttggtggtgggcgcctgtagtcccagctactcaggaggctgaggcaggagaatggcgtgaacccgggaggcggagcttgcagtgagctgagatcgcgccactgcactccagcctgggtgacagagcgaaactccgtctcaaaaacaaacaaacaaacaacagcaacaaaaacgaagatttggataattcatgtgtcttttgttttgatctcagaatttcctcattaacagatgtgaaataatttaccaagtttttcttcaaattgactaggcctgtataaaataacagaaatgccctttgcagtgaaagcactttgtattagggattgatcactcaattacattctggatgagaagaaaaaaaaaatcctattggtgtttttatgtgattacatttagggagaaaaagtttggaaagctaagaatcttttgtgggaagacaaaaagaaagagcttttaaggggcactttgaatacagagagtgactttagatagctagcaatgctgtttaaaagttacatcatggctttaagcaaaatcaacagcagtgaaacaaactgaacaagcagaaaaaaatataactcgaaacactgatgagtagtagtttttgaaagtgaattcatccaataaactacatcaaataaaggcaaataaagacaatctaagcttcattcacaaagtacatagagaaaaatgcttgaaaatatatcacatccaggaagaattttttaaactgacaggtgaagttattttactatatataaattctttaaggtggcagatatcttgtcaaatgaccacccttacaggaggacagtcaacttgattctaattaataaacaaagttttagtggaaatcctagaacacgtagattcatgagactcagcattcaacttggaaacccgcagaaactgtgtatctaagccactctaaccaaatagaagaaaaccttctacatattatgtgccagggagacgttaggcattagcagtgcacagacagtcatggttcaggctttgacgctgatgacaactggtggaatgtgtgttatctaccctgttattgtactaacctatcctctatcctcatcacacagtatgagaactacagtagcttgtcttctgcctaaaatctcctaccacttccacagtcatttaatctgccagctcactgttatgctggtatttttaagaaataatttcatataattagtctctttctggatgaaacactgctaaggtgtttattactaacctaaattcagtccttttcagctctttcactctttgtaatccaattccattctttgcagccagtattcatttctgcttgttctgaaatctatcccatcacttaggatttggaaactagcagacatgaagattggctacaaagaatgtaactagatttttaaacagatttagctctaatcccatttcttagaacaattcccaacttgaaacaggaaatatctagatggtttcactgtccgattctgtggtgacccaacctcttagcactcagattctgcctcggccctactgagattactagtcttacccaacatacaacttccttccacatctaccaggttgaggaatgaagcaaattatgtgaaataggagaaatacttttagaggaagcttgagtattggtgtattgggataatttatatgggatggtaaagttagagggtagatgatggcacttcattacatctgcaaaattttaaaaaaaattatcctagggctaggcatggtggcttacacctctaatcctagcactttgggaggctgaggtgggaggatccgttgagcccaggagttcaagaccagcctgggctatatagtgagaccccaagtctacaaaaaatacaaaaattgaccaggcatggtggtgcacacttgtagacccaggtactctggaggctgaggtggaaaggattgcttgagcacaggaggttgagactgcagtgagtcaagatcatgtcactgcactccagcctgggagacagagtgagaccttgagactttgcatcagaaacaaaacaaaacaaaacaaataaacaaacaaacacgttctggaagtagtatgaatggtaggttgagagatgagggtaaattcaattgagaaagggatgcaaatgagaacataattattagtaatctaaaagagaaatggtgaggggaaatttttaattaagataaagtaaaataatggtgaaatcatgaatttttttattttgtatttcatttttaaaaatcataaccacatgtacacttcattactttaagaaatgttacttttgaaagaaaaaatagtcatatccattgactctcaaatattcttatgagttatttatactaaatgaatgaaaaaggcagagaatacaactatgtataaaatatgagcccaattttttaagacacacttatgtatagataggcatagagagacagatgggttaagagatattaagagaggaatgatgagagaatagaaaaaaactttaggggctgggtgtggtggctcacgcctgtattcccagctctttgggaggccaaggagggtggatcacttgaggtcaggacttcgagaccagcctgaacgatatagtaaaaccctgtctctactaaaaatacaaaattatctgggtgtggtggcatgcatctgtagtcccagctgctggggaggctgagacagcagaattgcttgaacccaggacgtggaggctgcagtgagctgagattgtgccactgcactccagcctgggcaacagagtgagactctgtctcaaacaaaaaaaaaaaaaaaaaaaaagaaaaagaaaaaaatctttaaggagatatgcataaatatttcattggttgactctagttattgacactataactgatttgcatcttctttcttgcactttcctaatttagaaaattcaattaatatttctttaataaagagaacattgagtgtatctaaaagtatgtcaattggtgagtaatgaaagaaagtgtcaataaaaataaccggaagagtgcagagaacaggtgtagaaatatcaaaaaggacaagctgacaaaagttttgattggtggttcagggataatagagagagggagaaggcaggcatccatgataatttacattttcagctgcatgttatgcatggctgttgatggaatcagcagtgcagaaggctcagcataaataaataggaggtgagaattgttccaagtgaaggagaggttggctgtgggaacattcggtctcaaagcagaggaatattttaacactgacatactttcaaattgctacccatggtaacagttaaaagcaacttcactgtatttggttttgttattattattataaacttccacttcctacaaagcatgcactccatctttgcacctgaaaggagttgttttcactgctgccctctaccttggttcatgactgggagaaaagagctgaaattctacaggattcattttgagagagagaattcaaagcactatagcgttatagctgcaaatatccaagcgatatttggggataagtgtgtgacactgaggagaaatagagtttgaagataatagtttaaatctttgtttagtagtaaacactttcattagtggcctaaacaccttgtttagtagtaaacactttcactagttgcctaaatgaaactctcaacagcataactttctagctgcataatttcggcaagtcccttaatctcactggacctcagtcttctcatatgttacataaagacgataacagtataaattctgtagagttgtataaaagttaaatgaatgaatagatgacaacagcttagaacatggctttagcagattgtaaatactatgtaaatattggatattttattttcagtatatgtatatattctttctacagagcaagctctttatgcattaatagtaatcttgctaaaaatccaaatctattcagaatgagtactacagaatttttcttatagaaatattaccaacattaactcctctcttagataaatgtgattcacatttcatctctttatgcaatttccttattgttttatcattttcctattgctctattctataaataatgaatacagcattttaatgattcttgtaaatagagaccacattttttaaccattgagcatacggacaaattttattcataatattttatttctttcattgtacttgagattaatagcacaatttctcatccacaaagtttattataggttgtaaaaatgaacatgatctctcttctgattggctcagaaaagaagtttaatcttatgtaattatctttcgaatcacacatgcatcagtacaatcaagctctctatctattagatcactgaaccgtttcacatgagtttacagattaatattcatataaaactatatatctttcagcatatctcctcttggtaggttttcttaaagaaaaacaaaaaagagtagcaaattggaaccttggatatggaagaactgcttaaaaaatattcaatgaattgccatcgggtcactttttccccttataaataaaaagttggggtataaaagcagaaatatcattataaaagaactggaatgtcagaaaacactaagaacattctgtttcagtggtatacaaacttgtttgtccttttaagccatgaaactttttctttaaacaaaatttcttcaaaggtctaattcttaaaatagataaactactgtgaagggcagatgctacgaggacaccccatgacccaactcccaaagcctttctttgtaatctctctgctccaggtagtggtttgaataaggacggcctaatccaaacattgccttttagagagaccttgagaagcagtgatgtagcctaggttacaaggtaatccagtaaaatgtatccatgagttccatgcgctgacagagaatgcattgttacattaattttttttttatatcatcccaactatggaaacttcagttgccaaatgctactgctacataatgtattcatcttttggtagtaaacttctctgctccagtttatttttcagcctatgaagttttttgttttttttttcttattaaaaaaatctcaatttagaaataaaaatgagacaagcacagtcaaaatttaaattagcttggtttcagttcctattattaaagagatttttaaaatatcctacttttgaacatctttgctgccatccttcatttctctcacaagggaaatataattcagcagagtcaatcgtgactgttttgaatatggtttactaaattcacaaacaaaaagtgtctctgatagtcaacacaaatatataaacaagcattgagtaaacggcaagaaggataaaaggcatttttccaaatgaagacttccattgaaaagaagaaattcaatgaaccttccttaaaacatatgaaacattctattgaattttgatctaataaaaaattgtattaaatttgctgtattagaactgttacacacttgagatcaaaaaagaaaacaaaaaatgccctaactataggtagggacattgtaggactaatggaagtgagtatataagtccacttggcaccagagatttttttctaatgtggaagtgtcaaaagaattctgctccacttcaaagcagtgcctggcaggaacaggaaagcataaatgtcactgaacaaacttagagacaagcacttccttcactgaagagaaacctgatatctttctagaaattctagtatgctgatacaaaatgctagacactatctaatttcattcctccatattaatcagcaccttaatgtatgttgcagtttatagacagtaaatatactttaatattttctttctttgcatgggtaaagaataaagaatgcaagtcaatagaaaagaaaaattttaaaataattgtagtaattggctataactggtgagtatagcttggctttggagtgatgtagccctatctttgaatgctggctccactatttgttatctatagaaatagacaggtcatagaaagcatttcccatctggcaatgtacttgtgaagattaattaaaagttaatctattggccgggcacggtggctcatgcctgtaatcccaacactttgggaggccgaggcaggtggaccgcttgagtcaggagtttgagaccagcctggccagcatggtgaaaccctgtctctactaacaatacaaaaaatagccaaccatggtggcaggtgcctgtaatcccagctatttgggaggctgaggcatgagaattgcttgaactcaggaggcagaggttgcagtgagctgagatcgtgccactgcactccaacctgggcaacagagcgagactttgtctcaaaataaataaataaataaataaataaaaagttaatatatttaatatagcttgaagaacctagaataatacctggaaccttataagcattcattaattggcagctagtgagtcctttaagctctatgattgcaggaaatatacattcactaggattacctcaagtaatggggaaatgtttttggaaaatagatatggatcaagtaagttaggagttctgaccctgcaacatggaaatagggcacacccaggtcccagttcagaaacaaggtaaagctatagtggtactcttggccacatctccttagtaagacgcaggagtgaacctgttttccttcagtattgtgactagctctactctacttctgcatcaatcagtcctgttcgcagcaactagtcacctcctcctttgtttaatgttcatcatctttaaacatcgacctgcttatagtatccacttactcccatgtctgctgacttatagaaaagcaaggtacaggtatgtgaatgtagaatgagcataaaatataattaaattaaagcgtaatcagcagaaactctgtgcttttgcatagtaatcctaccagtgaatgattctttctttgtatcctattttgacccatcaagacaaattttattggtctaattaataactaagatcccttctgagcaaagctcttctgtgagactacatacagaccagtctataattgctctgatgaagtgcatccgggaatagggtgaggattggtttctcgtggcacctatcgcagccatttatcctggaagaattccctggaaaggaactgcacatgtggcacacacttttagacttagcatttctatacttctcttgtccatttgtgcagaaaggtggagagataattcagaaagagagctagtttaaagctagaataaaccatgcaaacacattttttttctaatttttgcaaattttctccaatatcctgaaggttaaacagaggttattctgttctgttttctatacccatgctaaggttcaagaaactataaaagaggctggctgactatctctcaaaaggcttcctaggagaggttttccatggccctgggtctggacttcacctagaaggatttaaatctgagttgattaacaagatgatatccttcatggaaaaactcacaggggcaaagctcaaaataagcttgttatgtatataaaaaagacaatttatcaatttagaaaagatgccctgaatgcctgtatgtgtatgtgtgtttgtgtaattttatatattaaataatatataattttaattgacagataaattgcatgtatttatcagcctatatttttcatgacatagtttttcctctggaaaaggtaagtagaaatctaaattaaaagctgtatattgctcaatgaatttgaaattgagaaatgtgtgtagttcaaatattttgtctagctacctatagggatatgcttggcctaaaaaaatctttgagccagagattctcctcatttggagtgagactaggtatcctccatattagcctataagaatctattgtttttttggtttctgctgtggaacacttctcctgttgggacattctgcattatttatattagtacatcaaatcaaggtatagacttgtttgaaaactattctatctctctaataaccctatacacttattcattcattcattcaaaaacttacttactctgcacttattatgtgcctgacaccttaggcacataataagtgacaaaaacaatgtcaaagacattgacatttgacgttgacaaaaacaatgtcaaagacattgacatttgacgttgacaaaaacaatgtcaaagacattgggggatacaagagtgaatatggaaagcaatgtctttttcttacttggcccttaggctccagttaaggtagagagacaaaaacccatttaattattccatctctcactctattgcataatctcaatctattggaatgtaatccgtttagggattatatgttatagaacataatctacatgttagagtatacaatcccaattgatcctgcaaacatttctagaaaaaatcctatcaaatgagtaataaagtgttctaagcactaactagaaatgtattcaggtgaaaaagaaaaatccaaaaaaaagtgtttttttttattatggtttacttgagaatagaacttaagataggaacatttatcacagatttgactcttccataaaggattgatcaaagagcttaattctcagaaggtaacttaattcaccttgcgatgaggtcaacatgactatttacctcataagcaacttgaattttcatagtataattagccagtggtttttcaagtctaaagaacagcctttgccatgctaaaacatgatgaagcagtgactcactacagaagacaagccttttcagaatatactctgtgactcttttttttttattattatactttaagttttagggtacatgtgcacaatgtgcacgttagttacatatgtatacatgtgccatgctagtgtgctgcacccattaactcgtcatttagcattaggtatatctcctaaagctatccctcccccttccccccacaccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaagcacaggaactcatcattttttatggctgcatagtattccatggtgtatatgtgccacattttcttcatccagtctatcattgttggacatttgggttggttccaagtctttgctattgtgaatagtgctgcaataaacatacgtgtgcatgtgtctttatagcagcatgatttatagtcctttgggaatatacccagtaatgggatggctgggtcaaatggtatttctagttctagatccctgaggaatcgccacactgacttccacaagggttgaactagtttacagtcccaccaacagtgtaaaagtgttcctatttctccacatcttctccagcacctgttgtttcctgactttttaatgattgccattctaactggtgtgagatggtatctcattgtggttttgatttgcatttctctgatggccagtgatggtgagcattttctcatgtgttttttggctgcataaatatcttcttttgagaagtatctgttcatgtccttcgcccactttttgatggggttgtttttttcttgtaaatttgtttgagttcattgtatattctggatattagccctttgtcagatgagtaggttgcaaaaattttctcccattgtgtaggttgcctgttcactctgatggtagtttgttttgctgtgcagaagctttttagtttaattagatcccatttgtcaattttggcttttgttgccattgcttttggtgttttagacatgaagtccttgcccatgcctgtgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattatctttgaactgaaaattcacatcttaatttgcacagagtattctgaaatatcaaatgtatacctatattggaaactttaccaggtagcactgccacattcagtttttacataagaaactgagcattttagcatatgagttgggaagtcaattgtcctgcttgatttcctatttggcatgtctgtgataatattgaaattgcttaatgattttatttattccttggagaggtggatccgtacacaataagcatttgcaaacacctgggacaaagtatggacctctgtcagcatagtctgtttataggcctaggaaagtatgaacagagagttgagaaggaagaggcaaaggcatgttattttactgagacacaatgaaatggctgtacatagaaaatacatcttaagatatcagagataaaagctataaaaggggcaggaagaacaaaatgtaaaaattagatagtttcacttatttttcctttctacatccttttttttttttaattgggaatcttagattggtgggttttgggggagggtggagttccttttctgaggtcctttattttctgcttgagtgcctgaaaatagatgcaagacagagaatgtctccactgactctcacggtggctgtttattcagagtgcagccttcatttggctctcctggaagctggctgtgagacaaggaatccaggccaagttctttatttggcagggaagtggagatgtagatagaaaagaaaaggcaactaataacacattatcaagtcagttaccagtacaggtagctgtagcttaatcccactgggaaactgagaacccttagaaaagtttgccatcagcatcatcttctctggggcataagggatctggggttcttataccccttttccccaagtggtcatgatctctcttgtacttccagcctgtggtgttttcaggtgcacaggccgtggctgcgtgagaaaactctcagcccgttggaagtcaggagtgcaccacagtgaaaagggctatgggggcagagatggatagagcatgacagttctgctgtaagtggcccaagttgaagggagctgttctcccgtctgcctttttgccttcttataaaaaccaaattagcaaagacattgatacatagacttgtcttataaccaattatggacttatattaattacccatcaatattctctgatccatagtacatatggaaatgtgtgtgtgtgtgtgtgtgtgtgtgtgcgcgcgtatttgtaaaatgccattatccctggtattctatattagcctaagcttaaaattcagtccttgtactgttactttttactgtacatctgtgacaaaattaatactgccatatgatgggtgcctaacaccacccactgcttttaaattatattctcattttttgttattcaatgatggttcaactatttcaccaagaattaaatagaagtaagagtcaaaatgaccaggatattttctctaataccgctgtgtactattaaaaaaataattaagatttctttattcatatcaattatgagttgatgcactgaatgatgtaatatttattcatgttaacagtggaaaatgtgagtgggaacagctttcatatggaatgcttttcttgtactttagaagtaaataaataattaaataaataagagttctaatttatgggaaaattgtcttatatgagttgattttctaagcctttgttttaccagcctgaaagaggaatgctacacagtcatattttaatggctttgtttattcttttagaaaaagtatcaacatgacatcatctgaggctaggttgtgctgcatactaataaaaacctgagaaatgtatgtttgacttctgatgtaaaggttttctttttaatatagacttaataacaatttcatacttaaccgatgagagcagcaaattaatcaaacaaatcgaacattttcttctccagggaactggggaagcttctgatcccttgatatgattatatctatatatcaaattccatactaatgacccccaagagagatggctttatcaataagattgtaagttattaattaattaattagtctcctggaaattctactgtgtgattttctgtttttacctcacaggagggagttctgagttaccttgcttcttcagagggttagatttttcatgtttcagggttgaacaatgaggtgtaggcaagagctcaagatagcatttgaggggcttcgtttctgtattttagactattaagctaacttctataaagggaaagtactaacgttgatatttagagaaaaacacggggggagctaaaacaagacagagaaagacaatttgatgcccttaggatggggtgatgacaacaggtttgttccaacatagcagccatccacatagctgtaccagaagcaggaccttggcagggaagttctgtggccttgtgtgactttaaccctgggaacccggcaaagatttctgtaggcagagttgatacaaaagggaatgttctcaaagtagccaccactttaaatgaataaatagcacctcagtagaagaccactggccagtgttctgtccaaattcacacatggaggcaaaggtagccatacaaagtgatgaatactgagtttcttgctaatttcattgaatgggtagcttgaaacaattactttgatttagaaaaaataatgagatctgacatactttgcattgcgtcttcagtttttctgatcaatccgtaagttacatgatcttcacatacaaactaagaccattcacataaaagagagaaaaggagtaattatttttgctttcttagcaagtgcctagaatagcattttccggtgcatgcactggggacaatcagggccataaatttctgatatgaaatacatttaagaaataccaatatgagggcaatggaaatttccggtgcaagcactggggacaatcagggccataaatttctgatatgaaatacatttaagaaataccaatatgagggcaatggaaatttctttggtaatttgcaaaacatattaacatattaaaggttctgaagtaacccttgttactagtttaactttctttaacccagaattgcccaaacttacttgagcataaaagtgttttaacacttctgagaaatatcctttcagataccagatggctagataaaaataaatagttgttctacattgtaatagcatctattacagtttcaaatctaaatatctgtctttgttccaaaagcaagcttatgtatatgattgtttttattttctatgtagactcacaaaaggagagacatagaaaatttaactctacactatcattcccccagattcaactctggcatgataaagatcctagagtgtattacaaagaggtcacccttataatatggtaaatgcatatcttctgctataaatattttcataaagctcttctcttagtcaaggattgagagtacaactggccgtctttaggaaataggaatcaggaacgaatggttgttgctcaaaagcataacatttaagtgggttaacagagcacttatatgaatgagcaagaagataattgtgctattacacacagttttacgaccattaaaatacctgttctaatttggcatcagatacgtgagcacaatgtgaagagcctgaggttggaatgagagcaggaaaaatgtccgaagtttggacagggagcaaagaaattgagaaaattatagaattgaagagaaaaccatggtgaggcacaaaaaagctgtataattatatgaatgatattaggtggttggcaataagcaattattaatattttcttttatgagtgaggaaaaaaaaagtatggtcataacagagggaatgcaattcgagcataagaagaaacacgagagtattatgctgtagtagtccagtctcactctgctatgaagaaatacctatgactgggtaattcatacaggaaagaggcaaaactgactcacagttgagcatggctggggaggcctcaggaaacttgcaatcatggcggaaggcaaaggggaggcaaggcaccttcttcacaaggcggcaggaagaagtgaatgcaggaggaactaccaaacacaaaaccatcagatcttgtgagaactcactcactatcacaagaacagcatgggggaaaccacgcccatgattcaattacctccacctggtctctcccttgacaggtgaggattgtggggattacaattcaagatgagattttgggtggggacacagccaaactatatcacatgctaaagcagccaataatatctctaggaaaatgttgtagtttagggtagatatgtgtttggaacaatttagattcaaaactcacagaattgtgagtagcaacaatgattactcttaaattagtaatgctggaatataggtaattttaattgtgtgttctattctgtggtgccagtggcattttcccccctgatgttatttttctgcagctccggctttgtacataaatggataatagtgctccttggtgatctattttcaagtcaaaattctttcttattttctgctgaggtttagcattccgtggataaaaagcaaagtttttcattccacagcaaaatataatggttaaaataccaacagctttacaggaaagaggaccagcctaataaccctgaaatagtcgcagttagtgaacccttaggcacagttttctcagtaaaaaaataatgtgatagttgataggataacctggagaatcccactaagtgctgatgtatagacactgtttcaatcttctcacattcatctgacttccctccagcctacctcagtgctgtgttatcctgtgtatggacagattgcatgtcagattcctaattttcaaatcaattttcaaattaataatttaataataatgtcttatacttatgtatatttcaaatcaaccctggtaaatctgatacttgtgttttatagtcaaagttgagcattttatgaatgcaccttgtaaatatcacatatcaggcaagcactagaaaaccaaatcacaaactgaaccaggttatcttccaacatttgccaaaatgagatgcaacacatctgagggaaatatgtattaatctttcttgtaagttatctgaattggtttaatggaaataaaattttaaaaactaaaatatattataaattctcatggatctgtctacattggtttataatttattttttcattagatttataaaggggcaatgtaaaaattaacatcagaatatcttatataacccattttatccattgtaataaagtttattgaacacctgctatgtataacttttgttttatttccttttaaataatagaaactgtattaactattgggtttcacattttcctttggcttccatgaagctcctgcctaaattttttgctcaggcacagaaatgaatttatctaggttaactggataacagtgcatcgacctctattttacttatagtagaattttatctacatattatttcctgttctgttttatatacctttagcagtgtaagctaccttaagcctttgcagaaatcaaatgaactataagtcatatatgaataaataaatgctaggtctaatatagaaaaattaataccttgaaataaaggtttattgagtcttttttcagagaagaagcattcctctaatgaaaaatattaatcagaaccatatttgctaattaataatttaatgataatgtcttatgcttatgtacattaaatatatttatatataaatgataataataatgcctcacacttatgtacattaaatgcatataatatataattatatatctatattatcacttctcacagtgaccttaggaggtagacattttttctcaaattaagtgtgaaaaattagaattcacaaattccaggatttgaactaaagacaactaattctacataaagtggttcatctgtaaaatttagtgtttagaactaatgtttgctatttgcatagggctgcagtatgaaagagtgttgggaaatgtcattagcccgttcttgctttgctataaatatctgagactgtgtaatttataaagaaaataggtttaattggctcatggctctgcacgctgtacaagtacggtgctggcatctgctcagcttctggggaggcctcagggagcttttactcatggcagaaggcaaagcaggagcttgaacatcacatggaaagagtaagagtaagggagaatgtggtgggggagtgccacacttttaaacaaccagatctcatgagagttcactcagtattgccaagatagcaccaagcgggtaatgctaaacattcatgagaaaactacccacatgatccactcagctcccatcaggccccacctccaatactggggatgacaattcaacatgagatttaggcagtgacacatatccaaactacatcaggaggtaaggcatttagatatatgtgtagacttcaaacctccttgctgtctcttcagtcctctaaaatgaggtgtgtctaaagaaacaaaagctttcatacagacctgtaccctagtggagatactgagtcatgttgacaaggattaaactagtctatataggccatcacataaaaataagctttatttagccagacaacagtaaccattgtgttcacaagaacacatacatacaagcatggctgtttgctcatagtaaaattttctttcctctagccatcaaattatcttgaaaatttgctgaactcttcactgtactaacttaaaaagaccatgcaagacttataataactcattgcatgaagatgcctaagtcattaatgtgacattttttttagaaagacagccttccacaaatctatttctaaatattagaggaaattgtgaaatatggttcagatatgatagagaatcatagcccatagttttttcctggtgtaataagacttgtaacattttcaagaaatcaagtttaaagtcaatccataactctaagaagaatcctacagcctccctaaaatttgaaattatatatatacctatacacacacacacacaaacacacacgcacacacacaaacatatatatatgaaaagactctattaagataaaaatactacctagaagcctaatggggaaaatatggttaagtttgctcacactgaattggaacaaaataggattgaaattttattccaccatttaaaaagcatatgacttgggaaaattacataacttcttcacatgtcaatttcttgagctataaaaagagttcaataatataatttatctcatgaggttgttgtgaggattaattgtgataaggcatgtgaaatgtttcactcattgtttttgtaagtattgagtaaaatcactgaactggtgataaaataccaggtataaaactgacaatctatccaaattgatttttgtcttaacacattcagggcagaagaaaatgagaaaaaataaaacaggccgggcgccgtggctcacacctgtaatcccagcactttgggaggctgaggcgggctgatcaagaggtcaggagttctagaccagcctggccaacatggtgaaaccccgtctctactaaaatacaaaaatattagccagacgtggtggcttgtgcctgtagtcccagctactcgggaggctaaggcaggggaatcgcttgaacccaggaggcagaggttgcagtgagccgagattgtgccactgcactccagcctggcaacagagtgagactctgtctcaaaaaaaaaaaaggagagaaaaagaaaaaacaaaaccaaaccctaaaaacatggatacccaaatagagtaaattaagaatctagagacattagttatctgaaaactattcagaaactctgcacaaacttttgatattggattgattaactttgataatgaccttatttttggagtaaagtgaacacaaatatcagtgtattagcccatcctaaaatattatttcataaaaaattaattcatcataaaataacactacatatcaccctgctttcattttcttaactacattatagaatgatagcacatttagaagatgatgtcatctttcaattaataaagatagttgtgcctcttagagaaaggtaataatttcaagaagctggatgagctgcaaatctacacaaatatttttaagaacatatatctatttaacaattttgtgctctctcaattttatttttgctgtttttagacatatggatgtttctatttttgaaattctttcttgtttttgtttgtgatttctgttttttagtcttcctccaccaaagctgtttagtaatctagtttttttccatttcattatttgattagttatatttgattattaatctatcaaaaattacttcttcagttgtgcaacgtggcgatcaaaattgattctcaagtaaatacctcaggttcctagtaccaattattgtctcatcttaatatttattccttagtttattatttctcctttatttatattaattatttatgtattgtacaatataactcctacatatataacaggttatatttttgcattgccatttctggttgattggtctgtctattcgtaggttaataccagaccattttattgattttattcttacatttccagatcttctcttttgggcaatactttctgatttgaaaggaagtagtgaaaaagttttacaaaacagagaggaggaacatgtgttgatcagtcacatggtttgtaaagcaaaatattggggtttgttgtatagtgtttacttattttaaatattaattttttctattcaaagaaaatatttaatggtgaaaatcatgaattttggatatagatgtgggttcgaatttgaactttgtaacttaatggttttttaatctctggtaaaatccattaaattctttcaagctccttcctctctgaatgggattattaatatgaatctcatcagtttagaatgagtcctaagtgagattacagaggaataaataaagcacagcttacttgtgattgtaagttcctgtcttcttatattaataagaaaaataaaacgaaatagtgctaaagtgttgggacagcgaaaatttttggagatggtatggagagataatgggcgatgtttctcagggctgcttcgagcgggattaggggcggtgtgggaacctagagtgggagagattaagctgaaggaagattttgtggtaaggggtgatattgtggggttgttagaaggaacatttgtaatttagaattattggtgatggcctggatacggttttgtatgaattgaaaaactaaatggaataagagaaggagaaaaacaggtataaaaggtctaagaattgggacgactcaggacatctgattagagagtgcctaaggaggttcagcatagtcctgccagcaaagattatttatttacttcaagagttaagagtggcagtttggggatagcaccaggaggtatcagctttgatgacttggagaaacagtgtaaaccggcagtgtaaacaagagcagggcatgcatgagtagttgagaacggtgaataggagtatgactagacacaagatagtaggaatgacaagttttttgggggcacagtctaagttgatctggtgtctggaatgagactggggcctaataaaaaggagcgtctatacaggagctcaaatggcctgtaccttgtagcattctgaggacaggtctgacttctgagaagggtaagtggtaaaagtattgtccagtcctttttaagttggtggctgagcttggtgaggtgtgtttttaaaagacctttagtccattctacttttcctgaagacggaggaccataaaggatataaaggtttcactgaatactaagagcctgaaaaactgcttggctgatttgactaataaaggctggtctgttatcagactgtatagaggtgggaaggctaaactgaggagttatgtctgacagaagggaagaaatgactgcggtggccttctcagaccctgtaggaaaggactctacctatccagtgaaagtgtctacctaggctaagaggtattttagttatctgactcggggcatgttgagtaaagctaatttgccagtcctgggtgggggcaaatcctcgagcttgatgtgtagggaagggagggggcctgaataatccctgaggagtagtagaatagcagatggaacactgagaagttatttccttgaggatagatttccatgatggaaaggaaatgagagcttctaagaggcgggctagtggcttgtactatagcatagcctgcctttgcttgtgtgtggcgattaggcctggtggaactgccatcaataaatcaagcgtgatcagggtgaggaacaggaaagaaggaaatatggggaaatggggtgaatgtcaggtggatcagagagatacagtcatgggggtcaggtgtggtatcaggaataatgtgggaggccagattgaagtccgggccaggaacaatggtaattgtgggacttaacaaagagtgagtacagctgaaggagccagggagcagaaagtatatgcgtcagctatgaggaagaaaatagattttggaagttatgagaaatgtagagagtaagttgagcatagtttgtgattttgagggcctctaaaagtattagggcggcagcagccgctgcacgcagacatgacggctaggctaaaacagtaagatccagttgtttgcgcagaaaggctacagggtgcagtcctggctcttgtgtaagaattctgaccacactaaccatgcctaggaaggaaaggagttgttgttttgtaagggattgaggtttgggagattaatcggatacgatcagcaaggaaagcacgtgtgtttttatgagaattatgccgagataggtaacagatgaggatgaagtttgggcttgactgaagtaatgggggctgtctgtgaagccttgcggcagtacagcccaggtaatttgctgagcctaatgggtatcagggtcagtccaagtgaaagcgaagagaggctgggatgacgggtgcaaaggaatagtaaagaaagcatgtttgagatccagaacagaataatggattgtggagggaggtattgaggataggagagaggatagggtttggcaccatgaggtggataggcaaaacaatttggttgataaggcatagatcctgaactaacttgtaaggcttgtctggttttaggacaggtaaaatgggggaattgtaaggagagtttataggctttaaaaggccatgctgtagcaggcaagtgatagcaggctttaatcctttcaaagcatgctatgggatgtgatattggcattgagtggggtaagggtgattaggttttaatgagatggtaaggggtgcatgatcggtcgccaaggagggagtagaagtatcttatacttgtgggttaaggtggggtaatacaagaggaggacgcaaaggaggctttggattgggaagaagggcagcaatgagatgtagctgtaatccaggaatagtcagggaagcagacaatttagttaaagtgtctcggcctaataagggaactgggcaggtggggataactaaaaggagtgcttaaaagagtattgtctaagttggcatgagagtgggggttttaagaggtttagaagcctggccgtcaatacccacaacagttatggaggcaagggaaacaggcccttgaaaagaaggtaatgtggagtgggtagcctcagtattgattaagaaggggacagacttaccctccactgtgagagttacccgaagctcggcgtccctgatggtctagggggcttccgaggcgatccgacagcatcagtcttcagccgctaagccaagaagatctgggaaggagtcagagagccttcggccagagttccaggggctctgggagtggctgccaggtgagttggacagtccgatttctagtggtgtcctgcacagatgggactcggcttaggaggaatcctgggctgcaggcattccttggcctggtggccagatttctggcacttgtagcaagctcctgggggaggaggttctggaggaacgcctggtcgctgcgtttcagatgtttggaagttcttgtgtgctggagatgtggctggggtttgtctcacagtggaggcaaggaattgcaacttttttctattattgtacacgttgaaggcgaggttaattaaatcctgttgtggggtttgagggccagaatttaatttttggagttgtatttaatgtcgggagcagactgggtaataaaatgtattttgagaataagacggccttttgacctttcagggtctagggctgtaaagtgtctcagggttgctgccaaacgagccatgaactgggctggatttttcatatttgatgaaagagcctaaacgcacactgatttgggagaggtctgataaggaaaaaggagcattaaccttgactatgcctttagcttcagccacctttttaagagtaaattgctgagcaggtgccggagggctagaggtggaacgaaactgtaagccggaccgggtgtgaggaggggaggtgataaaaggattatagggtggaggagtggaggctgaggaagaattgggacctagctcagcctggccaggaggggagaggtagaaaaggaagattagaaagactcagcgaagcttggggttgggactgaggggacaggtgggagggaaagaaggaagatttgggatgagttacattgggaacagagactagagatgcactgacatgtaaaagagtgcctggacatcaggcacctcagaccatttgcccattttacgacaataattatttagatcttgcaggatggaaaaattgaaagtgccattttctggctatttggaactactgtcgagtttgtattggggtcaagtggcattgcagaagaaaataagacgcttagattttaggtcaggtgagaggtgaagaggttttaagttcttaataacacaggctaaaggagaagaaggaggaatggagggtggatggttgcccatagtgaaggaggctagcccagagaaaagagtagagacacggagaagggttgggggttcttgccctccagaaaagcagagaaggggttggggcacagagatacgaggtcagggcacggaaataagggatcggggtgcagagatataagaggttggggcacggaaataagggatcggggcacagagatataagaggctggggcacggaaataagggatcggggcacagagatataagaggctggggcatggaaataaggggtcggggcacagagatataagaggctggggcacggaaataagggatcagggcgcagagatataagaggtccgggtgcggaaataagggatcgaggcgcagagatatgaggttggagtatttgcccctcctctagaaaagcaggacttgccgctcagggtgaaggagaaggggttgggggtttcttgccccccagaaaggcggagaagacacggagagaaggggttggggtacttgccctttccccagaaaagtgggacttgccgctaagggtgaaggaccaaggcaggcatccctgcgtggtctgacacctctgaaacctgggtgaataatcagggacgcatccctggaatgattaaacaccaggggaaggctgccttccctagtccatgaccagcgccggagttttgggtccagggataaaacgtgtctcctttgtctctaccagaaaatgaaaggaattgaaattaaaagaagggagagattgacgtgtggcgccaagattgaaaggagaaagaggttgagggatggtgagggaggttggagaagagagtaaaaaggggctgcttaccggattttaaattggtgagatgtttactgggctggtcggtctgaggacctgaggtcgtacgtggatctttctcacgagcaaagaacaggaggacaggggattgatctcccaagggaagtcccctgatccgagtcacggcaccaaatttcatgcgcctccgtgtgaagagaccaccaaacaggctttgtgtgagcaataaaagcttttaatcacctgggtgcaggcaggctgagtccgaaaagagagtcagtgaagggagaaaggggtggggccgttttacaggatttgggtaggtaaaggaaaattacagtcaaagggagggttgttccctggcggtcagagtgggggtcacaaggtactcagtgggggagcttttgagccaggatgagccaggagaaggaatttcacaaaacaatgtcatcagttaaggcaggaacaggccattttcacttcttttgtggtggaatgtcatcagttaaggcaggaaccggccatctggatgtgtacgtgcaggtcacaggggatatgatggcttagcttgggctcagaggcctgacagtaagtgttcagtaaatgtaattagtataattattaaaatattcatgattattattcctttaaaatattctagaaatcttcatgttatctaatctggaaaagaatttttctagctccattgctaaaaaaattcttcaaattcaaatttatttctgtatctcttaatagaaatgaggaaacgtatttcctcttcctgtaatagtagtctcagaacacgtgactgtcacttgtgtgtctctgtgagtgactgtgtggaaagaacttatctgactcactcacttctctgtgccttggctttgggtatatggctgcaagtctctgctaattactcctatgccactttcagcacaaatatcacttattatgtgctgcttgaatattattttctttatttctaagtttggtccattcagtcctctcatggcatgagttgcttttcttatttccacataagtatttgaaaacttgtcagaatgctattttcattagacacttttcattattacgctgtcatcactgaacaagtttatttcaaagccttttgagaaaaatgacagaaaacatagcattttatttccttggccgttcattagattagaaatgtcaagaaagacttagattatacttatttttattaaaaggaatgagagacttttcttgaaaaaaagaaaaaaagaaatttaaattttgaatgctacgtcttagggctctatgcagtgaaacattttctcttcattgtttagaaagacttacattttattttaaaattcctgcccgtctttttctcttgaagagataagatactctaatcattctagaacaccagctattaatctgaaattaaatctattacgtgccagaaacaaattaccccaaagttaacctaaaatatcatcagggtaacaccttcagttacaaattatagtaacatcttagataataaatttcagcagctattaaaagagagatgataatagtacctttgtctgaggcttcttatgataattgactttaaatatgtagagcatctaatactgcatgtgaggctgaattctatgaaattactaatactgaagcatttttggcctacagaaggaacggtttcatgtggttcaaccgaagtgttgctcgttaattttgagtttcccattcaccactgcactgacctttagccaggacagtacttactaattataatttaaaggtcgcatggatagagagcaaggcagacttgttacgacaaacctgtgtcttgtctatcttggtatggtggtgcctcagttagcacagggctttcactctcttactatggccagcttcacagtctctgtgacccttcaacctgtcccatgacttctgcttacccgtggccatggtgtctactgatggcatcactatgctcactgccttcacccatatgattctcatatgtgtaatttactagccagtatccagcaaggcctgctgtgtatgggagctggtgccatagaaagtgtggatgaggttatgtgtaggtatctctgctggtggtgggttgatgataaccatatttgacgcccttaaatttctaaaattaggagtcattgtattcattctagattgaggaggatagcatttaaatggggcttaagtatgccttgtaagtatgtaaaaagatataaaattaccatgcatactgtctttcaataacataacaagactgtagtttagtgagctcaaggtgacaaaatagccattattttcttactgtgagagtcattttgtttattgtttgcatgagtgacaatttttccaatgaaactttcttggttaatagaccctttcttatacataaatatgaaataagagggtgatagaaatcagatattatatctagtttttatgactagcagattacacagaataaaaacatcacaatgacacaaaacataatcttacacattagacaaaggcatacaactttaaaaaatattgcaatcaaaaagatgtaattaaattaccctgattcattgaaactttagcttttaaaaggttcatttttgtgggtataaataaattttgttatcttaattttatacaagttacaattatattattgttaatgacagataccaaatttaataatgtcaccttgttttatgttttataaaatttgcttcatttttccacctaagcagatatgctgtcaaaatgtggtgttacctgaaattttaaaatgcatctcttttccttgtgtaattttataataaaatagttaagaatgaagaattataaaaaagttaagaattttattttgaagactgatattctaagttgcatatagcaaagaagttacgaacttttatagtcaaggacctcataacacatgatagatgctaattttaattaaatttattatttcaactttgaaaaatggggtaggaggagagtatgaatcagaggatgaagtaactcacaatttaggctataggggccacatttttctaacttaatattccatgattatttccaaaggttacttaaatccaatatatgactcagagcttcagacttaacgtcatacattttcacataggttttaatttgtggagaaaggacatattctgatattattatagaaaagccattggattctatggtgtgataataagagatttcaggtctgggtcttctttatcagtcagcttttgtattgcaataacctacaatctcaattctcaaaggcttagagcaagatcatttgctttttgttcatctgaggactgccgggtgagtttgggttggctgggctcagtttcactgggcttttgattccaggagcccagagtgaagcagcagccactatcctgcagttttcaacgcagaggacataccaggggagacagaggctgagccaaatcaaataatcacattgaaaccttttgcttaatcataccaatgtcatggctgctcatattcattagccaaagcagccacatgacttggcagaagttcatagggttctgatgcttattcctcccatagaatgaacaggaattctcatataactataattgactatatcaaatcccattgctggaagtgggtgaatagctgggaatagtaatccactgtattacatatgccaccaaatgattcagcaactttccagtttcctactggacagagagaggcctgtctctctggaaagtcgctcctcctttatatgaccgccctgacagaccttgcacttgcaacttgactccctgctgaaaaccacttctactctgttttcggaaatacctgtagtgtcagtagacaaagtagaacaaaatgagaaaatagagagaggatgggatctgaaaactagtataagtcagggcaggaaaaaaggaagagtctgaaagcaagcttggagagctgactcttagaccagaatagaaaacattttcttcaaaatattcgccccttttcaaatgcagaattaggccagttatgttttaggatacccattgccttatattcttaaaaagaaaagaaaaagaaggaaaagaaagagataacacttaatagtccataacaaagtgtcaacgggatagacacatgcttattcaaaccacagatatgatccagttaatttccttcttaaaatgtgcccatagtgtcttattgcctcatcgtaatgataataatgagagcaacaattataatggcaaaagcaaggactcctgccatttactgtttgtgtattaaatgctccactctacactaaaagctttatgtacagtcttattcctcaaaataaatatgagaaaaacaactttaccaaactcacatagttaataaaagtatttttatgagccaccacaatactcaaaaatggtgcaatactgtgttttcatgaatttcacccaatctagctttcctgactcatctcttgccttcccctctgtgattgctaagtacagacacacagaagtgctgccatttcctcactatactctactatttcacgcctctgtgagtctgtatccatgaatttctccacttggaatggcttttctagccacactactcctttgccaacctaacaaattctgtttctcttctaatgactcttctagacgcagtcctctgccacctgctctaggaaggtatgccataggtagataagttgtctcctgcatttgcttgcagtctccacacactgcagcgatcacatacacctgcacataaaatgtctttgctatacatgcccattcctgggcccacacaagtcttccacccttcctcaggtgtgaataccttaagggtcttctttattcctattttattttatattccagtgtatgttctaacaagtaatcaagtgacttgaatggaaatctcaatagccaaactgagttgttgctgtacatttttaatatttaacagagagatggatctattggaggcagtcatctgagatgatcagatataatggccaatagcaactatgctaatcataaaatttaaaatgtaaaaaattgcttcgtcaaactgttttaaaagatgtatctaaaacatagtaggctgagcatggtgactcatgcctttaatcctagcacattgggaggccaaggtagcaggattgcttgaacctaggagtttgagatgagcctgagaaacatagtgcaaccctgtcactacaaaaaaaaaaaattaaaaattagctccatgtggtggcatgcacctgtagtcccagctatttgggaggctgacatgggaggatttcttgagcccaggaagtcgaggctgcagtgagctgtgatcatgccactgaactccagcctgggtgacagaacaagacactgactcataacaaaacagaacaaaacaaaaagcaaagtcaagatttggatgttcagtgtattcattgctacttgcacacacacacacacacacacacacacacacacaagcaaacacacacaatatagttttatcagaatacacatattctgatagcagaattgaaagcttacataactgtgcaagctttggattctgctattctctggtttactcatccccagttttccaatccatcaataaggatagcctcaattatctaataagcatttcatgtgtatttcaataaaataatgcattttaatgaaaaattcttagaatagttcttggcacatgccatatttaaatgtcgccactgcctcattcatacagatcgtacccaagtaaaagtgtatatatggagaataaaaatgaaaacaggaagtaagacagtaaatggaggaagtcatttagatttgatagcatggtttccaaaggcagtgtcctattagaagtgttcaggtaaataaaacgttattggcagagacagatggtaaagccattttagaaataaaaattaaccaggtaagcacatgccaattttgggaaaacaatttattgtacctttttttctggagcttatttcaatgtaaaagtactttaaaaacttagaaaatagggtacatattaggtaaaagagagtcttgcaaaaatggatccagcaaatattagtgaagagaaaaagatgatcagaactctgagtttcagtgatttgtcttgtaccatattcaagctgtaatcactgaaggtaggaaacaaaccagcaaaacatttgtaaggtgatggtatcatttaaaaaaaatagagaaacattacagacaacttaaattggaaacaaattggaaacaatttttaaagttatataaacaccacatttcaaaaggattgcatgatatcagaatgggaatttctagtagaaagttgaaaaaaaaaatgagactcaagggagactgttagtgtggtggtaagattgggtagaataattcagatctcaaccatgggaataacctgttgaataatcatgtgaatactaacaggtcacaataatcccgtgaatgaacatgttgaatttcggcatagagagacagcattgttattgccaaaagagctgagtagaaaggaattttgtgatgagtgatttcaagctacatttctctgagtatcaatgtgcccatctggaaaatgcaacaataaacagccctcacataattgtgaatattaaaagattatttgaagtgtctaccactttgctgatagggattcaacaaaattaaatttttcataccgaagagtagaattttccgtcagtacctcatggggcatcaacaatgatgataagcagtagaggctgacttgatattagataacattaggtgaccagtgagccaagacattcacttctttggctttccttcagtaaagtaagttacctaaaatctgaattagagtaagcagatgttgacagggataaatgaataggaaaagcatgcagagagttaagaaagaaggcatctaggatatttgtcaagaaggattaaaggcaggttttatgtatgcaaacctggatggtgaaaatggatagtttactgtgctgacttcgttcagaggtggtataattagacagagagacaaagccgcaaatgtgacttaacttgggcacagactatgagatagttggcatttgtagctggaaagtgtaagggccggttccagaggtttgcactgtagcagtccattgtgatgacaagatcctggaattcatcatgagacagagtgaattatgtggagaaggaaagtgaaaacaagaaggatgaacccagtctggtggaatttatgtcttcctcccttctaaattttgactgtgaataaatcttgttgcaaaagaaaaggtcattattaatagcatcagtcatggatgaaaacaaattagaaaacttgtttgttttattgaacatgattcagcagcagaggtgatttgaaatatcctatagggaaggaattcatgcatgcataaagtgtgttggggcaaaccctactggaagcttctttgggtcataggtcttcctggccttttcatttgtgcagcctcttggcaggtcatcactactttctaattctaagtcctgaaaattgcctatgaggtaagtttctatttcattaaatgttctattaagacaagttttctattgtcagttttgttatgaccaaattcataaatggaacatataataaaatgttaggaaatttggacattttatttcatgattattgatttctaaatttatgtaaggtccattctgtgaaattcctagagaaatttaaagagttttctttagaatattttatttgcagttattgatacatgtaacaaaaatatgggtagtatttttgctttctatgacaaaatatttatagttaagatattaaaaatataacgaatattaattatacaaaaataatacattttagaatgataattcaaatacagaacccatcaaaatcaataactatatgttagtatcaataaaatgccaattaaaaatataagaaaatatgagaaaatactaagaaaatataagaaaataatttaagaaaacctcttaagagatagcttaagaaactttcttttacccataaaatcccatgccttaccacaacacggcaatgcagatatttccttcaattactggtgggaaaaaaaaacatgagatttgaaatatcaaataaaatgtgtaaaatcaaaaaaataaacagtaagctaaaacttggaggtttttattttttccctactacatctctaaggcgttgtgagattcatttaagctagaacaagtagaatgtgttctagaaatggcatccataggatagtttaataaccggaaaacaattatccacaatgtttcaaagcatacatttggtttgtttgtttttagcattttaatttgtaggttcattcaagttaccacatccaccaattaattgcaaaagacctagccacaggcaatagttgactacttttgctttcctttatttgaacaactgttattatgcagatttcttgttagaattattctgctgtaagagagtgaagtctacctaatttcatgaatataaagggggagatgaattatgagaaatatacaggagtactccatgaaacccagcaacaaaaagtacaactggaaattacaaccagagccagaagcaagagtggtataggaagaaagatggctacttcttacatctctgcctctttttcttatctttctatatatctgctctgtttccctttctgtgtcagtaaggcaataccttctgctgtttacaaggccccaaaatgactgttttacttatacctaggtgtacttgactttccattttcaaaaactatcacgtacttccagatgtaaaaggattatgtctcttggattaaattctagaggaataaaatgggattggcccaggtgttctaatggacagtatttctttctgtgagaatgaagggaagagacagcagaatatgaacatggaagccctggcccaatactttagcctaagccagtggttttcaaacttgagtccccatcagaatcactgggaggctgtgttaagacacagattgccagcaagttttcaggtgataataaggtcactggaccagagaacatactttgaaaatcactagttatgctgtgggattgtaacagttctcaacaagaggaaatggacaaatattccaacgatgtgctatctgtacctttttgtgcaattgagccgctttgattatccagcaatttttttttttttggagacgtggtcttgctctgtcacccagactggagtgcagtggtgtgatctcggcctcagctcactgcagcctccacctcctgggttcaagcgattctcctgtctcagcttcccaagtagctgggattataggtgtgcaccaccattgcctgactaatttttgtattttcagtagagacagggtttcactatgttggccatgctgatctcgaactcctgacctcaagtgatccacctgcctcgcccttccagagtgctgagattacaggcgtgggccaccatacctggtctatccagctatttgtcttcattcatttattaaagaattattgagaagttactatataagaaaatagacatttatattcctatatatacaaaaattaattccttaataaatatagttcatgtatgtgcctggatactaagcctcacagcacatattattatacattttttaatatgtaataccattttactattttattatctaagtacagaacaatcaaattttcagaaaatgcaatcatttatattttatgctttatttattttcccaaatatttatgcataccatatgtgttatattgtaaataaaaacaaaacaagtgaaatagcttgttgatgttggaggttctcttatttacaataatttttcttcatgaagaaagatgtgtacccatatagtgatggatcaaatataaagtttacttgttaccatatattaagggtcaaaatatcctgagaggaataaactctctaaactgtttcttctgaaacctggttccacagtaacatagtctcctgatttacgaatataaagccaatcaatcctcagagatgagccattcttttcgtcactgctactctcttttgaagtgacattttcctagctgcataatctgagataatgtttggttgtataaaatatgctactattatcacatgtatgtgctgaaaaattacaaataagccatgtttcttaattatgttatcatactgagtgatatggtttggctctgtgtccctacccaagtctcatgtcaagttgtaatcgcgaagtgttgagggagagacctggtgggaggttattggatcttggaggtggtttcccccatgctgctctcatgatagtgagggagttctcatgaaatctgatggtttaaaagtggaagtttcccctgcacgctgtctctctcctgccaccttgtaagaatgtgcttgcttatccttcaccttttactgtgattgtaagtttcctgaggcctccccaatcatgcataactgtgagtcaattagacctctttcctttataaatttaccactctcaggtagtatctttatagcagtgtgagaattgattaatacagagaattggtaccgagagtggggtactgctttaaagataacctgaaaatgtggaagtaactttggaactgggtaacaggcagagattggaacagtttggagggctctgaagaaggcaggaagatgtggggaaggtcagaatttcctagaggtatgttgaatggtgttgaccaaaatgctatagtgatatggacaattaagtccaggccttggtagtcacagatgcagatgaggaacttcgtgagaactggagtaaaggtcacttatgctgtgctttagcaaaaagcctggcagcattttgcccctgccctagagctctgtggaacttcaaacttaggagagatgatttagggtatctggtggaagaaatttctaagcaacaaagcattgaagacgtgacctggctgagtctgaaagcattcagtcatatgcattcacaaagagattacctaaaactgatacttatattttaaaggaaagcagagcataaaagtttggaaaatttgcagcgtgaccatgtagaaaagaaaaacctattttcttgggagaaattcaagccagctgctgaaatttatgttaagtaatgaggagctgaatgttaatagccaagagaatgaggaaaatgtctccaggccacatcagagatcttgacagcagcccctcccatcacagacctgtagtcctaggagggaaaaatagtttcctgggccaagcccagggcgatgctgttctgtgtaacctcgggacttggtgccctgtgtcccagccactctagcttttgctgtggctaaaaggaggccaaggagcagcttgagccattgcttcagagggtgcaagccccaagccttggcagcttccacatgtgttgggcctgagggtgcatagaagacaagagttgagttttaggagcctccacctagatttcagaggacataaggaaacatctggatgtccaggcagaaatttacttcatgggcagagccctcatggagaacctcaattagggcaatgcagaggggaaatgtggggttggagcctgaacacagagtccccacctggggcactgcctagtggagctgtgagaaaaaggccactgtcctccagaccctgaaacagtagatccacagacagcttggattttgtgcttggaaaagttgcaggcactcaatgccagcccatgaaagtagccatgggggctgtatcctgcagagccacagaggtagagctgttcaaggccttgggagcctcccctccttgcatcagcatgctctggatgtgagacatggagtcaaaagagattattttgaagctataagatttaatggccagcctgctggaattggacttgaatggggcctgtagcccctttgttttcatctatttctccgttttggaatgagagcatttgtcccgtgcctgcacccccactctatcttggaattagctaacttgttttttattttaaaggcttatagaaggaagggacttaccttgtctaagatgagactttggactttaacttttgggttaatcctggaattagttaatactttaggggactgttgagaaggcatgactggtttcgaagtgtgaaaaggacatgacatttggaaggtggcagaggtggaataatatggttgggctctgtgttcccacccaaatctcatctcaaattgtaatccccacgttttgagggagagacttggtgagaggtgattggttcatggcagtggtttctcccaggctgttcttgagatagtgaaggagttctcacaggatataattgtttaaaagggctagtttcctctgcacactctttctcctgccaccatgtcagacgtgccttgcttcccctttgccttctgccatgattgtaagtttcctgaggcctccccagccacatggaactgtgagtcaattaaacctcttttgtttgtaaattacccagtgtcaggtagtatctttatagcagtgtgagaatggaataatacacttagttactgagattaatattcaaaaaattaataacattttattgataagaatcacaatgttatgtgaaaagttcccacaatttttctatgtgtaactcaattagaactagccccttctgcttgcctgctctcatttaagtcatctctcaactcccaactatatcccaaatacacatgcaattataataaataatatagaatttatagttttatgaagagataaaaatgagagggagggcacaccaaaaaatcacacaattatgcttcttaaatttccctattacctatatgcagtaattattaaaatttcctttcccaaactagctactacatcactctactcaaatcttctaaaaatttctagggtatcggtttctttttctcctcaacagaaagtctcaaaattctgataactcatatattgtagtctgcaaaggttgtagctgaacagttttagaaattcagtctttagctcagaactattctgctgagggagactaaatttattttcttccaaataaaataaatattatgtctctatttgaaaatgtatcctgtaatacctagacatgttttttcatagaaggttttgaatattttatgtttgaaaggcattgaaaccaatgattctatggataggaagaaatgaaattaaactgactaatgaacaagcacctctgaaaaatttcaagaataatttttaaatattcgactgcattgattgttagaaacatgctcagtgtgtgtgttgctgtttcttttattgttctgcttggaaagcgtgaaggacccagaagggtgataattttccacactggtcctctcctgtccctgccactcagccatttcatttcaacccctttagcacatgaccttagccactaacttctttttcaccagtcatgataaactcaaactagtggatctaattagctattagcacagctaataatcgtgagaacaaactttgtctcttccatgcattttaaaccataattcctaaaatgatcagaacttcagctgacccccttggtaaccatcactaaaatccttgcccccctcaattgcacgttagacaactcctttggtctttacttatctgacattttttcaaaatggcctatagtatcagtgctctggataatttccttcccctagatggttccaggaaatccagttgagcaaagtcatacttttgtatgccttttaagatacagaaagaaatatttcttctcttccaatgcatataacatttttccaatatgtacaaatcaaaatttctattggtaataaaaaacaagcaaccaactaccaagcaagaaaatattacatcagcaattgtttttatgataaattttgccaaataacaaatagatttcttgatggcagctactactgaaaaagcttcatatttaatcaaagtttagtaacagtgtgaaaatgaggggaagttggggttaaggatgatgtcattgttttagtcgctgtgataaaaaataatagacatctaattttggcattgtttaaaaaatatgattttacatttagaaatacttagttttaggtaggaacaaggcatgtgcttacaaatatgcagaaagtaattgggaatatatataagaatcaccttaactatctgatccttaaaaccttaataacaattgtgccaggcaaggtgtgagagccctggcatcacaaagtggtgggcttgtgggtagtggggtagtaagaagaacttaccaacaacattatagttttgaaagggaaagttttggccaggcgtggtggctcatgcatgtaatcccagcactttgggaggatgaggcggacaaatcatgaggtcaggagttcaaggccagcctggccaatatggtgaaaccctgtctctaccaaagatacaaaaaaattagccgggcttggtgacgtgcgcctgtgatcccagctaattgagaggctgaggcaagagaatcccttgaaggaaaggagggagggagtgagcgagggagggagggaggaaggaaggaaggaaggaaggacggaaggaaggaaataaaaagcctcatgtttaaaatgattcttcgctctcttctgacttgtaaatctccctttctcccttactcttaagcgtagttccatttcattgtcttctcttcttcaattctaacctctctggagaaatatgaaagaaaatcgtagaaaaatataatcttgggtttttttatcagagtaattcagctttttctaacctcatgggcagattaggccttacattttcaagtaaaactttgaaatgataatttgtaaaggcctgtccgattaactatttagataaaaatttacctcttgtagcttcctagaggttgtagacagagcagggtatggttggcttcatttttctcacttacaagtagagaacggaaaatctggaatgagatcagggataccatatgggattggaaatcacctgtgaaataatatttgtaaagccaattaaagagagtcaaagacagacctctaagtgcaagtataaagggaaaatagaaacatctcaatgttcacccatttaagggacagggaaatacattaaatccagataaattacctgagaggtaatcataatagttgtgtgagttagtgcaattatcttaatttacttatagagaaagtgagatacagaaatgaacggagctaaatgaagaagtcattatcaaatgtctttgacttaaagactgtgtcctttttaggacagtaggacctccctaatgaatttattctccttcgcagggtcagaattgagaataagtaagttagaaagtgatttcactttggtagattccaatgctgtcagtcaacaagagaagaataaaaacattgccctgtagaaaagcaatctatccaggccaggaggggtggctcatgcctgtaatcccagcactttgggaggccgaggtgggcagatcacctgaggtcaggagtttgaaaccagtctggccaacgtgatgaaaccccatctctactaaaaaatacaaaaactaaaaattagctgggcgtggtggcgggcgcctgtaatcccagctcctcagaggctgagacaggagagtcgcttgaaccaaggaggcagaggttgcagtgagccgagatcatgccactgcactccagcctgggcaatacagtgagactccatctgaaaaataaaaaaaaaagaaagaaagaaagaaagaaaagaaaagtaatctatccagtaaattgagtaacttaatatgtttttattattctttccattagtctaataaatagttggcaagaatgatggtgggagcaatccaaacgttgacaatgaaaacagagacatgaggaaacagaaatagcacgtggggttatctgatggtagggaagaaagcctgaaataatagggtaaagtgcaagtgaagcgaggaagcgagaaaaaacgaagcagaaggagttgaaatgccagaggtgtcagttactaacaacacatttaatgtgagagaggcagatcgttgtggaagctagaggtgatagccattcaaagcagatagggggatcgcagcctatgatgctccaaatgctactgccaaatgacagccactggaaatgccactctggtcattgtatcataagatgttaaaggtttgccattcattagtttcaaaggaatctgaatgagtaaccacattcattatagagacaaacaacagattatgaatgtgtactttaatactttaggggctgaaaggagaaaaaaacaaagacaataaaattctaatggctgtatttaaaagtgaacattgtgtgagtctaagaaagctaacagttcacagttcagtttgtcttaaaaaatatgtgtgtctgtgtataacgctcgtattacatatatctcatattaccatgttatataactatcatacataataccattatgacataataccattatgtatgtatgtactatagattattaccattatgtatggttatttacattatacattatatgccatttaataacatttaaagtgttataaagatgcaattttaaattacaagtggatttgtgacaagataattgaatccacaatttatgtcaacagagttggaaattgttgaggcatgtttctaaacttttaaaataggtcttcatttgagtagattttctttttttttctttctttcttttttttttttttccttgagacagggtttcactcccgtcatccagactggagtgcagtggtgtgatctcagctcgctacaacttctgcctcctgggctcaagtgattctcatgcctcagcctcctgagtagctgggattacaggcatgcaccacagtgcccagctaatttttgtatttttttatagagacggggttttgccatgttggccaggctgatctcaaactcttgagcttaagtgattcacctaccttggcctcccaaaatgctatgattataggcatgagccactgcgcctgtgctgagtatattttcaaatgtagaatactgaattcagtgcaatttgatcatattttgaaaatttctgcattattatgttgttgtattggaacatttgggttttcgtagttgttttgttttgtgtccctaaggggagatgaaccttctttgtttgcttgaagaatacataacatatgggtcttggtggttgagaagaccatggaagcctaaaagaacaaatttgccctctcccagcctcgcttgcaattagctattaaagttctatgggtgatacacatattatcaaagtttactgttagggaaagccagagcataagccataatcacatgacttcagctgagccaattgtaagcaccagactgagaacaaataatgcaaggagagaagattagcaaaggctccctttgggacctggcagttcacagtgatacttagagacaaaggcaatgtaagctgaagcagctagtactgagaaaaagtagcattattgtcttcactagacagtgaagtgtggagtggtttttgactttgatcctgagtgtctagccttccattgttgcttctggttttctgagccagtgtttgaaagcatcccacagttctatatgctaacacaattaactcttaaaaaattctgtttttctttaaatcccccagagttagcttctgttgccttcaactaaaaaccttgacaagtacagtagataaggcatggtttgggatcacaacttgattttttttattttgggaatacaaatttaacttgtggagagactgatgttctctatctcaccaaaaattgtttttgttataagctgtattcataagtgagctgtaatgttaaagagaaaaaagaaaaggattttaaattgctttctgcagcagaatgggaggcagtaaaaaggacaaactgctaaacagagaaaacaagacaatagaaaggaaagactgttctaaggaggagctgacagggctgctatgaaagaaatgtagagtctggctttaaattgcacatgtgacaagaaagatgtgatggaaaaaaaaatgtttgtttactcacactccgtccacatcctcactgcaacacacccacagcacactcttctaaggaaggttcacattgctgaattttttttttttttttttttagttgggtgtatagctgccttcaataaaatatttagtcacatacttgaacacagtgtgaagtcataggtatttgtgtatcacgacaacagcagataggtatttcaatatcaaaacaaaattggagaaacctgtgtagttgtaaaaaacactgcataaaataaagggagattgaggatgggtggtagagaggaggcaaatatcaggaaagaagggaagatgtccatgtctgatacggattttctcagctgtaaatgctgaggactgtttagtaaccctctttttatgtgctcatcaaatggacattaaaatatctatttgtcatagtggtttgtgagatatattcatatagcaattaatactgtgaagcgctgaaacttgctctaagttatacaaagagtggagacagagatagccaattggaagccggttacatctaggccatgtgttatttctgtatttacgtagtcttctctgtgtaattagaactgctataggtgctaattgaaggagaactttagatcctagatattataaaaaataaatagaaaataccattgctatggactgaatgtttgtgtccccaacatttatatcttgaaatttaaaccccaaggtgatgataataggaggtggagctattgggaggtgattagttcatggagttagtgcccttgttaaagaagccccagggaactgcgttggccttttcaccacgtgaggacacagggtgaaagcgccagctaatgatgaatcagaaagacttcatcagacactgaatctgtggatgccttgaacttggactttccagtctccagaactgtgagatgcacattcccgtggtttgcaaggcactgagtctacagtattttgttatagtagcactaatggactaagattactatgggggcataaatcctctaaaccagattttctatagatataaaaattaaaaagagctatgatacaaagagtccccatttgctctatatcccatgatttattcatttgatcaataaacatatgtgcagggatctaggtataacaacatgagaaagcaacaatcctcgtggaaatggtggaagcaagagaaattagaatttataaatgtgtagtggtcatacatggacttcataataatctagtgaaaaacaccacatgatttgttcttaatcatgttaatattataacttcttcagagctctcgctaaacacagcagcaagaaaatcagcctcaatcaactttgggagaacttttaactttgcctagtgtcagtcgaatgaatatccaggaagctcatgttatactcagaaaacaggaaagctctgaccattagtctgtggtgtttatcgtagttacctttgctctttctactataaggtggtgctgaatcttgtcctctgccctctattgaaaccctgaccctccacgcagaaatctttagaaccacagtttaatggctatcttttatggtcatcctatagtcagttaactaaccaattggaggtgccacaagtggaccaaataaatcttcatgttgcaaaggaattaaaaaacaaaacagtacctggacccagccctaagtaggagaggcatgactccatctcccctctggctgaataaccatccatcttataactccctgcctttcagagttcttttgtttacttctatctggatctgcttttccatctccaccaccaaaacagctcctgagtagagtggtctgtttttcaaacttgcaacctaaagacacccaaatgaaaagaggaaaatgaaagaataattcatttagttttttcttggaatagaattaagggaaaaatagctcacattctttcaagagggaacaaaaggtaaattaatattttaccatgttatccagtagcatatccattatttacgtggtcttattttattgattggtcaaaagattcacaagaagaagatagttcaacatacacctgtgttttgagggtgaaactcagctgaaatacactggaaacaatagctgtgaaagtctacaaggcaatgggagtgaaaagcataatttaaaaccatcatctttacctaatgatcaaagcctttggcctctaacagagattcttcatagcagttcacaaaagagtgccatactggggacataagagggtgggccaggtggggtggctcacgcctgtaatcccagaactttgggaggctgaggtgggcaggtcacgaggtcaggagatcgagacaatcctggccaacatggtcaaaccccgtctctactaaaatacaaaaaattggccaggcacggtggcacgcgcctgtggtcccaggcacttgggaggctgaggcaggggaatcgcttgaacctgggaggtggaggttgcagtgagctgagatggcgccactgcattccagcctggtgacagagcgagactccatctcaaatcaatcaatcaatcaatcaatcaatcaattagggtgtaatgggagagttaggaagggatcctatcctacagatggggtaaaggaaatgttatgtaaggtggcattggtaccacctattgattatgctaactgatgcattccaagttaccaaattagatctcttataaacttgaaattttatgattaagtattgctagttttggtttggaaaaatgatccaaaatttatgttgcataacttatagttaaaggaaaatgtagtacaatgatactgtattttactgttgaagtctttgtgttgggattaagtattaagaagaaaattactgttcaacataacaaccgaaagggtaaacatatttaaataattacttaaacaaatgtaaacattattaattccaactaactctgtatacactttccagcggttgcactgccttgttcagatagctgttgcttcatgtgtggcatggccaattggcttcatattatgaaggatgagaggcaacctgaactggccaaccatgacagcagacctttcttagggaagtcaagtccatcattgcctttttcactcttcagtttcaaatattgtaagatcttttatatgctgctgtctttgttaaacatgggaggctcaaacatgtcatcactcaggacttcatacctgattcctctttcagtgtttatggctactgtcttaccccaggctttcattttactcttattgggaccatttcaagggtcttctaactggactttctcccattactcactccatcctccacattttcacgatggttatttttaaattaggagtctaatcatgttgttcgtctgccccactgcctacagcgtaaactatagtttatgtatagaattttgtatagaattcttttgtatagaattcaagaccctccatattcaaccattaatgattcttgtccgtaagcacttagcacagtgctcaacgtatggcagacactgagtagataaatgtgtgctaggtaaaatgaattaagggcaattgagtggcccttccaccagatgatgtcctggtgtctagaaatagatgaattttgattgtttttggcaattatcttaaagatttcatatccagaaacttcaatttcataatttttctgattagcccattccattttattcagttgctttgatgataatcaataatagtaatattgttgacttcatacagaagaaaagaagataacttttaaacaattttaatatttccaaaagatgttttatgatcattttttacataaatattatattctttgaatagattatctgaaatagaattccaggaccaaagattatctaccactttaagccttagattgtaaaatggtctcttaaaaaagcacatcagctcagacccagatttataatgttctgactaaattataacattttatttaattgtcgataaaaagcacactgtttcacacataacacaaatttaactttttaaatttaaataccttaaagggtcaattattgcaaaagacagattgagacattcaacaaacatttcttgaatacctaatatgtacaagaccccatcccagaaaactatatagagttatagaaattaaattaagtgaaaaaatgagtatgtaaacatcaaaataaaaaagttagtttggagtcaaatgtaagcatttgttcttaaaaatattatggtttcctccaggattattctttagtagtacttgccaattttttctcagaatgtgttgtcctatggtttgctttttttaatttcacaaatgtcagaggtacaaaagagtcttacaccttttcttgcaggatttctaaaaatcgtatttagtcatcaagaccaaatttatcatcaaaccttaacccctgaaaccaagaaatttatgtatacattttatttatattttcatttatatttacatctcagcagtggcaaatgatacttatatggttttatgtattttgtacagaatcaccataggattattgttttgatgtatctaatattagactgtctagttagcaagataattggaagaattttacaaatttctgtaatattttaattcttatctaattgaattaactccttagcttcaaagtccctaataaaaagtataaaataatcaaaagtatttttaaaaagcttttaatttttaaagtaaataatatacggtttattcactcatacattaagaacttgtgaaaacagaaacatacttcataatgttaagttaaaattgttctattttagttttcaaatatttttaattttcttcaaggagaaatgttaaatgaaattataaccattagtttttataattttgaaaaattttctctattactctgatactttagagagccacaattttcacaaatctttgacattttaagttgtttcttgatattttcttaaattaaaaaccatgtttattcagatttatgcacatctttatttcagataaactattgctacaacttggttaaaacaaaaataaatattttacaatttttaaaatgctggcttatattaaagttggtttacattagaaaaaggctcaaagaacttgtattggaattcttctaccaataaattccatcttctaccaataaattcatgaaaacatttaaaactttataagtaatcaaataaaactaaaataatctaacactgtgtattagtccatttttacactgctaataaggccatacccaagactgggtaatttacaaaggaaagagttttaattgactcacagttcagaatggctggggaggcctcaggatcctcacaatcattgtggaaggggaagcaaacacgtccttcttcacatggcagcagcaaagagaaatgctgagcaaaagggggaaaatctccctataaaactatcagagctgagaactcagtcactatcatgagaacaggagcatggaggtaatcactctaatgattctattactttccaccctgtctctccaatggcacgtggggattatgggaactacaactcaagatgagatctgggtggagacacagagctaacccatattacattgcaacactgttattctcctttctccaattggctacattttaataaatgataatatgccactttcagcaatgaccttggagtgaagtactctggctccccgctggtagaagtccaagcacggctttttgaaaaggttaagatgtgacctatcctttaactcggcaattccactattgtgaattaatcataaagaagtaatgagcatttacaaaaatgtgtatgtgtttgtatatcagtgtgtgtgtgtgtatgtgcacacacacatccacatacaaatatgtgccctcatgtgtgtgtgtggacaagaagtcagaggcaatagattgaggagtaaatggtgacaaaggcattgattgtaaacaagtcttcctaggaaattacttatgaaagatagaagaacaaagtagctggagcaagaggtaagacctgaggaatctttttatgttagggaagatttgaacctgcgtaaacattaatgagaaagaacaaataggctaaaatagatgagaccaaaggagaagtgaaggaggagttcaccaagaagcgagaggtatagaattggcagcacaggtggaggaagcacctattacattgggctgggagggagtgaggtacagattggcacatgtgtgggatggtgagggtggaagggtgagagaaagagaaagagagagagagagagagagagagagatcagaaaggagacatggggagatatggaaaatttaaccagaggcaaagccacaaatttctgctttgggaaatgtatttttagtattaaatgcgtcacgtgcaaaaaaaaaaaacaacaaaaatcagaactcattccatctgtattataaggactgatattttcctaagactgcctaataataataaaaaagattattcacaactataactaggccaagtgtaatataaaaatgtaagataatttcttatgattttgaacaggagttgatgatctttatctgtgaagtgccagctagtaagtatttcggctctgtaagccacacaatatatgtctcaaatactcaatcctgtgattgtggctgtaacacaaaatcagccatggattatacctaaagaaatgggggtgggtgtgtttcaataaaattttatttacaaaaatagatgacgggccagatgtgctaacttctggtctgaaataaaatcagtgaagaacttgacactggtaagctaaatttttgttctctcagggtattttaagctcatgcctgattatcattatatatttctgtggatcaaagagattttcttctatttatagcagaacaagggaaagaacacctattctgcggtctgtggtcctagattttaaggacgacccttttacttgtactggccggttacttaaaacctctgagccctagtttccttcttcgtaaaacaaggcgatgaccctgtatttaatcctcacagatcagaatgagaataaaatgtaaatactataaaaatggtatattattcatacataaggaaatggtcatttgcaaccaaatcagaaaatgttagttcgatctccttatgtgtaagaccttgacattatatatacatatatatgtgtatatatacacatacatatgtaatagttgtaactattaagtgaaataataatatatgcaaagtgcttggctgcagtgcctaatataccttatatgctcagtaaatgccagataatgttcttaatttctaaaggcccattaaaattctccagtgcttgtgacacatagcgcctgaaggggcaaaatcaagttattccaagtcaagcacaatgctggcaatgccagccatgggcagggcagtcacagcaacataccttttaagtaagcctcccagggctgctttgcaaatggcgtaagaaatgggtattgacaattgtcatggagcccagtgactcggaagctgagttttgcgttctgagttgaatatcaggagagagttttcattcttctatgatttggaagttacagccccagactaaaaggaaggcatctgtttgattctatagtaacacaaacataaagagaccagatgagacggcatagctaccccggggcagttttaaaataaactgcaaatgtactcatcagccctttggaggaacatttgcccctatttgttcagtatgtgcagtttgttcaccagaccagggaatgcttagttattatgtgattccaccccattaaagttcttcaagccacccaggagaggcagggtaagcagcaatcggttttccatggatgaagaaggattcaatgagggagaaatgggcagtgcaggagcaattctaactcatttctgagtaaatatatagaaaactttgtgtcaggtgtgattcaacagaaggaaaagcattctctataacagttaacctacatttcgagcaaagagtgggcttttgttccttgtcttttaaacatttttatttttagtttttatctcagtgaaatcagtgggaatctacactgatgccaggttatgcggtgttattcaaacatgaaccttcacctgggacacctgttatctgcaacagagatgatttggcttttggcacttaataagctatttgccctctatagttttaaatcccaggctttcatatagacttgtttttgacatggtgcatttttagatcctgaatatgaagataatacgcactatgcatttggttcaaacatcggatacaagtgtccattgaaagtcaattctccctctcattttctgtatcaaatagataagatttttcacatggatcttttgtcatgttcatattcatcatctcaaaaattcatgacacttattgtttataatatttatttgtaatcattcaattgtagaactttttaaaaatgttaaaaaatagtaacttaacaagactatagtgaccatgaatagaggaaggattcaaacccagatcttctgactccgaataagtttttaaaatagtatttcttattcagaatgatcaactttaacataaataaaaacacttaaaatagaagggtattgatataaagaatgatatgatataaagaacacagaaaatatattgtataagaagtttgcttcagtctgtatttctgtaaatgattatttccaaagctgaagatcaaagtaaacccacatgtgtgtggggtgtgttcacaaattatattaaacttgtgtctcccttctggcaaattggctatagataagaaatgtaaatcacataagatgctacacgttggtttacatgagcctctatatcttcctaagcacacatatccactggcaaccacaagaatgcgatgtaggcacaatactagtcgatttaatgtgattctatgattctcgtttatagaactggaggtttcgcatttcccattcctacctaattcaataactcagattgcttgatttacttttagagcaatgattccctcctgggagcaattttgcttcctagcaaaatttggcaatgcctggagacatttttgtttgtcacaagagggggttgtgtgctactggcatcttgtgggtcaaggccgtggatactaccaaatatcctataatgtacaagacagtcacccacaactaagaaatatcctgcaaaatgtcagtggcaccagaggagatgaatgcaaacatgctaaccacattcctagagactagtacgtgaaccagaatgccatttattaatttgcaatgatagctagaactgtcaaggggaccaagacaatcatatttactgatgaatatatttactccctctggaaaacctatacaaaaagccaaattagaaccagacatttatttgctaaacataaagtcaattctaagaagatagatactcctcatagaacttatcacaatgaaaactgatcatttgtgtgattatatatgtattcctcctctttaagtctaaaaactctattgggatatggaacctatctcaatatgcatcatcttaaccaaggcatctaactgtactgcctgtcatgtagtaggtactaacaaatgtttattgaatccatgaatgaatgaatctttaatgtttcagtttaaaaatacatattaaacgtataacatatacaaagcacaatttgaagcactgggattacaaaatataataagataatccctacttgtgtggaagttcctgaattctgatggactagatggacacttccagttatgtcaggctgctgaagccatagcctgccctgccaacaggcaccatgaaagagctgagcctcagcagccatgttaggtatcatgtgactctgtgccttgaccacatttgaatggactgaggtgaaagagtatgaaagcaggaactggcggcatcctatcatctgagctttagcaagaagatgtggaccctgacaaatcagattcctgtgcttgggtatttaaataaaaatactaaatgactgaattagaagtgtaaagagaagttgcaaagatactgtagtggtttgaatggtggccccccaaaagacatccacccagtacctgtgaatgtgacctaatttgaaaaatgtctttgtactggtaattaagtgaaagatttaaagatgagatcatcctgaattaagtgggtggtcataaatccaatgagcgtgtctttatgcaatagacagaaaggtagaggacacacaggagaggttcatgtgaatgaaggcacagacagacagtgcacatatgtagccacaaaccaacggaggcctggagcaaccagaggctggaagaaggaaggaaggatcctcccctggagacttcagagggagtgtggtcctgccgacaccttgatttttgaacttctggctttcagaactgtcagagaatatgtttctgtttctttcaggccccacactttgttacggagccttaggaaactaatataaatacctagaaagaagaaatatataggagtaaaagtcatgaacggcagcttgcaaccactgatgttacattgaacaaggaactgaataaacaaaaagctttgcagtagggaaataacacagtctggaggaaaatactgagccagtcagtggtaaaagacacatagaattggatcatagagagcagccacgtcacttctctggttaagttctggtgtaaagatacacagattcctgctcttgataatcctgctgctttggaagaagcttttatttcctgcttatccattaagaagtcaggcatgtttggggtttatatttgtttaatcttacaggaaacttcccatcatttcctaaggctgaaacattttgtaaagaattgtaaatagaaaattgcaatataaaacagaaagtagtaaacaagtccagcatgccaatgaactaatggactccaaacaggaacacttggtctggctagaaatttcatgaaaagcttcctggatgaattcattaaattatccctggcatatcttgaaagtggagtgggtacttttcaactgactaataagagatgaaaggacaagaaagaaaaattttcaaaaaagaaaataaaaagaaaactgaaagcagagatgcataaaatcatttgggttatcatcttactatgtaacgggatcgagctatgggcacgtgagggagacacagaagcaaaagatactgaaatgttattgtcagcagattagcatgccctgcctcccacagactttttttggttctatgataagcaacctcttgagacaactgatgtgcctatagttttagatgggctaatacaattccattcctatgagattgcttcaaagttactaactcaagatatatttgagatttttccattttgccccttctgcagatagctgatgtaatttcctgcatttcttcttcccaatcttttgacaaagtaaacatttgaaattctgagtgtcttgaaatatagggaaacaaaggtctctgttctttttttctggaatttgaattaatgccttttatgtaacatcagtgtgaagatgatgaataaagaatactccatagatgagaaatcaaaggagaagaaaagtttaaaaaatatatgtgaaaataatctataaaatagtaatgttctatcagactcccactcactaaaaaaatgaaaaaagtgtggtttctatttagtccctttggttgtaagtaaatgatgtgtctagtctgtgccaaacactgtgctagcttcttagtataaaaaggtaactaaaagcacagcttcactcaaacataaattatgatttagtatgtcttgaaggtatcattttgcctgacagtataagcaaaaagcagaaaatagtgattgattaaccttattttgtagtgatgcaggaatctaataaacccaaattaaggattgaaatgaagataacaaaattgaagtaaccaatatttctggttggagcccacttttattacagcgctaaaaatagtcattgacataagaaaggatagatgaatgccatcttgttattttccagcactgagataggtttagatgagtatgtcggagataggaacattaagaagttggtagccctcgcacatatgatgaataaagatagatcattataaatggcttcaaaactcttttcttcgaaggttcttactgggcttattataaaaggaacaaagattgttagaagatatgctgtcttcactgtctcaaaaacaatactttttgaaaccttctcaagaatatagtgaaatggataaagaacctctctgagaaactcctgttgtcattggattttgaaagttgtcataaaccacctctgtacctaacctaaataatgaatgttgttgtctttgttgtgtttaaaatataagtattgctaccaagtatattacaatattatgctgtatcactaatgtaaaattgtgttttgttaaaacaaagttatgcatttttattgaaaataaatatggaataatataaatgtttagaagctggttagaagaaattattcatctttttcatagaagttcttgttacttcattaaaaaattcatttccttaaacacacacacacacacacacacacacacacacacttccacacactaatcagtttctgtgaacaggtaactttgtagtatcctatttgtatccacatttatatccatgttattagaaattctaataatcttatttaaaggtagaaatttccaagttaaaaattaatattcaagttaatgaaaaaataatttgtttagaatttccacatgaataagacataaaaataataagtataatttataaaagagggaataaaattgcaaagtacagaaaaaatataactgtagtagtcatcaaagaaatgctaatttaaacatggacacaatttttcattcagcaaaattattttgcaaccttttaaaaaataatatgcataataatttttaaaacatgcttaaggaatcaatcaataattataaatatataaataggatattagacatctaaaacaaacttaaaaaaatatataatgtagaaaaaagtactatatactaataagtgaaaggaactgtagaattataaattactatacgtatcatattatgaatatactataattatgttataaatgttaaaagtttaaactagattgaagtaactataccaacatgttcaattagcagtgtttaagttaacggtaggatttttactgtgtgtgcgtgtcgatgtgtgtgtgaatgtttgtgtggaagtcacgtctatcttttttagtaaaagcagttgcttttatcagaacaattcttgtccgaccaaatcaggaaactccaaaattcagctaaaatatgacatatgcaaaaaacaataggtgagaaaatactttccaaaaatactttatgtaagtggaagtgataattgttgtctttgcaatgatcaagaatgagccttaagtgaagtagttgatacgaacttttattttctttcctactttctttttttctatatttcttcctccctgtcaacaggtgtctgcccttttttcacgtctcaaggaattaattcctatctcactcttcttctgtcatcaatacttgccttttgatattaaggccaggtgaattgctgatcactccctgcacttggccgctcctatcttgtcttgcagccacatgaattaggtactagtaatgaaccctcattggagagtctgagcctcagtgattctgaattctgtctccacattatgtatcatttgggcagattttcataagtagggtcatcggctgcccacttcatgcatgctttcacacctccacccctagaatctgatccttacttttctggaatatggttcaggcatagacattttcaaagctcctggggttgtttggaggcccagccagctttactaactcctggcctaatcctaccaatagaatctcattctctttgctacagtgcttgctgcaagcttgggaagctctaagccattcagtgaccagccacagggactggctcaggaaccttctgagccaaagagacaccatgcaagattacctgaggaacttctcagggtgaggatgggagcagaaacttccttttcctttcctgaacatttcagaagtgaccgtcaattcctggaaaccttggccatcttgctccctctgtgaggatgagggttgacctacaagaattacagagagaaggaggcagaattctacatgggccaaggcgggtcacagctctatgtttaattttttagatcatctgaaccaaaatatatgcatttttctggtgttagttcaagtttgatttttctgttaaaacgagtacattccaatgaacacagtttttcttcacacagaggtgtaaaaaattgatatgacataatatgatcctataaccagaggtattttcattttaataaaggttgagtaacttcctactaaataataaaccttttatggtagaattttaagcatcggcaagctgatgaggtaaagagggtactttcctggcatttctgaaatcaattttaactaattgaacacttaacaaaaatatattgaaattgaaggactctgattcgtacctcagtcttagcttttcacttacctcgtgtatgacttcagttaaattacttaatttcagctgggcgcagtggctcacgcctgtaatcctaacactttgggaggctgaggcgggtggatcacaaggtcaggagtttgagaccagcctgatcaacatggtgaaaccctgtctctattaaaaatacaaaaattagccaggtgtggtggcgcattcctgttatcccagcaactcgggagactgaggcaggagagtcacttgcacccgggaggtggaggttgcagtgagccaagatctcaccgttgcactccagcctggcaaccaagtgagattccatctaaaaaaaaaaaaaaattacttaatttctttaggtttccttacttgtaaaagtgtaactatatcataggattctagtgaggataaaatatgaaataatgtgcataaaatttattagtgtgcagtggctggtgaattaataaagatgggacattctattttattataaattgtaccttaccatatgcctatatgctttgttcctcttagtaacatagtagagacctaaaagccctaaaatcaaaaagtaaaggaagaggagaaagaaaaagtttatgttagcattgctgtttgagtctccacagatgtatgttcatcagtgcttgcctattgaccagtcttttatttgatagctggtagacatgtgaacacacgccaattgtgtatagactcatgacaatgctacacctaaatggtctcgcttatccgtgatctttcacctctgaccggacgtttgtatcttttgcccccaacgtggcagctaaaaaggcaaaggagaaatgttttaaagctccaaagcaaagcttggttctctgatgcttgcagacactgtctacatacctagctccatcgactgcatctgtgaccttgtctgtctctcctcctggtatgaaatgattatatgtaggcagagactttccaaacctgccaacactttggataattgttaaaacaggtttaatgtgtaggtgaaatccaaaccaaaagttaggacacagaaaagtgattcagggaggtgcatttatactatttcatttgatattaatgaagttttaaaaactgagattatgtcctagagtaacatatgtttgctctcagaaaaatcactagataagataagggactatttaggagtaagttcctgagacatctggaattttctatcagtgataccgttccctatcagttaaaggtaggctacagttttaaaatggacaaaattctgtgtatgagttttgagtaatagatactgtggctgtattcttaaaacacagaatgctccagtaataggtcagagtatttgaagttttgaaacatcctagtgaagtttgaactacacattgctgaagttaggactgctgtcttctacgtggcacagctgaatttggtagatgattccaatgattaattttaatattaaagttttacattttaaataaaacatgatcctgaaactagaatatcacatcttcaaatatttataaaacgctgtgtcctaagtcctagcaattattgtaagacacataacattgcctgaaattatttagatggacacagtgaatgtttacgtaaccttttaataggaaactcgagttttgtgttctcttcaatacaagctaagacacatttctaactaagttgatatttaaaatacataccacctaagtgaacactttgtaagttcaaatttggtattattgtgaaaacttaaaaacatcaaatatacctttgaaagtttcaagtgaatattgactcctaaatgagtatgaaacagatcagacaattccaaatctctatttaattcaacatttatttatactactaacatcatgggagaaaaatgagtggttctgtttttcgttttgttttgtttttttaacaaggtcttgctctgtggctcaggctggagtgcagttgtgggatcacaggtgagtgtagtctcaacctcccaggctcaaatcatcttcccacctcagcctcccgagtagcagggaccacaggtgtgagccactgtgcctggctggttccagatcattttaaagaaattaagatgtatttatttgttttattggcaattcttagttttatttaggaattgattctcaaagtaaaggtgctagcaggatatggaaaatgaaatatgggaagaaaaacttaaacctatttttaaaatttttatctacaaatagaaataaattaggaaataattcggctttgttcatatttaatatatggatagacactggtgtttccacttccatatgtcacatgatcatattttatgtgtggtgccaaggtttcccagggagaagatgggttgactacacacctattgtatttgtcttctacgtcttctaaaatgaaaggtggctaaagaagattcttaaaaaaagtctcagaaccagtcttacaataaaaatgcaaacaaaatcaacaagaaaatgacagggttgttatttatactcccaatacaaactctttctttgtcacatcatgaggtaaaaatcaatgatgatttacaagagattgatcagagataaaaaaattacctagaaagcaatttgaaatgtgaattcatccactattgttattaaatctgactttgtatgtgtattattgatgattagctagtgttcgttttagaatggaaacaatgtgtagaaatagaagcattatttttcaaaacacacattttgggagaatgtaaactcaaaattgtatcgttagcattgcacaatctaaaatattcggagatgagtaatgtagcgccaaagtatattaaaatgatttcacctggtggctaaaataacaccaaaaacaatttatagacattttataatttatcaatttctttttaaatatattatatattaaattacataaaagctttacaaggttgatgctgttttccccactatataaatgcaataatcaagattttgaaagattacaacttgtccatgggcgtaattaataaatagaacagcataatctgattgctgatcttttgattttaaattctatatttttctagcttccagttttagttgcacacaatctacttagctaaaactgaatttggttaattgtcaaccaagactccaaaacatctttgttatctgatgttcttcatttttactttttaaaaataattgaaatgtcactattatattgacagtaaattcaccagttgttcgatgagattaaccttcttaaaggatgatcaaagcatgcagtgaagggaacctgacggggtttgactgctcagtttatcactgaacagggcacaggtaggctgagtgataacaccactcgtctctgatcagggactcatttgtgccatctggattagcaaagatttcccttccatttctctgctccctgcctcccacaggctatgactatgcttcttgtggtttcatcgcttgctgctgagcggtgttaataactacttgacatttggtttcccaatgatgttcacccaatttttctctaatatacagattctctgcaacacttctcacagtaattccagtgctgtagatatttcttggacatttatacaaaacatttaacttgtttccctgtaatagatagtgtaagttaaggttcacaaagaggaacataatttgcaaattttaaaattgtcctccctttactttaagtaggtaaaaataaagatgcaattgaccctgtcgatattgacttcatagagacatggatattaatatgtaaaacaataatctaaaatgagttttgaaaagaggtataatataaatccttaactaattaaccttgactatcataagtgcattcacatttcacttgcttatagtccatgacatggaaaactactcaatcaatagttattatacagaaacatctgaatcaggcataaagaatttggctaacatcaatcctttatgttagtgaaaactgtaaaaaatttgtataccaccgagaaaacatttaaggttttattaagaaggttttattaagaagtgaactatttttaggtaaactgtgaatccttgggaagaaaatgttatctttctcttttggagtggaggtgtcaaaatttacaaattagggtcaatagtagactagagtttgcttcacagtgaccaagctgaagttttctttatttttccctccctcccctcctcttccctcatctcccttcccctcccctcccctcccctcccctcccctcccttcccctcccctcgcctcctctccgctcctttcccctcccccctcccttcccctcccccctcccctcccctcccctcccctcccttcccctcccctcgcctcctctccgctcccttcccctcccccctcccttcccctcccccctcccttcccctcccccttcccttcccctcccctcccctcccttcccctcccctcccctcccttcccctcccctcccccttttccttccttccttccttccttccttctctgtgtgtgtgtgtgtgtgtgtgtgtgtgtgtgtgtgtgtgtgtgtctctgcctgtctttctgtctttttttcaaggagttgaagtttcccaggcagttggtttataggggggactctctggttcatgggcaatcgaatttcttacaacatagtctatgtgctgaggtggggaaagcatgggagatttggaatcagacagagcaaatgagctcattttaatccctaactaactttgtcacttgggagaattatctgctttatctgagtcttagttccttcctctctaaaatgagaacaatgataacttctctctctctctctttttaacttttgatgtttcattgattgtacataaaacctccataataagagctgagttcagtccaattgttggtgaccgtgcaaagctagacagtggtaaattcatcagggtacatgccacttagtcacactaagtctttgcaatagaaacttctgcagagaccagtctacctttttttgttgtctttagagcaatttaccaaatcattaagaactttgcttttcttaacacttgccatcttcatactcagccagaatgttcttttcaaacaaaaatgtgattttgccactccctgttaaaaacccctgaatgacttcctgtcattcctgagacaacagcccaaatcctgaatacaacttctagggccttccttgtctgacctcatccgacccctacagaaacagagccatgatccataaacgttctactgttcacctccctgactgtggaaagtgattgtccttcagtcttgacttgacccagtgcatttctttaaatctatatgtaataatcagaatataggagctgagcacagtggctcaggcctgtaataccaggactttgtgaggctgaggtggaaggatcacctgaggccaatagtttgagaccagcctggcaacctagggagaccctgcctctacaaaaacaaaacaaaggaacaaacacaaattccccccaaaacaggtgatgagaacgtccctctggagcaaacagaacaacctcaataagaagagcaagtattgctaagagtcacctaaaagcaactgcaaaatgaatgtgaacttaaagtaaaagcaaataaggtagacagggacatttctgttgttaccacctttttctaaagaataaaaatgtttttaaattattctttctgcctttttacaaactaacaaaatttgatcttcctggggagtgggaaggagggatgactcatactgctgaaactcacgtgagatcaatttgtgtgctctaagatcaatttaataatttacactggaaatatctcttcaaagtaggtgtccccactgggacattaaattagcattggaaggcttgcttggcgaatattgaggctgacttaggcaggtgctgagaggcagataagccttctgaacgtaacaggttgcctgtaggggcaacttctccttagtgttttgaagacatattatgatttttctcctccccacaatccttgtttgcaaagatatgagcttattttccaactcattcttacctccatgttgacctcaggaaaaaactgaatgcttcagggagagagctttcaacagacgctcatcttttcttaaggcttgtgacttctaatcacaagcctccaactaagcaaaatatgcttacatacacagatactgcctaaatggggagattatatttagatatatttgagcgcatagagttgatatgacaagattctcaaactaagtaattttcaagtttactagaattttgctgcttaaagttcctgttaatacaagaaaggaccagaagatatctcatttgagccttggaattctaactttgtgttaaaaattattgttatcttacctggagaaagacatctctaaatgctttgtaaatgttacatctgcttaagtagaagtataaaaatagttgtctccaaaaatttaaatttgtattaaattttctcttatgtcttaaaattagaaaatcgattcctatgcacttaaacaagtgataaagaatttgtgttttgggccaggagcagtggcccacacccataattccaggattttgggaggcctaggtggaggattgcttaagaccagcctgggcaacatagggaccccgtctctactaaaaattaaaaaattagccagtcctggtggtgtttgcctgtgttcccagctactctagaggctgaggtgggaggattgcttggacctgggaggccgaggctacagtgagctgtgactgagccactgcactccagcctgggtgacagaatgagatcctgcctcaaaaaaaaaaaaaaaaaaaaatttgtgttttcttggtttgacctttggagtgtacaagaaggcttggaagttatagaaaagttaattgtttttggtgatttcagaatatgtacagcaggtcttcaagtctttgataggttcttagaaactgtgactttaagtgaaaggctgtatagcaggccctcagataatgttgtttgattagacgttgttttattataacgttgatgagaaaaaaaagtgttttattttatgccattttacttaagtcccagtttccaaaaaccttaaggacttactctatttgaaaaatgaaatgaatattattaatattaatatttgttgactgaataaagctgtgtaatagcccaataggctaaatgtttaaaatcaggaaattacaattactactgtattttacagaactgtaggtcacttaattacttttgtaatctgcctataagtgtaaaggcaaagggtagagtaaaattagtaatttttttttttttttttttttttttttttgagacagaatctagctttgttgcccaggctggagtgtagtggtgcactctcggctcactgcaacctctgcctcccaggttcaagcgattctcctgcctcagcctctggagtagctgggattattggtgcgcaccaccaccctggctaatttttgtatttttagtagagatggggttttatcatgttggccaggctcgtctggaactcctgacctcaagtggtctgcccgccttggcttcccaaagtgctgggatgacaggcatgagccaccgcgccctggcagatgaatacatcttatgccatatgcctgaccactccctcagacaaatgagaaccaatgtaatggctgaagaaatggctgcttttttccattgaccttggtgcatagtttctctcctctccttacacaaaaagtaaatttaaatgaacaaagttaagaaggcatattttatgtttataaagctttgattcatggtacaaaatacaagttttcttggagaaacagaagctatttaaaatgtagaatgcagagagttgcattgagccacattccttcttttatctatctcatgggaattaacagacaatgaaaatattgactgtgtttatgcttaattttccctcacccttaatacatttttctgttatgattaattactttcctgtaaaattttgaatgaaattatttaaagagtgctatagataagtgtgtttttactaattttcattattcaccattgtggtataaaatcaacaggtacaagtcaaattaagccctgctgtctgcatgggtactcattattaaatatgagcgatttgggccttcagcaaacgaccatttatattccaaatcgtatttaaaattaatttactcttttatcagaacaaagaaaatttcacacacacaatctcttttactaaaaaataaattttatcataggaaattatctcattttatattccagagcagaaacatacaaaggtgagatgaatctttgtacaatatgtctttctgtcaaacattctaaaacattgtcaatttcattttttctagtattttcaatatttattttgtgtttggcaataaacggagctaatacgaccacttttctcttatgcttggttattattattttaagaaatgaaaacttataaatcatatagcttggaagattgctggcagaataagaaaaaataattttatcttttgtatacatgaaaagtttaaaatatcaaactataataattagtaattacatatgtaacctaggttacatgtatgtatgaggtatggctcacacccatcatcccaggattttgggaggccaaagttggaagattgcttgagaccaggagtccaagaccagcctgaacaatgtagggcaacacatccccaggcctgggtaattttttatggctccatttaaagaagcagcatgacaatgaaccttagatgtcatccagttgagttctcctacttgagcatgaatcccgtcttaaccctcagtttagcaaaccctatcagttatggagagcagataaatctcagcctacttaaacatgaagacagaactcagaaacagttcttcaaggcgctgccccttgttaagctggttctttaagaagcttatccgccaattcacaattctgaagcacagcaaagctgtttctgtattggtgttaattatttattaatgcagtgaaaacactttaaattcctattaaattgtcactaattacttgtgaactaaaacgtaagatgtttagttttttgcttccttctgagaaaatatatttgtatcgccatctttgaagtcagttctactgtaaagagcgtgtatttgggaatcagaaaaaactagatcgaaactgtttgtgttttattgggcaagctacttaaacactttgaacatcatcaggtttttaatttatgatgtaagaagttcagacgaatgaactgagtttatttgcctgcttaaattaaaacatatagaatccctatgtttcccccagtctactcaaatgttttcattgcagtatcaatgccaagaatattgtcactgcatagcaaagcattggagtgaagtagctgatatgtattggatgacttagtttcaaaagctgtttttcctataataccgtaattccttcctcaaacggaggcaacagaaattgcagtagagttcccttgccaactacaaaatgttccatttcattctgcttttctccatttcctagaatcagttacatcaatttgaatctaactagactaagataaaacatgatgaatatgtttgtgaaataaaaacttgacaataaatccttaagatttttctaagaaagaagtttatgaaacttcagagaataggagaatatttcctaataaaaaatagaaagcatgtaagaatatcttctgtcttttaatacaacaaaccaggggcctgcaaactgtatctcatgggccaaattcagctaggtgcttttttgcgtagcccttgagctaaaaatgatttttaaatttataaatgattgaaagaataaaaggataataatatttcatggtgcatgactatatgaagttcacgtctcagtgcctataaactttattggaacacagccatccccatttgtttatgtgttgtctatgttactttgagagaggtgagtggcagccacagaaaccatatgtgtccaataaagcctaaaatatttgctacttagaccttcacagaaacaatttgctgccccatgttcaataaacagctgaaggcagggatggtatcaaatctcaacacctgcttaagtacttgacacatagatctgcacagaatgagtaacagcagaaagaatagatttaaaaaattaaaattattttctcattataaaaaggaccaaatatctataatttttaaaaagccaatagacttacacataagatctgtaatgtaaaactactagaaaaaacacaggtgaatatctatgaggtataagtctgggcaatgattattttggatttgaccccaaaagcataaacaataacagcaaagatagacaaatgagattacatcaaaataaaaatgtcgtgcacataaaaggaaacaatggaatgaagagacagccctatggattgggaaagaatatatttgcaagccacatgtctgataaggggttgatatcccaaatatataagaaactcaaacaaatatatagaaagaatacaaataatttgattagaaaatgggcaaaggagctgagtagacatttttcaaaagaagacacaaaatgaccaaaaggtatatgaaaaaatgctgagcatcattaattatcagagaatgaaaatcaaaaccacagtggataccacctcactcttgttaaaatgactgttgttcccctccctttgtgcatgtgttctcactgttcatcttccacttataagtgagaacatgagatgtttgattccctgttcctgcattagtttgttgaggataatggcttccagctccgtccatgtccctgcaaaggacatgatcttgttccttttgataggtgcagcaaactaccatggcgtatttacctatgtaacaaaactgcccattagcacagaacttagaataaaaattttaaaaaatgagtgttatcaaaaagaaacaagagaacaagtgttggtgagaatgtggagaaaaggaactcttaacacactgttgatgggaatgtaaattagtacaagcgtaatagcaaacaatatggaggttcctcagatattaaaaatagaactgccatatgattgagcaatcccattactgggtatactgggaactgaaatcaacatgttggagagatgtctgcactcccatggttagtgcagcactattcagctttacaaaagaaatgttgtcatttgtgacaacagtgaaattggaaaacgttttgctaagtaatataaattaggaacagaaagtcaaatacgttatactctcacgtatatgtggaatctaaaacagtcaaattgaaagaagcagagagtagaatagtggttatccgagacgctgggagagaggggaatgaggagttaatggtcaagggtacaaagctttaattacacaagagaaatacattattctttgggatatattgtaaagcatggtgaatataggaaataacatattgttatttcaaatgttctcaccacaaaatatggtatttaagatgatgaacatattaattagcttgatttaattattcaatattgtattcacgaactataacaccagtttgtgtcacataaatatatacagctataatttatcaatttacaattaaaaaataaatgaaataaaattggatttaaatgaaacagtgaaaagtcttcatatagatgacaagcacaataacttcattttaaaatttataataccatgaacataggaattcccaggagaaaatttaggtttatgagactatatccattgaaaactctgttggacattttttctgaagttgttcagttttagacctgaaacaattatcttttatcatttaataaaaatggattagaaaatcgctctgtataattaatagtttgacctagtcttctatgatggtttattgattgtttcaactccagagctggctagcaacatgaaactctcatggaaaacctgtttataatgaaggatgcttctgaaacaatatacactattatatcttgattgatagttaacatttagtaactaagtacactagtacatttgacttacaggccatcattttcccttaggagacagtaactttgagtctatcccattcatctcctctagaactttgtcaaacagaggtatatatggcttttgatgctctcctttcatttcacgttgttctttcatgtttgatttgcttaatgctcattgggtttctttttaattcctctaaattatctaatttgaaaaaataactattattaatatactctcaaaaactgtagaaaaaataatttctaaataatttaaaaggtaaaaaatatcaacatggagaccttccataatgtaaaagtggttctttttttaataaagccttttctctactcatttaaaaaagtggagttggaggggctgcctttcaaaatttccacataaaagcaaccaaaaatttgttctaggaggagcactgatggcagtttctgaaaagatttccgtgacaccttagataagagtgaaaaaatcaaccccataaggaatttgtcttcattcactccatactttctggactgggctttcccttctggctagtgattagagctgacagacaattcgacagaatcacaaagtggagaagttctttttaaatacaagttaatggttttgtaaatttagtgccttaagcaaaattgaattaaacattcagtcattcatcttaagcatccttaaaaattgaaagcttcacaatatgcccagaacccagaaattcaagtaacttttacccagagcctacccagccggactgcgcaaaggactgatgagacgaaaggatatttggacgctgccctctaggaaaggtagcctagaagaggagaggacactaacagactaacgactccttcagaggggaggaccacataatcagccaatgtcagctggcccagatccaaacagctttctgcttatgcaaaccttgtgtggtcgttgtgttaactaatgcaaagatatatgattaatgtacttgtcagtgtcctgtgtttagttttctcacaaaacatttcttatataattgagataattactttcacttacaatgccattggtttaagttttaattgataatgatgactttacttttcagtttaccactatagacttttatttttagagtaccattcagagtcagagcctgaaccttagagaattaaactcacttaagattgaagtagtagtcatttcatactttgtgtatttatccatgttttgagctaattccagaatgttgtcagtcatattgggatgcgatatagtaatttggtttttaagtatgattttggaactctaagttactaaaatagtagcttaatttttgttcaccaaaagaatttataactgaaacttccattagagattatatgctttttatttactacttttagccattaaccaattaattataaaatatagagattttatgttttcatctacatatacaaaattaccattaagatgaaagtaattgaattgattgcatattcagttatagaattccaaatttaagtagacacagaaagtcataagtttacatctaaaaattcacgaggtagtcagtcatagtcactacattttagccaactatggaacgtgtactatcatgtactatgagtcagtccctgtactgaagatatcaaaatgaatttgacaatctggtataaaatccaggactattatttgtactgccagcctcagggagagatgaataaaatggatttgtaagttagaggctgcaaaaactgttttttttggtttgttttgctttttgtttgtttgttttcctgcaaaagcatgtattcagggtacaggtggtggttctacccttccagttttctaggctggctgatctttataacttgttgttcataaagatgtatgtaaataagcaccatgtctcaaatttagattgagaattgttctcccagagtattcaaatttttaagagataaaacaattaaaatctaaaatatgtgataatctaaatacatattatacccccattcacccattaaaatattttttcttgctaataaaagaaaaaatcgtttttatggattttcctatccctcaaaaataaggacaataacattttgcctatttttaaaagatattggttagatgaatcttgtagatctagctcaattgttcccattctagaaagcttagaattattatcctgaaagcagaaataattgttaaaaatgaaaacatgaaaactttacataaatgacttcattttcacctcgtaaactttattgcacagcaccgcactccagcctgggcgacagagtgagactccatctcaaaaaaaaaaaaacaaagaaaagaaaaaaagaaaaattttattgatttagaatgcttgacagagcaaagtgaagctgtcctcacagggttagtaagtattctggacagaaacatagttataattaagcattagtcaggctgtattttgacctacttccttacaaccaaagtcacatagcactagatactgaccatttgcatcccattgcttgtatagataggattctgatgtaggatagataggatctctgatgttggaatcacaaggctttttaggaattgcttaagcagatcctaaattccagcagaacagcggaccccagccagtttgaagacactcacagaggaactgagtcacctgagaatagtttctttatctccccattccatgacctcaccctgcactcttcaaccaattcatgatctccacactttgggctacttcagagcctgtgaaaaccctagtcccagactccccaaggtgatgtgtgtgaggttttctcctgtctcctcctttggctgccctgcaatgaaacccctttctttgctgcaaactggtgtctccatgtattgacttgttgagcatcaggcaacagacatatggttacaaaagcagaattttctcttgagtatttagagagctcctaggctgttctgattccaggcagcagacttcaggaggtagcatttctaattttctatcatgatgttaagggaaatatgctgcctgataagtgtttggatattggatattgcatggttgtcccatgtcccagtaaaacacacatttttgctttgtcctggtaattaacaatacaaacaatataaattaatttggccacgtattttagtataaataacacagttacaaataatggtctgtttgtcatcctgtcacctaaatctaaaataccgagatccagatgaaatgaaagagtgcacattttaagttgcataaattatatatatgtatgaagacttaaagttcagattttcagaaaactaaaaagttcttaatcatttttagaaagtagatcagcaaagtactgagttattttgtataaagattaaagcaggtattatctgtgtgtgtgtgtgtgtgtgtttctgtgtgtgtgtttgtgttgttctaatattaatagaaacaatagaaacaatatttctttaatattacttttcaagaagatagtaaaagccaagaagtaaaagtgttttaattcttgagctgttaattcaatttttttcttgaatgattgaatattatttccatcatttgttcattgtaacatttcccaatacttatagatgatatatagaaaaacaatttaaattgaaaatcattaatttcccagtgcatttcctaatatatctatattcagatctgtatgttttcttgttccataaagaaaaagataccttcgtttttttcaaattaatatcaagagcattaagttttattgaactaataatcttcagtgttgtctatggatttaaattccattttattgccattttgggagactaaagacagaaagagaaaaggaagaaatatagatgggtgatcaaagtaggtaaaaccataaagatgtgtgaaataaaagtgaaatagaagaaagagatagccaaatgaggaaaacaaatcacagaagagaataaaggcatgtaaagcatacaaaactagaaaaagtgcaggaaagagaaagaaataggtagataatatagaaaaagttttgaaagtttcagtaaatatgataaggattccatgtaggtaataactatcagagagttataaatttatatgtacttctttgaaatgtatagtaattggcattaatagcttttaggttattccaatgtttatttgtagtgctatactcataagcataccttctataaataagcacattctttatgctagaaagataatgaaagctctatctggtaacttgttttccatgttgaatgctacaaacacactctctaaacgtgttaatgtgaatgtgtgtacccttgcatacacagacacacacgtaaataaaaaaaactttattatatgaactgctagcacaaatatgtgtattttgtttgaagaaatactctggtaagtttcttgacacttactataaaacgtgagatgctgtgagcatgaaagaaagtggtcattaacatacccaaaggaagagatgatccttctatgctataaggaaaggaaactattggttttcttacagaaaacaggaggtagaatcaaagaataaggcaagggaggacaagagaaaaagacagtctgggactttgtgaagagccactatttgcaagttgaatgtggttttttgctttgttttgttttgtttttcttgctattattgagttattgttctgtgtttcttcacgagtcttcaaaaagtctatactgttcacagtgcttggagtgacagggttttcctgcagaaggctacacattcaagcataaaaaaagaatgtacagcagcttagctcaagaaacagaagatattactagtaaatacatcacccccacagctttaataactgcccaccccctgcaaaaccttaggaaaagtttggaaaggatttgacatctataatctgtaaagttgcagtaacagcagagtctcaaggcaattttgcctaaatttctgagaagctgagggtcatgaggttgcaaagccttctgtccagatgtggggctatcaggggatttggagtttagctttgtttggttgttccctatctcatcaatttacttttcacaaaatctgcctctgaacgttcgatccactgtgaatatgtttgaagcatgtttttgaatgcatgttcaacactggagaaagtagattacagttctgctcttggacagctctggtccagcactgcaggtggtgaatgtaagagtgatagtgatgtgatctcttagagaagaatgatgtgttaattaatttgaggaatggaagagcatgcccttgacagtcactgtgacttgagtttgcgtgctagcacctccatttgagctcagatttatttaccttgtaattcctgtagaatatagatgatatgctgtacttcaaaatttcattgtgaatattaaaagaaataatacggccaggtgtggtggatcacgcctgttatcccagcactttgggacacccaggtgggatcacttgaagtcaggagctcgagaccagcctggccaagatggtgaaaccccatctctactaaaaatacaaaattagccaggtgtggtggcatgtgcctgtaatcccagctacttgggagggtgagccaggagaattgcttgaacccaggaggtggaggttgcagtgagccgagatcatgccactgcactccagcctgggcaacacgagcaaaactccatctaaaaaaataaaaataaaataagatagaaataatacacacagtgttcttagcaaattccttggtgcacaattatatggtagttattattatcaaaattataaagcagaaaaaagtctcaaagccaatgattatttatttatttattttagagttggagtcacggagtgcagtgtcacgatcatagctcacagcagcctagaacccctgggctcaagtaatcctcccatttcagcctctgaatacctaggactaaaggcatgggccaccatgcagctaattttttagttattttattttattttattttattttgtagatacagggtctcactttgttgtccaggatggtcaccaacactggcctcaagcagtcctcctgcctcagttttccaaaatgcagggataacaagcatgagccactgcaccaggcctgggaacttacagcctagtatattccgcaattatggagggggtacgacttatgtgaaaccttcaggaatgcatacccttttagagagaaataagtcttaagttagagatgagaaaaagcatgggaggctaccttctgaatattgaaggtaggtgtaagattataatggtagagaataagttcagatatgaagaataggcctaggttatggcagaccttgaacttcagagaaattttagctaaatatgaaggttagaaagagccattatacatttcagaccatggaagtaatataagctggtcgtttagaaaatttcatcaattgcgttatgcaagagtaactgaagttcaaagagatggtttttgagaaggtgactggaaggatttgcagttatcaagaaatgaggtgaagaggacttggagtaattttggctgagaaaaataaacctttacatacagctctaagtctataagaacaaagaatatataacaatccacatgtagagtataaaataataagaatgctatcagtaaaacaatagtgaaaaagaagcatcacatttagtccataaattaaatcgtgtccttaacttagtataaaaagatctaaggattatggtataaatattgcacactttttatgtggtggacatgaaagcaatttctgtgagtttaaccaatggaaaattggtactcttggataaatgattggccctatacttgaaccattaaaagagagaacattaaactaagtagacataattttgagagttccactacattaaaattgaagaacagcttactaaaaacagccagacttaagggtaccatattgtataaaaatgttatattttccatattataaatggtttggctgatagatacttaagaggaaaaatatagccagagtcttttaggttggccatatagtttcaagttttcaagttatcgaaaatcaacccatttatttatttaaaactcatactcacctgcttggagacataatttggaaatttataagttgtatatacaacttcataaaatctgaagaaataaatcaaaataggcattattgaaaagcagcaacataaatgtatgtcattgggattctacaatgggtttgctgtaattatatcgtacattgatgttaactctcagtttcctgacagctaaaacaaagagaaaaaaatattataggtattaaaatgtttatacaaatcatttaaatctgcagagacatgcatgcttgtatttaagtgctgagggtggactgttcaacataacagatgattagctttcacctgaattttacaaacatgctatttaaggcaacaaatacattaattctatatagaagttaagagaccatacttcagtggagggatttccttaagagaccagcagacccaacattccaggtcaacagaatcaaagcaaatgctgtttataataatacaatttagggatagttgtggtaaattttaatgacatttccaaaaccaattggagcctatgcaccttaatttgaaacattgtgaaatggactcaggattaatttgagaatagaagaaaagaagactattccataatttcttttacagaaaattatttatcttctttccatttaagaagacatacatggtgaccgggcacagtgactcacgcctgtaatcccagcactttggaaggctgagacgggcagatcacaaggtcaggagatcgagaccatcatggctaacatggtgaaaccccatctctactaaaaatacaaaaaaaattagccaagtgtgacggcagatacctgcagtcccagctgctagggagggtgaggcaggagaatggtgtgaacccgggaggcggagcttgtagtgagcccaaattgtgccactgcactccagcctgggtgacagagtgagactctgtctcaacaataacaacaacaacaacaacaacaacaaaaagatatacatggtatcatttcaagaccactgcctacctataatgtccaaagttgcatgaatgatctccaaataaatgcacatgtacattcacagtggtgcaaggaattttctggaaggagcaaacataaacacgggagggacagcctgtgtgctgggtgtggaagtaaccaaagaaattgttgtggtattgtgaaggaggttgatggtaaacctcttgtcaactaatgaaagaggaatgattatggctaagttgtaagttccacctccctcctcatttccaaaaatttcctgttcaagctacctcgtaggacttggaaaaggtacaactcttcttccactctttctgaaaaattaatgggagtctgttttccacaaggatagaagaatattatcctgagtagtttgtcagtggttgtagtggataatttttagtgtacagcaaaaatataatgacatagtgataggacaaatattttctgcaaagcaaaaagaaagtaaggcatcatatacaatttgttgctacatgacaaaatgaaagatttaaaaatttaaaatttatgcaccccttttcagtcccatataatagaagtttgttttgttattatttacagatgatttaaaaatatttagacaatcgcaacttctgtatccatcaatttggtaaggtaatattaaatgacacaacttgtcaactaagttagtcaaaatggtttatatatgtgatctttcattcacttagtcaaaaatcttaagtgcctattgtatggcagaaatattaacagctgacacatatagtatctattctatttcagagatagtattaaatgcctgatgtatattaacacatttaatcctgacaaagattcttcaagatttatggaaggaaaaaactgaagcaaaaaagctaagtaatttgcacaatattgcgtatctaaaacgtgttggagttgagatatgaaaagacagttcaacgttagaggccgaactcttaaacagcacggcatatggcctcttgagtcccgagtgataagctcagaataaaatgtgggtcaaaccatacaattccagccataaaagtgatgaatgtagagctcttaccatcaccatcatcatcttattattactatgttattactttgctcttacagacatgtgctatacttctgttactagaaattcatctctggagacatatttgttattcaaacaggtgaaaaagttatccccataaaaatatgacctttgtaataaatgtattattcaacaagagttaccagttttctgtagtatagcagacacagcttttggctggtagaaacaggtaagtacatgattaaatctaaagtaataggtactaaagtaatggtattgagattcagagatgggagaaactaggtacacctttgtgtgcatgtgtgtgtgtgtgtgtgtgtgtgtgtgtgtgtgtgcgcatgcatacatgaacacgtgtcatgggagacatgggtagggattcacaaagggattgagaaaatcaaaagtgatggggaaacaagagaaaagaacactataggaaatgacacttaggcatagcttttaaatctgttttcaaacatgaacaaaaattgagagaatgacataataaacactcatgtacctctcatttgcctcaattataagcaatttgccagtctcaaatcatgtaccctcctcagtttttaaaccttattttaaagtaaatacaaaacagaagttttttttttaattattgtagtaagcatacaacatgaaatctacccttttaaaattttaagttcacaatacattgatgctagctataggtagaatgttgtacagcagttctgttgaacttattcctgttgcataactgaactttatactggagcaggtttttcagtttccatgtagttgagcagttttgagtgagtttcttaatcctgagttctagtttgattgcactgtggtctgagagacagtttgttataatttctgttcttttacatttgcttaggagtgctttacttccaactatgtggtcaattttggaataagtgtgttgtggtgctgagaagaatgtataatcttgatttggggtgaagagttctgtaaatgtctattaggtctgcttggtgcagagctgagttcaattcctggatatcctttttaactttctgtctcgttgatctgtctaatgttgacagtggggtgttaaagtctcccattattattgtgtgagagtctaagtctctttgtaggtctctaaggacttcctttatgaatctgggtgctcctatattgggtgcatatatatttaggatagttagctcttcttgttgaattgatccctttaccattatgtaatggtcttctttgtctctttcgatctttgttggtttaaagtctgttttatcagagactaggattgcaaaccctgctttttttttttttttccatttgcttggtagatcttcctctgtcccttttttttgagcctatgtgtgtctctgcatgtgagatgggtctcctgaatacaacacactgatgggtcttgactctttatccagttttccagtctgcatcttttaattggagcacttaggcaatttacagttaaggttaatattgttatgtgtgaatttgatcctgtcattgtgatgttagctggctcttttgctcgttagttgatgcaatttcttcctagcattgatggtctttacaatttggcatgtcattgcagtggctggtaccggttgttcctttccatgtttagtgcttccttcaggagctcttgtaaggcaggcctggtggtgacaaaatctctcagtgtttgtttgtctgtaaaggattttatttctccttcactcatgaagcttagttcggctggatatgaaattctgggttggaaactcttttctttaagaatgttgaatattggcccccactctctgctggcttgtagaatttctgtcaagagatctgctgttagtctcatgggcttccctttgtgggtaacctgacctttctctctggctgcccttaacatttttttccttcatttcaactttggtgaatctgacaattatgtgtcttggagttgctcttctcgaggagtatctttgtggaattctctgtatttcctaaatttgaatgttggcctgccttgctattttggggaagttcccctggataatatcctgcagtgttttccaacttggttccattctccccctcactttcaggtacaccaatcagatgtagatttggtcttttcacatacttccatatttcttggaggctttgttcatttctttttactctttttttctctaaacttctcttctcacttcatttcattcatttgatcttcaatcacagacaccttttcttccacttgatcaaataggctactgaagcttgtccatgcatcacgtcgttctcatgccatggtttttagctccatcaggtcatttaaggacttctctacactgtttattctaattagccatttgtctaatcctttttcaaggtttttagcttctttgcgatgggttcgtacatccttctttagctcagagaagtttgttgttgccagtcgtctgaagccttcttctctcaactcgtcaaagtctttctccgtccagttttgttccgttgctggcgaggaactgcatacctttggaggagaagaggcgctctgatttttagaattttcagcttttctgctctggtttctccccatctttgtggttttatctacctttggtctttgatgatggtgacatacagatggggttttggtgtggatgtcctttctgtttcttagctttccttctaacattcaggaccctcagctgcaggtctgttggagtttcctggaggtccactccataccctatttgcctgggtatcaccagtggagtctgcagaacggcaaatattgctgcctgatccttcctctggaagctttgtctcagaggggcaccctacgaggtccataacaaaatggaggcagaaataaagatgttctttgaagccaatgagaacaaagacacaacataccagaatctctgggacacatttaaagcagcgtgtagggggaaatttatagcactaaatgcccacaagagaaagcaggaaagatctaaaattgacatcctaacatcacaattaaaagaactagagaagcaagagcaaacacattcaaaagctagcagaaggcaagaaataactaagatcagagcagaactgaaggagatagagacacaaaatacccttcaaaaaatcaatgaatccaggagctggttttttgaaaaaataaacaaaattgatagaccgctagcaagacaaataaaggagaaaagagagaagaatcaaatagacgcaataaaaaattataaaggcgatatcaccaccaatcccacagaaatacaaactaccatcagagaatactataaacacctctatgcaaataacctagaaaatctaaaagaaatggataaattcctgcacacatacaccctcccaggactaaaccaggaaggagttgaatcactgaatagaccaataacaggttctgaaattgaggcaataattaatagcctaccaaccaaaaacgtccaggaccagatggactcagagctgaattctaccagagggacaaagaggagctggtaccattccttctgaaactattccaatcaatagaaaaagagggaatcctctctaattcattttttgaggccaacatcagcctgataacaaagcctggcagaaacacaacaaaaaaagagaattttagaccaatatccctgatgaacattgatgcaaaaatcctcaataaaatactggcaaactcaatccagcagcacatcaaaaagcttatccaccacgatcaagttggcttcatccctaggatgcaaggctggttcaacatacacaaatcaataaacgtaatccatcatataaatagaaccaaagacaagttggcttcatccctgggattcaaggctggttcaacatacacaaatcaataaatgtaatccagcatataaacagaaccaaagacaaaaaccacatgattatctcagtagatgctgaaaggcctttgacaaaatgcaacatcccttcatgctaaaagctctcaataaactaggtcttgatgtacatatctcaaaataataagagctatttatgacaaacccacagccaatatcatactgaatgggcaaaaactggaagcattccctttgaaaacgggcacaaggcagggatgccctctctcaccactcctattcaacatagtgttggaagttctggccagggcaatcaggcaagagaaagaaataaagggtattcatttaggaaaagaggaagtcaaattgtccctgtttgcagatgacatgattgtatatttagaaaaccccatcgtctcagcccaaaatctccttaagctgataagcaacttcagcagtctcaggatacaaaatcaatgtgcaaaaatcacaagtattcttacacaccaataacagacaaacagagagccaaatcatgagtgaactcccattcacaattgcttcaaaaagaataaaatacctaggaatgcaacttagaagggatgtgaaggacatcttcaaagagaactacaaaccactgctcaatgaaataaaagaggacgcaaacaaatggaagaacattccatgctcatggataggaagaatcaatattgtgaaaattgccatactgcccaaggtaatttatagattcaatgccatccccatcaagctaccagtgactttcttcacagaacttgaaaaaactactttaaagttcatatggaaccaaaaaagagtcagcattgccaagacaatcctaagccaaaagaacaaagctggaggcatcacactacctgacttcaaactatactacaaggctacagtaaccaaaacagcatggtactggtaccaaaacagagatacagaccaatggaacagaatagagccctcagaaatactaccacacatctacaaccatctgatctttgacaaacctgacaataacatgaaatgagtaaaggattccctatttaataaatggtgctgggaaaactcgctagccatatgtagaaagctgaaactggatcccttccttacaccttatacagaaattaattcaagatggattaaagacttaaatgttagacctaaaaccataaaaaccctagaaaacccaggcaataccattcaggccataggcatgggcaaggacttcatgactaaaacaccaaaagaaatgacaacaaaagtcaacattgacaaatgggatctaattaaactaaagagcttctgcacagcaaaagaaactaccatcagagtgaacaggcaacctacagaatgagagaaaatttttacaatctacccatctgacaaagggctaatatccagaatctacaaagaacttaacaaatttacaagaaaaaaatcaaacaaccccatcaaaaagtgggcaaaggatatgaacagacacttctcaaaagaagacatttatgcagccaacagacacatgaaaaaatgctcatcatcactggccatcagagaaatgcaaatcaaaaacacaatgagataccatctcacaccagttagaatggcaatcattaaaaagtcaggaaacaacaggtgctggagaggatgtggagaaatagaaatgcttttacaccattggtgggattgtaaactagttcaaccattgtggaagacagtgtggcgattcctcagggatctagaactagaaataccatttgacccagccatcccattactgcgcatatacccaaaagattataaatcatgctgctatgaagacacatgcacatgtatgtttattgcggcactattcacaatagcaaagacttggaaccaacccaaacgtccatcaatgatagactggattaagaaaatgtggcacatatacaccatggaatactattcagctgtaaaaaatgatgagttcatgtcctcttagggacatggatgaagctggaaaccagcattctgagcaaactattgcaaggacagaaaaccaaacaccacatgttctcactgataggtggtaattgaacaataaaaacacttggacacacggcggggaacatcacataccggggcctgttgtagggtggggagacgggggagggatagcattaggagatatacctaatgtaaatgacaagttagtgggtgcatcacaccaacatggcacatgtgtacatatgtaacaaacctgcatgttgtgcacatgtaccacagaacctaaattataataataataataaagaaagaaagaaactttgtacttactgaacagcaaacaacagactatcttttaaacccattttactctgcttagttttaaatattgagtgcaggtgggagaactagatatgagaagaaccacctttttattattggaaatgaccaagggcattgttttggttaaagtaattttaggatgtttccattgaccattgatatcttacatacatttcctgttttaacttcggagcgagtcattttgaaggattttgctggactttcagaacgtgtgatttgttttaacggtgctctcgggctgccatatgtgtttatgtaggctgtgtcctgaagaaggggtctctgttagggggtatgagtacgctgaaaatgaagcactctccaagcagcacagaggtgcattttctcatctgcagtaaggcatcttagcggccagtggtcctgacagcagcaagtagatctcaaagccatttcacgggccttctcatattcacactaattctaaatcagacttctgttaagaaaggagaaataggtggggcgcggtggctcatgcatgtaatcccagcattttgggaggctgaggcaggtggatcacctaaggtcaggagttcgagaccagcctggacaacatggtgaaaccctgtctttactgaaaatacaaaaattaatcgggcgtgttggcgggcgactgtaatcccagctactcggaggatgaggcaggagactcgcttgaaccctggaggcggaggttgcagtgagccaagatcagcccattgcactccagcctgggtgacccagtgagactctgtcaaagaaaacaaaaaaaagaaagaagaaaggaaaggaaggaaggaaggaaggaaggaaagaaagaaggaaggaagggaaagaggaaatagaatttaacaatttgaacaaaaaaagggggaatagaatttaacaatttgaactaaatacaaataaagtcctttgctgctatcaaaatgcaattgtgacatagagttagtgcaaatatgttattgtgtaatgactgtgcaaattgcttttctgtatgtttgtcttatataatattgacagtactacatagtgtgtcaaaaaactaaacttggtatttttaatgctaaaatgagtaaacactaatcagaatgccagcaggtacaatatctttgaatgaaaataacacattcaaactgctgtttctgttctctttggtacacggtctgcatagttagtatgataaatgcgaatagaattttcatgctgacatttaattaaaatgaaattacctatcattgttacccactacacagaagctattatttatgttgatattattctaatattgtattaagctgatattgaatttgtatcagtgttttttatgaactgaattatttctgattcctcagttgtttttaaaagccaaggagtagatactattgcattgtgcgtggatagagcatattttcctcttatttgaaaagttagaggtggaaatcatgtagttcagtgtaactataattgtactattttcctgtttttttttcttttgtcttctttggctattttgatgccttttaatgcatccccctgttgatgtacagtttaatatctgatataacactaagattaattttttaattgttaatatatctttgactagtctttccctatattattaccattgtgattacttttacttactacgatcaaagtagcaacttgtagtcagatagcagtgatattcacggtctatcaatttatccattcatccatttatccatcctacttttcttcccttcccccatccatccattatgtactgtggatttgcactgaagtcaattggaattaagtattataaaactctattttactaatagccatataaaacccttaagaggcaattcagacattcacaatacttggaattttaacagttacctctattgactattacaatatagcataatctgtaaaatcactctggcaaaaatgtgtatctatgttttagttctaaggaagcaccactcagtacaatgaaacaggaagaaatgctagtgatttacattgttcttgaggaagttaaaaaaaatcaattcattgtgattctgaagctttctctttaggtcagatattgttatattgataacaaagcaatgacaccacacagtttttgtgctccaataaatgtgatttcaaattttacaaataaacatttttcccttttaaaaagtatatacgtctatctgtttagttggacaaatgaagacaaagcaaatttctgtgacccaaatccaagtctgagtactcaagtttgggtttgtacagtttagtttaacttaaaaacaagtgacttgttcatttctacgccacaaatacctaaaacaacaaatattacacatcatttttggttgagaggaatgactaaatcattgtttctagtgattgcttcttatgacaaatcaacattgtttattaaaaatatgagattttatagaggtcaggcatggtggctcagacctgtaattctagcccttgggaagcggaggctggagaatccctcgaagcctggagtttgagaccagcctgggcaacaaagcaagaccttgtctttacaaaaaaaaaaaaaaaaaaaaagaaagaaagacagaaattaggaaagaaagcaaagaaagaaaggaaagagaaagaaaagaagaaaagaaagaaataaagaaagaaaaagattggctgatctgagtgcagtggtgtttacaactaattcatcacaaccagttacagagatttatttgtcccatctctacacctaactccttcatttaactagaaaaatatatatatatattagattttataagaaggaaagtagaacatacaaataatattaagtacttatctattacttgagatataccaactagggaagacagaggaaggacaatcaatataaatcatatttaaacaactactctagtaaattgatcaaagtctggttagtattatctgctttaagtttttctaaggattttcaatgagagaagaccgtatcatttccccacaacccaacctatccagcgtttttctggaagaggctattagcaacacataagctgccagcaatgtaaaatccccttatttgctgccttaacatttgggataaaaagtgttgacaccattattttttaacctcgatctcattgaggaacttcctgaattttctaacatcaatttactgctaaagatctatataataaggagattttgaatgttaggaacctgtgattatgggtgagagttagttgatgagagggtgagagttagttgatgagaggattcgaagctctaacatctcggaataactggtaacacatatctttgcaacatagcttcatttcactgttaggctttggtgtgttggcgattttttatgtgtgtaattaacatattttattgacaatatttatgtatatctgtaattacatatatctgtacaatgtgacatttaatctatgtaggcattatagaaagtttcagtcaagtgaattaacatgcccttcacctcaccaatttatcacttttctgtggtgagaacattaaaactttttaaaaacaaatctgaaatatacattattattatctgtggtcaacatacaatgcattacatcactaaagttcattccttcagtctaactaattctttgtacctctgattaacatcttctcttccctccactcctagtttctggtatccacatttctattccttgtttctgaaatagaccactttagagtccatatataagtgagatcataccgtatttgtctttctgtgtttagcttatttcatttagcatattgttctacagtttcatccatgttattgcaaatgataaaatttccttcttttttaagggtatatagtattccatagtgtatatatactgcattttctgtatgcattcatctgttcctggatacttatattgctttcatatcttggctattgtgaataatctaaaagaaatctgggaatgccgatatctccttgacatacagatttcactacctttggaatatatccagaagtgggattgctgaatcacatagtaattctatttttagatttacgagttactcccatgctattttccaaaataggtgtactaatatactttcccatcaacaatgtacaagggttaccttttctccacatccttgccaatacttgttggcatcagtcgttttgataatagccattctaatgggcatgtggtgatatcccactgtggctttaatttgcatttctctgatgattggagatgtggagcagtttttcatatatctattggccattcatatctcttcttttgagaaatgtctgttcagattctttgcacattttataattgggttgttttcttgtcatgagttaaattcctcatatgacgtggatataaacccctcatcaggtgtatagtttgcgaatattttctttaaatctggtttctctcttcatcgagttgtttcctttgctatgcagaagctgtttagtttgaggcaattccgtttgtctatttttgcttttgctgcctgtgcctttggagttccatctaaaaaataattacccagaccaaagctgtggagatcttcccctgttttcttatagtatctttgtagttttaggtcttatatttaagtcctttatcaattttaaattgatatttgggcctggcacggtggctcacagctgtaatcccagcattgtgggaggcagaggcgggcagatcacctgaggtcaggactttgagaccagcctggccaacatgctgaaactccgtctctactaagaacacaaaaattagccaggtgtggtagcacatacctgtagtcccagttactcaggaggctgaggcaggggaatctcttgaacccgtgaagcggaggttgcagtgaactaagatggcaccactgcactccggtctgtatgaaagaaagagactccatctcaaaaaattatatatgtatatatatataaattgatatttgtatttctagtgatatggggtctgatttcgttcttctgaatatgaatattcggttttcccatcagcatttgttgaataaaatccgtcatttcctattatgtattcttgtcacctttgaaagaaatcaattgatcataaatacttgagcttattttctgggctttctaacctgttccattcgtcagtgttcctccttaatcagcccagtcagagattctaagtgcctctaagttttgtgtttgtccagcctgctgtctttgttcttagtggccccaatacatgggagagtatcaagttgtgctatcgccttgagagacatttgatagaagccagtccctaggaatgtggctggagaggtcggggtgttagatgcgtgttccagttctttctgtctctcttttcagagaagctgagagccagagtttctttctcatccattctgccttactccaaggaatgaagctgagatagatgcctgtacccttgatcatactgctcactttgaacctggggagatacttgttgaatgtttgcaagtttaaaagtcaccttttgttccctgtggtctaggagattcaggagcgtggagttctgtcaactcccagagccaggtgatttaggagccagtcccaagcaaagactgtaaaagttgaagtatttgatgcatgtagaaactgcctccagggagggtcttcagatctatatttactgctgggtcaagctggggaagaaggtgcagagagtgcccacagtcctgcttgagcattcagaagacgccctccctcatagcaggggagacttctggtctggagtgcccactttcctttaagacatgaagaggtctctctgcttccttccaataagagattgcggagtttatctctagagcaagctgagggagaaggcacaggagtgctgtccctcccagtcttgctgggagaagacttcaactcttcacagagagactgcagggctgggattagcactggagaaagccagggaaggccctcgtaggtgctgtgcttcctgtttaggctcaagttggctttttctttattgctttgtaggctcccagagactgacctgttaaaggccaaaaccacagggaactgctgtgaagccaaaccctctccaggggaagggtggaagctggacagatctaggggctaccgctgctgagagtgccctcagaggcagttcaaattcttctttgtttttgtgcttgagggaaatctcccaatgtgctgtctctgacattctgcaagtggggtgatctaagagcccctcccccttgcagtgatggtaaaagttgggcattataggtgtggtgcaagcctgttacccctcaggaagaagctgggagttgaggtttctttccaaatgtaaggcactgtgctcagggtggggttatgcctgagtgtatctccactttttctactcatttgggtgtattttcatagttgtcaggtgtgtaggagtctttgagctggattctggctttctctgggacagaactgatccactcatggctatttacttggtgtgtctgtgggaggagggagcatcaagagtctcctctctgccaccttgctgacttcctgtgttgaatatttttgacttgtgtttatttacattttgtttatacatttgtattttttcaattagtgatactacaattcatgaattctgctttatgctatcaattatgagtagccttaggttaattgctatatttaatttcctgttacagctatagcttcttgtggcttagaattgccttagaatgtaataattctagcaacaaaagaaaatagattgaaatgggccagacagacattcatctgttctctcttttcataaaaaggaaaactaaaaagtgcttataatttgagatattgctgcccatttgaaattataaaaagtctctaaattaagacataactgcttatttctttcagttttttgaaacaaatcaagtaaactatacacagaagatacatgatcatttctctcatgatttaattttagacaatgccttttaatctttttatttcattttaagttaaaaaggccatttgccttctgtattaattattttgtttatcaagtcatctgtaattgtttgtagataatgataatgtattttgaaagcagctttttttttgttcctatataccccaaatgttacttcataacatttttattttatttttctttcttgatcttcaagtgaaagagataaagcctggtgcttccctttcttgtcagttttagaaattaaaggagagagaaaagaggctgaacaacagatgcaaggtcagattaaatgtctcattagagccttttatgcaaatgctgaaccctgcagtcttgaaccgacagacatttcactgtttgggatcctgatgagtcaagtagagacaaggtaagagtcatattggttatttagataaaagacttaaaccaaaacatagggctgagaattaggaccccgggggtgataaaaaattacatattaaaaaaaattatgtcataagtccacccgtggtgggagataactttcatgaagctgtgtttggtcatgagaagttgctagactccatggtggaacatacttaacatacgtccataagatacgtttacgcaaaggataagcaggatgttttctatttataactgtgtcctgtatgacagaagttttaaatgtgttcaggttttttaattttttttttttttaataaaaactactactccaatcactgtgtggcttctccaagcacacctactctttccaagagctatcactctatcagaggggcactgctgctcttctcacccacctacgggaggtcgtcagaggagggacactgaatccagaagcataggggccttgttcaatggggattcattcattcattcattcaatacatatttacaaatcactcaaactaaacactttcaattgaaaattgtgttatgtaccgcataccatgatggataataccacaacttggtacgtcatagagttatgaagattgataaacatttgtattttcttagtccctttttatttattcatatacattttaatatctgattatcatgtttgaatttcctttgattataatgttctttataaatgcaatacattaaaattagaagttagcagttgactttataagaatcattacaaaatttataattattcaaacaacacaagcaaataggtaatcatctatactaagctctaatataagttccaagacaggctaaatccagtatactgccttgtatttttttgtcccatctttctgagaatctttgtataatttgacaataatgtcaagtggaaagagaaataaatccctctttttcttttcctgcatgttgtacctgagagtgttttttccttttctgacactccttttgtatagttctttcagcagtagcaatttattctaataaataggcactcatcacatgatctggaaactactgatttcgtctcagtctgccacaaatacaattaagctgttctgtttccatggttagccatcctgttttctaaaataggaggtttctaaacctctccattttctacaagttaaaaactggagctattcttttttaattggttcttctgtattggatcaaagcatgctatgcaattactgatgctgtcatattggcagaaagaatacgcagaagttcaagctaacattacacatgtcatctttccttgaagaagtacacacagttaactcaatcaaagcaatgtaaagcttgttttttgaggcattgtttccaataaaaagatgaaattggccgggcatggcggctcacgcctgtaatcctagcactttgggaggcgaaggagggcggatcacgaggtcaggagatcgagacaatcctggctaacacggtgaaacctcatctctactaaaaatacaaaaaattagccaggtgtggtggcacgcacttgtagtcccagctactgtggaggctgaggcaggagaatcgcttgaacccggtaggtggatgttgcagtgagccaagatcgcaccactgcactccagcttgagcaacagagcaagactccatctcaaaaaaaaaaaaaagatgaaattaacatttttatcatactattattggatgtaaactagtgattataatgattatgaaatatatagcaaaatggatcagagttttacacatttagttctgttttgattgtttttcatatttaaaataataaagtgttgagaattctactaaagctataaaataaaaagctttcatcttaaaacaatcttatcattgtagatgatctgattttcataccgataaacatgccatgttacttcattgtcaatatattatacaggcaaaataagacaaaatatacgtcacttaaaaatttaaaaaatgtcttataggcttctgaaaatgattaggcacatactatcactttttcctgtgaaataaaaagagatagtctttaatatttagaatgattgttcaacttaatgccttctctccctatttacaaacactctgtgtttggaaaacacacaccttaagcaaaatgcaggtatatgtaaaagaaacagatcttgtttcaagagagaagatacgaagaaagcatttaaaacagtgaatgtcttcaccattactcctcaaatggagtaatggtgaagccggtgtggagggagtgtataaaatttttgtaacacagttggcaatacctgaatacttaaatatgtaaattgttaggataccttagaattcagtatagaaatgttatatataataatcttacataataaagtaatgcaatacataatatgtatgtataatcttaactcttatgaatgctttgtaaatataaccgattgacagccaaaacagtccttggagacagatatctcttctattatcccattttgcagttgagaaaactgaggcacaaaaggtagagtaatacgcccactgtcacagatccaacatgtcttaggggtgggatttgagctccggcaacctggctctagaggtgttggtctcgaatgcctcaatctttttgttctccatgataagatgtggcatcacagaaccctccttatcctctaggtcagataacttttactgtgcttaggattttaatgtctttctaagacttaaatgataatttttccttctcagcatgcatttaattttgaatacatcatgctattgtactctaagtcatgtatatagatccacagcaataaaaatactttaaaaaacttgtcataattacacattgataaagggatttcactgtcatatcatcattttcagaggctatcatattagtataatttaaaatatagtagtaaaagcttgaatctatgtgtctggataagactttctcaacaagagagattttagtagaccggggtacaaattggacaaacaaatgttagaaaataatgctgaagacaaaatatactcaactcacttcttatagcaaatgtgttaaaagtgtacagctcataaatttgaactcacattgttttgatttcttatactctttgaagccaggcttgacgtatggatgcatatttaagatgtgatcggcttcaaacatgaattgattattctgtttgatgttcattaacattaaataatttgagtggggcactgaatctgattgtgtttattttagtgtgtgttagtgaaaacagatttctgtgtagctgatctaatgtaggtggacagcaagtgtctgggctgtgtctgcattcccatcgttcgggcatggctgtgttgtcagctgctgactaatatgtcccttgagtgacaccacagttctgctacatgaagggaggaaaaggcgagttcattcttttgattttacacagtaaacatgccaatttcctcttaatgtatttcataggtaagcaaaataatgtaactgtcgccccccccaccccagttttagtacaaaaataattaaaactccattaatggttttatttggaaacagacatctgaattaatattttttctccattactgcagcaaaaaaagactctgagtataaattgtttaaaatgttgatgaggattatatcattaaaaaattgacatcatgttttgaaattgtcatttttgtaataataaatcatcatatatttaattttgaatttttttctagctataacctgaactttgcagatattatacctctgtagtttgaggttttgtttctgttttgtgtggtgtcctagagtggctgttgtagttatactccaaaaaagatgttaatgcaaaaatataatgcttataggataaggggtataaatagttcactttctttcccttcaggaacaagttacgtaaattcattattatactgaggcagaatgttatacataagaagaagaaaatggcaccagactaaatagtacctcttgaaatgtttcatttattttcatgttacggttacaatgtgaattgatcttccttcccttcttcccctaggaatctgactctatgatcagaactaatttttttcttccctttaagcatactgagggtttggagatagctcctatggttttcaaagtggtggattgatttaattgaccaaaacatagcagggagtagtcatctgattatacaagtataaaataatacagaaagggattttttatttccactgatacaattcaatcaagtttctttgagttgctgagttcaaacattaaagttaaaaaaattcttgatttataaagaaaataaaagttattttctaaatggtttgatttccaaggaacagggaaaaaatgaaatattgttaagattttctgaacaatgaaataaatattgagtattaaataaaagatataatatcttttaaagaacagatatcagttaagggctattaaaattacttttgttctagagttcttatcagaagctctaccaagtttttcagtgtttacaaacagactaacagaccaatttcataataattttcaaaaaaatattgtaaagtaaagtataaggtaacatgatgtgatttttaaggtcaataatatttttaccttaaagatgatgatgcgcttattaggaaaacagtggggtaaaatagggtagccgaaatgaaaccaaagattaaaaaacaaaataaaacaaaccccaagttatcaagtacttaaatggggcattatttcctttgagtatttttattgtcatagaatcagatataaattatgaaagaattaaaacgagaagtttttaaatttgttttactttttagggatggaaagattagtgccattctatctggttttcactttaaaatcgagaacatccctctgagcctttggagtggagagaactcactgtgtggatctcagatccctcttgtttaatttgcctgagtgcttcactgagcttgcaccttcctccacactgagaacaaaagcaggctactgaattaccttttgaagcactacctcctaacagaccccttggattgagaatatggcaaataacagtggctgcagccgccttaaaaacagaagagaatggagtgtggaatgcagacttaacctcagtgtgattttgctccagaataaagcgacatagctctaagtcaggacataccatggggcaagggagtgatggacaaagctaggaaaagagatgttctacacacacacaaagaggttcttctgagtgtggatgcttaaaatctcaagaaggaaaatgtttttcatctgtggtcacaaaggcacaagtaatctagtttaaaatatctagaatggaaagcagcctctgtatgggattagtggctccattatttctttttttcacagcaattttacatgagatctgaaattctttcctttgtaatctaaaccttttcagtttttagatatatcatttaaatatgaaaaaaaattcagggaaaagtaattttattgttttagtacaggtcatggaccttggagtcttcataatggccaggccacatggaaataaattcatagggaaaaccatgctgtaaggacaaagggatctggagtgggttgaggggaaggaaggtattaggtaaccttcactttttattctgcctaaggccaatactagtggtttcaatctagtgacatgcatgttagggcacattttagagcatgtcactgatagctgcctgaaacagccagtatttgcactgtcagataaaagatattgcctgcttcacagtaaagaattcccctttccaggttttaacaggacaagggacggctaactcagatgtatgagctttggtagtacctcagctggtccattaaaaatgtgcatgatgtttagaggcattttatgatttttacaagcataatgttttcactggaaacgtagcagttatctaaatgttcagggaaggttttcttccaggtattgttgcttgtatcctagaatgatttcattcataggtgcagtctcagaatgaaacatacaaatttaaatttgggaaatctattggatcctcttttatttttagggactttttttctcctgtgaataagaggagactgttgtgttcattctcttttttttttttttttttgctggctatgacggtaactgacactcagtaggtcttccctcaatatttgttgagtgaatagatgaaagtacagtggggaaaggaagcagggcataaacacaaaaacggataataatagaggtggtgttaatgacattgaggccaaaatagaaaatttgattctagtggatggtttatcgcatgatacatataatgggttatgaactggaaatcagagggtgtgaatttgcttttattatagtaggagagaggagctgatgagcattagaaaataatgaaaatgagtcattttcttacaaaatattatctttcagataatatagcatcatcagagtctttggatttagagccaaaagagccttatatgccatctaattaaatgtcttatttctaatgtgtatggggagattttctggaaaattacctatatgtgacctaaagtttttggaaatgccgtgtaagaagtttttcttttcatgggaactggaagggataaaaatctgattgcttttcttcagcaaagcataccagcgtccccattaggcaagtgattatgcagtgttgaaaggtattttcttgagaatgttatttttttccttttcattaattatgctttgtctaaaggttctttgtcaaagctctggctagtacttgaaattgtaattgatagggaataaaagaaagtaaaatctttgatctctctctcggtgttatgcaatatctttattcttgagatcaaaagactccgagtataatgctgaccaaacagaggctacagtactgattttgacagagaccaaggacaacagctatgaaagttaacggctatataggcatgaaatgacaaaatcaaaacaaacaaaactgtgagagtgcctctatgctaaacatccttgcatccttacataacataaacagacacattaaaataataaattcataaaataggtacacaatattatccataatatggatctatgataggtccataaataatattgttcaggagaagaggtattgctcttctaggagaaactataggacaagcatatttccaggaaggcatcaaaataaacatttattacagaaaatcctgaaggaatagcttgtacctattcttacagttgaaggcttctagggaaaactggtatctagaacacatagagttccttatttcataataaatgcatcatttattaacattgctccattccctgtatcacttgaccctaagagcaattatgaagttaataaagtttatctttgatgtaatggacatccctttctattctccccagattctttttgtctcaagtatttatttctcgtcatatggcctaaagacatttctcttataaggactgtgcattggtaaactaactctcagaagacttaaagtgacatcatgctttgccactctgggaattatttgaatttaaaatacccttaaaaagataacaaggcttgggcatgatggtgggtgcctgtaatcccaggtacttgggaggctgaggtgggagatttgcttgaacccaggagggggaggttgcagtgagctgagatggaacgattacacttcagcctggatgacagagagactctgtctcaaaagcaaagcaaaacaaaacaaaacaaaagaaaaagagtaaggcttaacctaagaggtctgaaacctaagtagggagagttatcatggggtattgtaaccaatggtgctctcattcagttaagaccatgaaggtacataaatagacacatcatcggtggtagttttgctgtgtgattcctagccactctcacaaaagcttcccctgtgtctcctgtttaaattgaaattagcagtatctggtacttttctctagacgtagtagaaatacttagatggcagaggatttctacttcctttcagtattacattgattcctgacatctttcagtcagggttctttgattaaagttgaatcatctatcattttattctatttttaattgctttgctttttctaataaatatatattcccctcttttaatgatatcatgaactttgaaaatgtttcttcctttgtccttccaaaaattaacttatttcagtagggaaggctacaaaaatattggaagagtaattatatatatatatatgtgctgatataaaactattttatcaaaaccaaaacgaaaacgaacttgaaaatcaattatataggaatatgcaattttagtataagaaaataggaagtcaaaaatcatggatcattacttaataaaacaaaatagtaaaaatgacaatatagtttttttggatacagattcccactctgttgcacaggctggattgcagtggcacagcaatggctcactgcatcctctacgttctgtaatcaagcgatcctcccgcctgagcctcctgagtagctgcaaccacaggtgcacactactaccaattttttgttttttttctttagagaggaagcctcactctgttgcccaggctggtcttgaactcctaggctcaagaaatcctcctgcctcaacctcccaaagtgctgggattacagacaatatacttctaatttatatttgcaaaacatcaaatgtaagacaattagaaagtagaaaaatcttgatgagttttaaaaaattataacataagtttcttaaaatgtacaatatatgtacaatattaagaagtagtaaaaaagtcatatttctgactttgtgaatcaaagccaatgtattcaacttgcattcttccccattttgcatataggtatttctccggccaatgaaaacctacaatattcagatctacatggcttactgaatattgtctttccttttgtcctgttttacatatgtttttatagccccttgtataatttctatttagaatctcagttgaaaaactgaaggggaaaaagacagacagatggacacgcccccctatacacacacacacatgcacacacacacagggagagagagagagattaaatatgaatatggaggtgaacataggcaggactggcacatgacaggtatttaatgcatcatttccttacttccatatttctttccatcttccttcattcctactttccctgcttaagacattttcaataaaaaaaaactttaacatttaaattgggtcaacaagacacatcatgtgcacatagtttgggtaataataattaacttcacggttaaatatgacatgatatgatgacatcagacatgtttattaagatgttgtctagctatccatctggccacaaactgagcttactttaccagtcttcaaaagaattgctcaggctagaaaaatgttaatttccctgtttatgttgcttaaaccctgaaaagttatattctaactaacagtattaagatctaagttaatgattctatctacaattataggtaattattaagtgcttaatgcaatgctcagacatggtagatctaacaaatattctcactgttcaatttctcaaaatcctattttactaaagatcacacacacgcatacacatacacatgcactctcacacacacatgcctgataatgcagaggaaaaaacatatttgtagtgatgccagtggaaggactgttgcattaatttttcactcatttatatacacgattcagaaaatcaataaactattcttgtttgttttctcaaagtcttcaaaacgaattaatgcatttcaaagttttggagctagccttgcatatctcttttcctgaatgctcctgaatctttattccatgtcagagctttgatgaatcagttacatgacagtgaatgccatttgctgatagcaaatgaattcaaatagccctcaatccatgtaggacaagactgtcgtatacttcttggtactattccttgtgttataaaattgaggtaattgagcatttaatatcccatttacaattttgtgtatgttgatgacacaccacagccgcaggaagctattaaagtgcatagacaggtacatacaccaatcaaacttttgccacagaaaagcatctccgtggatgaaaagagtggcgactttttattttaaattatgacagctctgggcagcactactggcagccaactcacagaactaatttactatcacctttgtgatagaaacagcttgatctaaaatttgttaactatgtaaccagttggttaacatgctgtaaattggatgttcagttcttatggaaggaaattcacatttcatttattatatttttatgtcaattatgtcgaagaaaatatttctcttcctatgcaaataagtaatctgatatatttttattcccccagagaaaagtataaaaatggaactattgccctgtagaatattcaagaccatggtgccacttattttatactgcaagtagtaaaatctgacatggtaataatatagatagtaaaatctcactgggatggagggatcaagggagaaatttcactaattccctaaacttaattattcaagggtatttgaagaaaaaaaagaagatatttaatatttataggactccatggttccatttcattcagtggagcttacacaaaattttgatttaagagcaatctgaactagtcaaatagtagactgtactgtaaacaatatgctatataactgtttgtatacaatgaagtggtaatattggttaaacattaaatttacaagaaaattagcatcaggcagatggcagaaggcaactcttaagtaataaacacaattgtatatctggttgcacagaaagaatgaaactttgataaacacaaattctcttctgttcattctgcaaaatttcacaactgtaatagaatgtaactcctgaaatactacaaatgaaattaaaatttgaaaagccacatccatgacttacagttcatctagcaagcagtccatacattgtttcattgcttatcaacaaatgagaaagctataaatgcccaatgcattttgaaggtcaatttttatggtggcataattttaaactagctcatcctcagtggcttttgtaataaaaagggataaattaatggccccttaactaaagtgaacttttgatacggaaacaaaaagaatattaagcatgtcctattttaagtagaaggattaagagctttattccatgaaataaattgggcaggacctaagattcaagactttgaattggtttctaggacattaacataaggagaacaagagaatttgacattgctagaaagaggcacaaaaggatgtagtatctgttagaggaaagattttcacactagctgacagtaactacaggacgtatggtggactgaagtgtttttctcagtttaatctgtgtcttcaaaaggcggcctcaacccttgggccacagaccggtactggtccatggcctgttagggacgtggctgctcagccggaggtgagcagcaggcaagtgagcactgctgcctgagctcagcctcttgtcagatcaacgatggcatttagattctcataggagcacgaaccctatggtgaactgcacctgcgagggatctaggttgcgcactccttatgagaatctaactaattaatgcctgatgatctgaggtgaaacagtttcatcctaaaacatcccctcctgtccatggaaaaattgtcttctatgaaactggtccccggtgccaaaaagtttggggaccactgttctatcaaaatatcttctcctttgtttttccagctttattgaggtatgatcaataaagaaacaacgtatatatttaaggtataaaagtgatatattgataaatttgtacattgtgaaaagactacgacaagttaattaacacatccataattcacttagcgacctgtgtgtgtgtgtgtgtgtgtgtgtgtgtatggtgagaacacttggaatgcattctcacagcaaatttgaagtatacaatatatcattaactagtcactacattgtatataggtcctcagaacttgttcatcttataaatgaaagtttgtactctttgaccagtatctcctcttctctccagcccccagctcctcctaatcaccattctcctctctgttaccaagaatttaacttttgctttagactccacatctacgtgagatcacgcaatatttgtctttctgtgcctggcttatttcactcagcacaatgtttgtcagattgatccatgttgtcacaagtggtatgatttccttttttactaccgaataatattctaaagtttctataccacattttctttaccaatttatctgctgaaggacacgtaggttgtttatgtatttggctatcatgaataaatgttacagtgaacatgagagtgcaaatagctcttcaagacactgattttatttcttttgaccatatacccagaagtaggattgctagaccatatgggagttttatttttcatttttaagaaacttccataatgactttactaatttccattcccaccagcaggacaccagggttcccttttctctacatcgtggtcaacagccatcctaacaggtgtgaggttctatcacattgtcatttggatttgcgtttccctgatgattaataacaagacatattctccttgccaaaattacaaccagaccatttttaaaataactttaacctatcatgttccaaacaaaaaataccatcctctccataagtggctatggaaattatttcttcttttctgttctttccctttttatttgtgctcacatctgacatatatggaggctagctgcccatttgtatctttgcccagtattacttcaagcgtgagtgttcatcttactcattttttaaaaatatattttgggagtccagcagaagtcttgcatatagcatgtattaaataaatacttgctggctttaatttggtttaatgttgccaagtgtctttgccaatatattgccagtcactttcacttgaaaacctcagcttcgatttttattatgtcagtttctctactctcttgttatgtaccaaattctaatgatattttaagtcagttctattctcaccaaccagccttttcttttaacacatcggtattactgcaacactttctagctgacctccttgcccaacctaaggttcttctaacttgaaggcattctatgtacaactgtggtactgaatagccacattacttccctgctcaagcattatataacgagtcttcactacctactgcatcaaagtgtaaaattatttcccaaattttatacccccataatttagttttttatttttctccaactttatttttcattatgctgaaatattttcttcgttaaaaatctcatttattgattcaacaagtactttctttttttttttttttttttttttttttgagacagagtttcactcttgttgcccaggctggagtgcaatggcacaatcttggctcactgcaacctccgcctcccgggttcaagcaattctcctgcctcagcctcccaagtagctgggactacaggcatgcaccaccatgcccagctaattttgtatttttagtagagacagggtttctccatgttgatcaggctggtctcgaactcccgacctcaggtgatccacccacctcggcctcccaaagtgctgggattacaggcgtgagccactgcgcccggctcgacaagtactttcttatcaccagtaatatgacaagcactgttttagattctggaagcatcacaaagttcctgtatcttttttgaaggtggtgatatgggtggctataaaacaaacctgttctcacagagcacacaatcaattgtatgtataaaaattactaaaatatgtcaagtggtgataagtgctatgaagaaaagtaaagtatgatacaaggacagagaataatggggacatggagggttttattttatttaaagtgctcaagaaaagcctttctcatacttcaatgaagggagaaacaaaccatacatatatctggttattaaacttttcatcgaaagagaacagaaagaccaaaaaccctgaggctggtttatacttggctgttggaggaaaagcaagtggcgattttatggtggcttggattaggatagtagcgacaaaaatggggggaaatgttaaaggcagctacaatttttaaatttgcctattggcagtatgtgctagtaatatattacatgtccgggccagtacagggacctcatcctttcttttcaattagcccaattataattgtgatgaggatttctggagaaaagtaatactatgctttaatgattctaaggtctaaaatataaccaaattgcctgtaagatataagcaatgatcagaaggtgttgttcaataaccaactatcatggccgggcgcggtggctcacgcctgtaatcccagcactttgggaggccgagtcgggcggatcacgaggtcaggagatcgagaccatcctggctaacacggtgaaaccccgtctctactaaaaatacaaaaaattagccgggcgtggtagcgagcgcctgtagtcccagctactcgggaggctgaggcaggagaatggcgtgaacccgggaagcggagcttgcagtgagccgagatcgcgccactgcactccagcctgggcgacagagcgagactccgtctcaaaaaaaaaaaaaataaaaataaccaactatcatataaattattcggccctttattgagtatattccatttatccagcagtgtgatttctggctgtctcagttattcagtatataggctcagatcagagtaagcagaagaggactttgaacatcagagagcagtcagaactggagaatctacttgcagatgagggatttattacaggtctagtgactcattgctgtttggtatctcatcctccaggggtcctccaggtggtctgggtttgttgtgggatggtgggttctgggcatcatactttctccatggctgctgattggcctcagagccagtgttccaaggaaactcaaaaaaaaactgcagggtctctgccgacctcacctctgacattccacatcactcctgctgcattctgttggggaagcatgtttcataaatagaaattggactctacttgtcaatggaaggagtaacaaagaatgtgcagtcatctctaactggtcacacagataatgcagaatttaatgttaatgcagtagaatataattattacatacgtgaaggtgcttttaatgtttctgagaacaagttaaagcatgttcaaagaactgtttcactaaaggaagcaggctatcacatatttttaaaagattttcattgaaaaatttaaaagtaatctttaaattctcagttatttattaccacgtacatatatatgtatgtgtatttatgtaaaaatatatatacatatgtgtgcatgtctatgtagatacacacacaaatatatatggtatatttatgcaaagatcccactgataaatacatgtatctattttatttattaaatttattatataactaaatttaaatttctaaaaatgtagtaaaatttttattattgaaggcccaaagtaactcaaactgttaacttttataatcgaatgcatatttttatcttgggattgtttaattttaaaactatttattcaaaaataaacatataaaaataatagtaaaactcacacattcatactgtttgtttctgctgtaaaacaaaattggaaacaacaggaaattgattgcctaaaggaaaacttaaattaaatataatagcttaactattatgtgagcagtaataaagttgaaaatgcatgccctttgttgtaggactttgagccaactgttattttcattgaataatttctgatttatttatctagtcaatccgaaatcagcagttatccttagaaatatgtcacatattctattatctccaagcatgaattatcagatcttagagaaatttccaaatagaaagctatatctatgaaagtcaaagtgaatcgttaatacaggcttccattgtctataaacaatgatcacttgagaattaactgttcattaacatgcttcatttttgaagccaacagtaaatattatttaacatgaaaataatttttcagttttacttttttggatcctagattcttgtctgatttttacttgtgaaacatatccctaacccagaaagtatcattctatgcatgtccaaatttactatgaggggtaaatgaattaaagtgctcccagagggattagaacctgagggcaatttcttcttctttttcttcttctatttttttttttttttttttttttgacaggtctcactctgtaacccagattggaatgcagtggtgcgatctcggcttactgcaatctccgcctcccaggctcaagtgattctcctgcctcagcctctcgagtaggtaggattataggcgtgtgccactactgcctggctaatttttatatttttagtagagatggggtttcaccatgttggccagcctggtcttgaactcctgacctcaaataatccacccgcctcggcctcccaaagtgttgggattactagcatgagccacgatgcccggcccccatttcttcttgtagaagaatagattacatcaacctgaaactgctttaagagtcaaaatgatgcagctattcttgcaatgttgggtgatcagggtgatgattgtaatttacttttgaattttcaaatgttttgttgacctaaactataagtaaagatgcactgctcagagaagccagtgaatatcagagtagaaacacaagcctgttatctcatgcccggaaaaaaagtaagaattaagtatgttaacttcttagactataacacacatttaatttctcactgagtattagttttccatggtgcatgtttttatgtaaggagaggaaaaatccattttcaaatccaagtcacatttctctcttagtaatcatattattaatatcagttaaggagtattttatttaaggcaacaagtgttaaaaaataaattcctaaaggtgtcatggctcaaacatgatagaaaattatttcttgctcatttacaaaactggtactttcggttggtaactcttttcaaagcaataattcaaagactctagctcatttccccaatgtctatggaatcctcatcattggcttctaggatcaccatgcttatctgtactagactgaagaaatatggagaattgtgcctggaaagttttcaagggtcagtcctggaataaatgcatttatttaaaactcagtcacatgaccatacctatctgccaaggttccagaaaatataatcctgatccatgactaggaagaagataaaataagtttgatgaatagttacccagtctccaccatagcagaagaagcccattctatttgagattcagagatcggcaaaataaactcagtaggcaagaggcatagagaaggttggaagtcctatagcagcttaattaaagcgccctggccgggcgcggtggctcacgcctgtaatcccagcactttgggaggctgaggaaagcagattaggaggtcaggagatcgagaccatcctggctaacacggtgaaaccccgtctctactaaaaataccaaaaatgagctgggcgtggtggcaggcgcctgtagtcccagctactcgggaggctgaggcaggagaatggcgtgaacccggcaggtggaggttgcagtgagccaagatcgtgccactgcactccagcctgggcgacagagcaagactccgtctcaaaaaaaaaaaaaaaaagcatccaatcagtctccaacactcaagaattatttgtgagattcttatagaactaaaatctgtcactagctagttctcctgtcttctttcatggcacctgagagtttgaaaaataaaaggttatgaattgtatgcatgccattttttttttctgtattgtatgcatgaaaccatcaaagatggaattctttctacctgtagatatccatttctcctccaagagatctcaggtcccatgacaatgtcaccacttctgctcctcctctgcaagtgtaatgaagagggtatttcagtggaagcaatgtattactttccctctcttggattatgacttgaaagaataacattcacacatttgtgaacctgttcatgccccacttcagttatcagtattattcctcattgcttccctgcacatgtaggttaatatcctcactcaccttttctattcttgcaccccttccatgcaggcaaaatgttatacagttttcaaccctcattgatcacatcccaaactccctccactttgatcacttgtagtagagtcagtgtctctcacccataagactttgagttctcattaaactgtgaagtcagagcttattacatttttatctttgcatccctagtacctagcaaaatgtctgccagtggccaaatgctcagaaattactggtaaatgatttgaagatttccactgactatgctggtctaccctgttctgaacttcacatcaaaacctatatgttgagagttttcattatgacaaaaatatactgtggtcaacatcttgaatgtagtgttagttatgatgatatataccgtttctaaaatttctccatatgcacattgaaaatgaatacattttattacatgtaaattcttaagagatgtaattttaaaaaagagctactgaaatgctaaacaagacagaaaaatgtccctcgagattcttgctattgagctgacgaccaaattcaggcacttgcagagtagttgaccttctcttaagaaggagccctcctctgtgccctcactataagaaggagcctcccaacattagattttctcttgaagagccctttggactgttgttctgtctgagagctactggagaatctctttgatagctttgcttttgacggttttctctggagaaaggtctaatagaagcaaacagttaaaacccttttccatccttcacgttttttaaaaaaagtctcccttttaatatgattttctaactctgtagcttctttgtgtcattttgttcctacaagtgttcatatatacttttaggtcacatgcatttccacacacaatctgaatgtttcctacaccatagagaaggtgttagagactggatacttatacaatgttatttaggggtcggggaagagggagactctattccttaaaacaaggaacacaaaattaaaaatataaaacatgatataaaagtaaatattggccagggcgcggtgacccactcttgtaatcccagcactttgggaggctgaggtgggcagatcacctaaggctgggagtttgagaccagcctgaccaacatggagaaaccctgtctctactaaaaatacaaaattagccaggtgtggtggcacatgcctgtaatcccagctactcgggaggatgaggcaggagaattccttgaacctgggaggcggaggttgtggtgagccgagatcacaccattgcactccagcctgggcaacacgagtgaaactccgtctaaaaaaaaaaaaaaaagtaaaaacaatgtaaatatttatctatagtgagacaagtaatcaaaaccaaaatatggaggcttggagatataggtccctttcttccaggagctctcggtaatttactagaaatgcttccacagaaatacttttgatttaaagatagatttttctttcacccagaactttctctaagttctaccaaattatctcaatttgattgtaatttaaatggaaaacataaaactacaaacttttagaatataacatcgaggcacatttttgagccccagggcctgctgacatgttcttagacatgataccgaaagcataatccataaaggaaaaaaaaaacagaattaattggactttatcaaaactaaaaatatttcatctacgaaagtaaaaaatgtatgtatgcacaacaatctgtacatgattgttcacagcatttctatttttaacggccctaaactggaaaaactaaaatactcctcaataagtgaatagttaaacaggttgtggtacatctatatcatgaaatactgctcagcaaaaacaaaagaagacctaacaacaagaagaacaacaaaagtgttgttagatgcaccaacttggatggatctcaagggcagtatgctgagtgaaaaaagccaatctcataaggtcacaaccttcttgaaataaagacaatacagggattggaaacagattagtggtggtcatgggttaaccatggctgtagtgcagggagaggatgggtctgagatggaacagttttgcatttagattgtggtagtgcctataccttacacatgtgattaactgatataaactatatacatatattgtatcaatgtcaatttcctggtttaaatagtgtgctatagttacgttaaatgaattcatggcagaaacttgatgaaaagtacccaggacccccctgtctttgcaccttctagtgaattcataattatttcaaaataaaaaatttaaagcttaaatgttagcacttacacaagtggattactttattacttctgggatatgtacaaatttgggtcctcttagtgtctccatgattttacatgaggttgttctaacataaaaaaaaaaaaacaaactacgtaaagagtgtttttaaaagtgagaagaaactactgctagtttgagaaagggctagatcctaatcagtaaatagaaaatcagttaacattcaaatcatgtttaattattttatcttggaatgcacacgattactgttttattttttactttttagagacagcgtctagctctgtcacccaggctggagcacagtggcatgaacacagctcactgcaacctcctcatcccaggctcatgtgatactccaacctcagcctcctgagtggctgggaccactggaatatggcacatacctggcttttttgtttgtttgttttaatttttcttgtagagatgaggtctcattatgttgcccaggctggtctcaaactcctgggttcaagcggttctcctgctttccagcctcccaaagtgctgggattacaggtgttagccaccacacccagcctatgattatgattttattcattagtctatgtaccaatatttaaaagaagaatttgtatcttgcatgtgtgcacaattataccttacacataaatgagtttgaaatggtaaaacggcaaacctctagactatgacagccaaagacaggtatttgatccttgaaaatagaaaataatataggcaatgacttttgcaaaatagtgagatatttccaggtaacatttattctgaaggatttgctttcctatcactgcaaagatggccttttcaaccctctcaccatcatctcatttgctgagatgagagagaggagagaggggacaaatggatatacagatatatgggggctgggggagacagagagaaactgtgttttctggggcaggcataggtaacatttacagatacctgtccaaagtacacacatatatttctatagtcctagcattgcacacgtattactctaaaatgctggcattttctgtcaatctgcttggtagcaaatgctgaggaacaaaccaatcactggatctaggagccaagaactaacagagactctgtgctttatgtgtgagcatttaactactgtagatggagacctgcacgtatttaaattgaatatcagtcctgtgtaaagagtgattattctgatgcttctccgcatcagatataaagttatatggagtccaaagaccatcaatagaggattactcgtagcccatctaattttggaaaacaatagaggagttttctggtgtgaggtgaacagcctgctgttttctttgcctggaatgcattttcctcctcttccatgcttcacctccactccccttacctagttaatacccactcatggctcaacatttgctcagctggtgtttacctacgaagccttcttattccttagatgaaaataattaccccatgttccactgcccagtcagagttaaacagaacttctttttttttatttttctttttaagaatatagagtctttaatgtggtcagaattaagttgctatcagtttaaaatagcctgttacaagtgtattttatataagcctcatagtaaccacaagcaaaatctatattagatacagaaaagattttttttttaaaaaaggtttcaggccaggcactatggctcatgcctgtaatcccagcactttgggaggccgaggtgggtggatcacctgaggtcaggagttcaagaccagcgtggccaacatggtgaaaccccttctctaataaaaaaatacaaaaattagctgggcgtggtggcaggtgcctgtaatcccagctacttgggaggctgaggcaggagaatcccttgaacctgggaggtctctctgtctctctcagtcattatctctctcttcttcaaacctgtaacaaaactccataaggaaagaaatttcattgtgtttgtatttgtctccatagaatctagtataatgctatgtgtacatatgtacacatatgcgtgtacatacgtgcatgcacacacagacttacatacacagggcttgcagaggaataaattctgcttttaaattttctatttaaaaagatacttcaaaattcccttcaaatttgatgaaaccaaaagtttgatttacccagacgttgaggttttttcttttatgggatatacaattattccatagtgacatgtcctaagataattttcatattcatagaggaggctgaaggtaggattttgtgaatctttgataatagttacatgaatgttgaatgtttgtatattgaacttgcatattctattaataccatctctggaaatagggtcatttggttataccaagttttttgtatttacatatttcaagaatatctatttaaatatatgtaactagagctactggcagataacttaggtctatatggaaattatgaataaacaaaagtagatgtgaatgaagccaagaaactcctagtgatataacatgaagtctttactcaagctttgtttagaaccagtaacaggggattttactcttttcgtgcaatggtccatttgtcagtctaattaaaaaaaaccacaaaacaccctcctcggagtaatataatgttattaaatacataaaatgaaatacagcggggcatggtggctcacgcctctaatgccagcactttgggaggccgaggcgggcggatcacgaggtcaggagatcgaaaccatccggctaacacggtgaaaccccgtctctactagaaatacaaaaaattagccgggcatggtggtgggtgcctgtaatcccagctactcagcaggctgaggcaggagaatggcgtgaacccgggaggctgagcttgcagtgagcggagatcgcgccactgcactccagcctgggcgatagagcgagactccgcctcaaaaaaaaaaaaaaaaaaaaaaagaaatacatagggttgaagagagaaatgaatcatattgaaagccaattttaactcaggagacaggataacctttttttgtttgttgttgttgttgttttttttttttttttggttaagcaacttggctttcctaacatctaatacttttcaaagttttccatatttgtttgctgcttatgaaaaccaaattaatgatgttttttcctgaataatctcatcatgaccttattcttataatgaaagaaaacagaatgctaaagctagggttgacagataaaatatagaacatagcttaattgaattttagataaataatttaaaaatagtataaatatgtaccaagtattgcatgggtcttactaaaaatttgttatttatctcaaattcaaatttaaatggacatcctgtatttttatttgctaagcaggcaacccttcaaaaactggtctaggttaacaaatgttagcgataaaattgccatgatcatgccctaaggaagtagaatcggatctactaagattcttattttatctccgcctgaaaaatattagccttatgggttggtttcagacctgtccctacatcatattttatgagttttgggaaggcaaatatttgctaaaataagatttaattctgtgctttaatgttttattgatgataatataaaagtggtaataaaagaatacttcacttttgcaaaaggcaattgaatatactgactgatatttttccagaaagtctgtctagttgtagtgacaagaagaaaatatctcttcctagattatctattgaaattccttttatcagcaagaaagtgtaattcactacgttttctcttttgcctttctgcaaaaggctaagagttcagataataatgtttaatagttattaaagtgaacttatctatccttttgtttaaacattttgatacatgtccgcattttattttcattttaactatcttattttattcatgttatttttctaagcctgatcaatttttacagaatgatcagattataagtcctaaatgaaatgccactaatttgaatcatattcagaatgtaatttgttaagtaacaaattttacaagaaatgtgatagatcatgcaaaaattataggtcttaaatcctacatatctcgaatcaaattattttaatactaattttcattgcaattaaaggattcagtaaggattgtaagtactttccattatactgaagacttggaacaagttctgattattacatattttagcatagatgacaggatgcatgcaatgtatcagcatgtaaaatgaaggaaagatagaaaaacagttgcgacaattttgtgcagtagtactatcgtgctgctatacaagtaaaacaatttaatcacacataacatagtaataatgcttacttattgctagaaaaacaggattttaattattttaatgataaatctgctttataattaggcagaaaagcaagctgtgaaaaagcaactttagtatttaattctagtgttaatttcaaaaacaaaaacaaaaaaaacccctgaaaaacaaaagaacacaaagacaggttgaaatgttccttttagggtattacatgctgtacagtgctttgtagtttaaaaagttttatgcccatgcctgaatgcattttgattctcaaagcatcttttggggtaggtttggcaggcactattgttcattcctacaaatagtttaaaatttttaagaaaaacattttagtactttattgaaaatcctatatttgcagccttcattcttaatgtttgtagcacattgaattttattgattgtaagacaaatttatttcaactggattgttgaaataaactctaaataactctaaaaataaactctaaaaatcatggtcacggaggttgagtcagattatgcttgccatttacctgtgcatgtgcaaacctcaaatacctcagccttaaaacttggagaatgagtgttcctgtggaagattattcttcagagatgatagtggagtactcttgaaaaccctaggtaccaaattgctgcagaagtatttgaaggacctggtgaatctaatatgttttaccaacatactacaagttgaaatcaaaagttgactgctcgtacataattgcaaagtcagatgtcagatgccaacatcaaaagctcttcaaaaataccacataaccaatgctctttgtaacccaagggatgacactgtgtggaaaagcacaaacatcaagaactctaaacctaaaagtgatttagacaagttaaattccaaatgtgaagtaattatagactgttaatatatttgccttataaatttgtatgtatatgcatgataaaaatctatcactaattaagggtaaaaaacttgcaacaaaaataagctttctagatattaaaaagcatatcatttaattgaatagatgttttccttcttgttacacagaataaggtgtatctatgtaataaagacgtgtaggatttgagtaatgctgtgctaaatacttactatcttgagttctggtttggagctatattgtcccatttatctgtctgtcaattcttatgctagtaccacaacatttcaattattttatgcctgtaagacatgctaacattttagggtaagatattatttctctattattcttcatttgcaaaattcgcttggctattatttcatattagtttttcaaatgtaactgcagaattagaatgcagaattgcttctcaagcacaccacactgtgcagcaagtgaaactgcactggagtcatgagcaataggcattttccacacttgggatctagaaacacaagatgcctttccattttttctgtttttcaaacgttactgtgtttggtaaagaaggttgttttttttttgtttgttttttgttttctgctctgggctatatatctttcaatgttaactttattctctaatagattatttcttctgcttattgctgaaagatgaacaacaaattttatgaagatttgtgtaagaatagtggatgaaaattttggtagatgttagcatttgcttatttggaaacacacgcttagagaacattcccactctgaccagactagaaatctgaggtttgacaagagtgacttaatttcacaccttctctctctgtcttttttttttcgtgtaaagaaaacagtcatcagcataagatttaaaatcttaaatgtacaatatgtttgactcatctgatacgttccgcctttgctgcaatggccttcaatacagtaaaaataaccacactcatgcgttagaatcatctgtgcaaactaaagtatatggcaaaattttaaagaaatcaccaacttcaattaatttattttgaaagaaagaaaaggaatttgcagtaatacttgaaacatttaaaatgaggattttttaaaaatatgctattaaaaatatgaatttatttaagacaatctgagatgactgaattataaattgtgtaaaaggcaatttagaatttttaaattatcaatgtatgtaaaatataggatatttcatttgttgcattgttaaattattgcttattttttaatagcataaaataaagtaaaggctatgttttagaccaatgttagtttttactcttatctatatataattggtaaatggagaaaatgtcagtgagaaatctaaaatcaaaataagatatgatttttaaataaattgtacagtaatttttctgttgaaattatgaacaatataaatattttatcatagttttctgtagttttcaaaatatcatatttgtggatataacccctgtttaatcataaaaaattataaatgactaaagataaaagaggaaaggaaatagagaagaagctattgtaaaaagaattgaaaagcagtgttttcctgctatttaactttgaaacagaaaactttttttgttgcaatgattcttcactacaataccaaaattctgaagagaatgttttcaggttaccatatcaccaaatcagcatagccagagaccaaacagtgagctctaaactatctttactagatttgaaactccagcatattatatttaccaaggtaaattatccctcttatgacaagtttttgttatcctaactgataatttagaaaactaaaggtcatttagtgtaaaaaacatagttgaaatacaattactttctcatatgtatcttaaaatgatatttcaaacttccttatgcagtgttgctatctgttaattctcccatatatcttattgaactagctttttttttttttctttttctttttttgagacacagtctcactttgtagcccaggctggagttcaatggcatgatctcggctcacttcaacctctgcccccaagttcaagccattctcttgcctcagcctcccaaatagctgggactacaggcatgggccaccatgccctgctaattttcatatttttagtagagacggggtttcaccatgttgggcaggctggtctagaactcctgacctaagggatcagcccacctcggcctcccaaagtgctggattgctggcatgagccactgctcccggccaactagctttaactagaatattatcttcagcctggcagttaaacaatttagtccagtagttacataccttaagaacatttagagaaaacaccaaaaaattactaaaaattctggtaaaattaatacccatgactagagatatgaaagtctggcattaactaagttgagaaagagctgttggaacagtctggagaataatatgaaatgttagaatgcaaggtcaatgaacagatggttctgcatttttatagctaacactactaattggaatggatttaaaatttagcaaacagagttcttcaagtgcaaattgttaagaaagagaggcatacattctttctaagtggcttggtggttgtacttgattattatggactggatgtggactagataataagatataaaattgacaagagataccatggcctgataatggtactcattttttatgtgtatgcataatttaagctatgtttttcactcatatgttctaatcactttgcattttttctcctgtactgtgtgggatttgagagtcgaggtgaaaggaagaacccaaacaaagagattgttcttaaaggcatgttagggtcctttgggttaattatacaaggtttgctgacagcgcctgataagaccgttgaggtcattctgttgttgacgtctcttcaatctcaatacgccactcagcaaaggccaaggcagatagagcttttccactatctttatagcacaaaatgctacgctgaagagagaaaacacacactctctctctcattcttacacccacacaaaacctgagaagcccaaactgccacacactttgttgatgacaaggtcagcatgataccttagaaccattcatttctttccactccacttcactttcaatatgcaattttaaacatcataatttttaccaccagaatgttacaaaaaatgtctgctaattgctttgtgtccaaaaaagaaaccaaaagaaaatggtattttgctttagacactaacaaaatgtaaagggtaaatgaagctatgtcttagtagtatggcagaggcagaggagcagggcaagaaacggtatgtaagacacgaactagtcactagtctcacagttctactgaaaagtgagctttatctagttgatgacatcatgcagccccatgaataataaatgaatacatatttattgagtgcttattaagacctccgcaaagctctgcctctgtataaatgagtgagatgaaagcactgttctcacaggaaggttataaaggagctgggggaaacattaatgcaagacacagatcataagagagaaacttcatagtaaaaacgataaagaacacatgagttcttccagagcaggggtccccaacccctgggccgtggacctggtacctgtagtggcctgttaggaaccaggctgcacagcaggaggtgagcagcggtgagccaggaaagcttcatctgtatttacagccgctccccattgctcacattaccacctgagcttggcctcctgtcagatcgtctgtggcattagagtctcacaggagagtgaatcctattgtcaactgtgcatgcaaatgagctgggttgtgtattccttgtaagaatgtaactggctgggtgccatggctcatgcctataatcccagcactttgggaggctaaggtgggtggatcatttgaggtcaggagttcaaaatcagcctgaccagcatggtgaaaccctgtctctactaaaaatacacaaattagctgggagtgattgtgcatgcctgtaatcccagctactcaggaggctgaggcaggagaagtgcttgagcccgggaggcaaaggttgcagtgagcagagatcactgctctccagcctgggtgacagaagatcactgctctccagcctgggtgacagagcaagactcggtccaaaggaaaaaaaaagaaaaagagagacagagagaatctaactaatgcctgatgatctaacgtgggacagttccatcctgaaatatttaccctacacccaagtttcatgggaaacccatccctgctgccaaaaatggatgggggctgctgctccagaggaccgatagtgcatgaccattaatctgtgtcatgggagaataaggtttttttgtttgattgttttttattgttttttattttatttttttttggagcccccttctgggcaagaaagaaagggatcgatgaaaaatatgcctcctatacagaaccaagactaaaagggtcgaggtggaataaaatgttcctatagttcgtaagcagccgtagtttggagtgctttggcatgtatcaatggaaagccaggatagtgtggttaggaatccatactctgtaaaaaaaaaaaaaaaaaaaaaaaccctgcctgtgccatttggcatgcttagttcaattattttgaatgctataaaaatagagatggaggagaaaaaaagatttcaaagtaggaaatgaaataggaagaatgttcaggcagagattgaggcaagaagggagtagagcccaggcagatcttatcaatgtgaatcagtctcaccataagtcctaacttccctgttgggaaagcaacagctcaaccagagaccagaatcataggttactgaaattgaagggcccagagaagtcatcttgtcaagcttctgcatcttttttatctcatggatcctactgactggtcataccctccaaaattctgagatttaaaaaatgcttacaataagttatttttctctgttaaatttctcagtcagcattggctttttttatttgtttgtttgttttgagacagagacttgttttgtcacccagcctggagtgcagtggtgtgatctcagctcactgcaacctccacctccctgcttcaagcgattctcctgcctcagactcccaaatagttgggattacaggcacccaacaaaacaccttgctaatttttgtatttttagtagagatggagtttcaccatgttggccaggctggtattgaactcctgatctcaattgatccactctccttgtcctcccatagtgttgggattacaggtgtgagccacgcattttcttctcttgtttctttcaaagtgaaacattacatgcccaccacaggaaattctttaaatgtgaacttcggaaattctaagaagcctgcatctgaaacagttatcatcagttggagttttattaacggccctgcgagactaaacaaaaatctgtgggcctttacagctagttcagagaactgggaatgagatgagttgtggttgctaaaaacataaacttactaccactctatgatattatttttccacactggcttttaataaatacgaagccacaggctgggcgcagtggctcactcctgtaatcccagcactttaggaggcctagtgggcgagtcacctgaagtcaggagttcaagatcagcctggccaatatagcaaaaccctgtctctactaaaaatataaaaaaacaaattagctgggcatggtggcaggcaccagtaatcccagctatttgggagactgaggcaggagaatcgcttgaacctgggaagtgaaggttgcagtgagtggagatcgtgccactgcactccagcctgggcaataagagcaaaactctgcctcaaaataaataaataagaagccacagaaacatggattaaagcaaaatttccacacataaccttagtgaaagttaaaacaaactaggattctaaatagtccccaaagtgtatattaatttacaattaatttattcagaagttttacttgaaaacttttctctagcatttataactcttcttatttatgctgttaagtgtcatggtatatatttaaatcacacttgtttggaataacaagtttgttttcactaaacatttctgatgtattaatatcatctgctttttacctgctatcagtaggaatgttaacagatttcgatatcttgtctcgttaacaccaaacaatgggtgttaagatgttttttaaaaaaattccttgttctcatgattatatataatatatgttatatattatatataatatacttaatttataactattgtatatagtgcataattttcaaagacaaaaacaattgaataagagatagactttcttcttataagttcatcagtttcaaataatcttgcatgtattacccttcctttttattgtcgtgttaataaagcagttttaaatatagctgagcttaaaatcagaatgtgtgacttttctgttagttcatagtaagttaccacaaggcctgggcccttggttaaagggtttgcctgattaggtcaggcttattcaggatgatttccactttgattaattcagagtcagcttgtaagagttcctaattacatctaaaaaattctgccaaattctattcgccagaaataaatcacaagttctgtcaatattcatggtaggatgtgggtggggaacgaggtcatacataggtgtccggtactaaggtgtgacaatcacagatgccatcatagaattctcattactacctaagaacgaattcaacagcagtatttcacccggaacatagtagctctcatttctaacttctctcctgtctgagctacttatggcataatgaaaacaaaaacgaagagctaattgcaaacttatgcatctataaaaattttcatttaaagttaatattgttatgtgtgtatttggtcctgtcattaggatgttagctggttattttgctcgttagttgacgcagttttcttcctagccttgatggtctttacattttggcatgtttttgcagtggctggtactggttgttcctttctatgtttagtgcttccctaaggaggtcttttagggcaggcctggtggtgacaaaatctctcagcatttgtttgtctgtaaagtattttatttctccttcacttatgaagcttagtttggctggatatgaaattctgggttgaaaattattttctttaagaatgttgaatattggcccccactctcttctggcttgtagagtttctaccgagagatccgctgttagtctgatgggtttccctttgcaggtaacccgacctttctctctggctacccttaacattttttccttcatttcaactttggtgaatctgacaattatgtgtcttggagttgctcttctcgaggagtatctctgtggcgttctttgtatttcctgaatctgaatgttggcctgccttgctagattggggaagttcttctggataatatcctgcagagtgttttccaacttgattccattctccgtgtcactttcaggtacaccaatcagatgtagatttggtcttttcacatagtcccatatttcttggaggctttgttcatttctttttattcttttttctctaaacttcccttctcgcttcatttcattcatttcgtcttccatcactgataccctttcttccagttgatcgaaaatttttgcaacctactcatctgacaaagggctaatatctagaatctacaatgaactcaaacaaatttacaagaaaaaaacaaacaaccccatcaaaaagtgggcgaaggatatgaacagacacttctcaaaagaagacatttatgcagccaaaaaacacatgaaaaaatgctcatcatcactgtccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactaattcaaccattgtggaagtcagtgtggcaattcctcagggatctagaactataaataccatttgacccagccatcccattactggttatatacccaaaggattataaatcatgctgctataaagacacatgcacacgtatgtttattgcggcactattcacaatagcaaagacttggaaccaacccaaatgtccaacaacgatagactggattaagaaaatgtgacacatatacaccatagaatactatgcagccataaaaaatgaagagttcatgtcctttgtagggacatggatgaaactggaaaccatcattctcagcaaactatcgcaaggacaaaaaaccaaacaccgcatgttctcactcataggtggaaattgaacaatgagagcacatgaacacaggaaggggagcatcacactctggggcttgttgtggggtggggggagggtggagggatagcattaggagatacacctaatgctaaatgatgagttaatgggtgcagcacaccagcatggcacatatatacatatgtaacaaacctgcacattgtgcacatgtaccctaaaacttaaagtataataataataaaattaaaaaaaattttcatgtgaacagaagactgagggtcaaaagaattgagaaaataaaataagtttacttgaaaaaaaagttgcaatgaaatctgattgcagaagaattggctgatcaaataaaaacataatgtgtattttaaggaaacaatgcaaaattatcaaggttaccaagtgtacatcagtctaagaatttgtttgatgggtttttatgtttgcttattttaaagaaaaatcaatttgtaagaatttcaaaacagcaaaaatgcttcatgttgtatttatattaaattgacattgattaaatgatgcctacttattccttagaagtctatccatgtaacatgaatactcttattaatgtcttagaaagtttacctgtatcattaaacccctcaactaaacctctttgattcttcttaatttttttactttatgttcagacagttgaattaaccatattttgttatgatacaaaaactcagttcctgtttattgttttaactttgtgctttttctaagttaaatggctctcacattatattgccatcgtcattagcattatctaagttcttctaaactttattgctgtgacaaaaatgaggaagaaatactgctttctaaaatgacattatgacttctttgctgtgaggtctgtgttgtaaatcatcacctctattccccaactgtgaaaggtaaagtccagtctctattgctctcttgagttttaaaacaacataacgtatttggaggagttaaaagaccttgctaaatattggtctgtgttaggaagtgtcaaaacatagacattacatacagaggaaagaagacttcaagggttaagtacattttcaaggtcatgacactacaaaatggcagagttggggcacacatacagaatttcagagtccaaatttttaaccaattttactttttttatatcgcattaagaggaatttatttgtatttccatgtatttacatgttgtacactattcatcttgtaacagcgtcacagtttttcaagtgaaacattttattatatttaaaatttttgtataaatatagctggaattaaaataattacataaaacaatgtttttaatacttttaacatctttcttttagaatagtcttagatggatcttgcacacgtattccaacaatgatgtaattgattaaaaataattgaaactatttattgaatagtcatctttttaatttatcatatgccttttattatcttaagcatgtaagatttccattgtttgatattagatttgaatttttggaaataagcctaacagtcatagaaaacagacttggtagataaaatatacaaccagcctgaataatacatttctttgtttttcctcaaaatgatttcataatcattaatcggcccatggcttactcctttggtaccatggtgtgtaaaatctataacatttctatgaaatcatcctcatctttgggagatttattataaacaatgacaactgaggtaaaaaaaaatgaaatagatatagtcttctcttataatttcaattagcataattctgtttttttttttttttttttttcgagacagagtctctctctgtcgcccaggctggagttcagtggtgcgatctcggctcactgcaagctccgcctcccgggttcacgccattctcctgcctcagcctccctagtcgctaggactacaggcacccgccaccacgcccggctaattttttgtatttttagtagagacaggatttcaccctgttagccaggatggtctcgatctcctgacctcgtgatctgcccacctcggcctccccaagtgctgggattacaggcctgagccaccgcgcccggccaggggatgtcttatttctctgcaaactttacaacgaaactcttaaaaaagacatgttagtactatggttttaatttttcttgtctcatttttaataatttactctgattaggctttcgtctccaactttctacaaaaactattcttgtcaatgccgtacatattaatgcctcctcctcactgagtctcatgcttagtcctcatctttcttgactcaacagtagtacttgacatggccgaactatttgcatccttaaaacacggtcttcacttggcttcagacattacttgatcttgattttccttttacattatggatcatatttcactcttttcccagtgttcttgaactccaattgttgacatgccattcttctcagtgcttgggcctctttatctacattcatggattgcatagtgttttatgcatttaaaaatcacccattcagtgagtattcccaaatttatatctctaatcctgtcttctcctgaaagcctcagacttgtatcccaactgcttatgtggcaatgtagactaataggcatctgagtgataaaaaattttcaaatctactaaggtagtttgaaatcctcttaaataagaactaagcatgacagtcaagctccttgggaaactttacctggaaagtatgttatatatccatacacctgacaaaggtagtagcagcactgggatttgcaacctcttagattactagggcctattaaaacaataataataataataataataaactcctctgtaggataagagttataattattgatctgtatgaataagataatacatggcaacaaacctttatttaaattgatttacaatttaagtttataatgcattaattacaataaaagctgtatttgttcaaaaatattgctaggcataaaaatagataatatttattaacgttagctaagtcaccataggcccttcacatatactgctaacttaaattgaggaaactattagtaagacttctgctttacactcaacgagataatctgcagccctccagaactctgtgctccacatttagataactactcatgaagataattcaacactaggagtcagagaaatctattcttgttcatttttcgctacttaccagttatgtgactttgataaagccacttatccactgtgagctttagattctaaatgcgtaaacagacatcctgttgcgtggtctgccttgcaaggtttttataagatatacataaaattaaacttgaaaacacctaaatgtgagacattatagttatttctgtagacacagtctaattattattgtagacacaggtatattttattcttcagttcctctcttgttagtatttttttttttttttttgtttgagacagaatctcactctgtcgccccgcctggagtgcagtggtgcaatgtcagttcactgcagtctccacctcccaggttcaggtgattcttttgcctcagcctccctagtagctgggattacaggcacctgccaccacgccaggctagtttttgtatttttagtaaagatggggcttcacaatgttggccaggctgatgtcaaattcctggccttaggtgatccacccacctcagcctcccaaagtgctaggattacggaagtgagccactgtgcccggcccctattttgttagtcctttaagggaccatataatcatataatatagtgggcaacctggtctctttctctacagattcaatttctaatcacgaaggaggagaaagaaattgagttgtgtctttgggtatattcttgtgaaatgaaattcagtggagtaaggaggaaaatatgaggcatatcaatggcataaatatttgtattttgagtggtgtagttggccaaaggattggcactagcttcaggtgtgtcctacttggcagtggtacaagtcaacatggttgtatgtgtcagttttgttacatattcaaatgtacagtataacaggagtctcagaggacactgtgatttctaaaaataagtaaggtaaaaatgggtttgtagttttagctgtttgtcctcttttgttccaattgcatacacatcaaatcaaattattcttgtggactgtttttctttatatgttcttcttctgtacccacatagaagaaatcataaactttaacaagatgataatttacatatcaaaaacttgatttaagccatagccagtacataaaaattcatttttgtttagtaggtttatgtctaattagctgaccaacagggggtgtgctaatagtgtcagataactgaagtaaatggtatttaacagcatggggttccaataacacaggagaacacaggagcaaccttctaggctttatttcattcaagtccataaagtcccctgtggtcgcagcagtgcatatttaaaatcagttaatcatgttactcatgggtgttggatatctttcaaaatggcctctggtaatgagctatttgtcctgcattgtgacaataagtctcttccataatttataaagctcatgcagatgatggttagagattccataagaaaataatgcagggatgttctacttcctgcttaattcctacttaaatacagttagatactataagtgcataaatctacatagtccacaatacttttgtgaaatatcatttcattttattatgatgatttttgcttttgtcttgttcaagtagttttaaattttggatgtgttggtgggtataggagtgactaaaagagagaaatgtctattgacccaactggtacttttcatactttttttccattctgtcattgtttgtcttaagtactctacattttgtaagcattgatctcatctttgcacactgtagtgataaggggtatgcatattcttacacatacagcttctcccctgacttaaccaaatatatcaagcaagaaaaacaaccctcttcagctagaagtcttcatcaagaaaacatatatgaagtatacatacgaatacacacacacacacacacacacacacacacacacacacacacgggagtttacaaccatacattacagagttctgcaaactcaaatagcattccattttctggacaattctatctgtagacatcagatgtactcgcaaaccgtacattgttgtttaaagttcttcaataagagattctaggcttttaacctgtgtttataattctaacaatctttgcatttagaatgcaaagtcttgaactctaacctttaagatgctggttttttacctttcagaggtcttctgacagggccctgccattgtacttccccatttcatatccttattgcccattaattaatagcttcaaggtttaaccgaacatagcctgtggataagttcttcttcatgtgggggtgtgggaggtgtgtacttcctgttctcaattccagctacaggaacatcctctctcaaacattgacatgagaacaagacagtgtaagacagtggaatcaataagctaatgaacatcaatacaaagtaaattctttcacctcaatttgaatgtgaagtaagattaatccttattaagaaagaaaatgatgcaaaatggataaatgtgaccattttgttttatcatgttattcaattcatcctaactgagcagttagagattttctagagtttggatggagaagtggatcatggtttcatgtaaaatattgattcacatggttttcagctttactagatcttggcaaacctttcctcctcccttcaaacacacacacgcactttctttaaacattctactttccattttcctttaagctcctaagcatgacaacctgggagcccactgtaaatgacttttctccaggtcgctgcttatggttacaacttctacacagaaaacaattttgccagtatttccctcatctcatcaagcacagcttcctttctgcaaaaacgacagcatccaacgtgcaatgactgaagttattataacatcttgttcaatgtaagcacagctgagttccttagaacatggtttgcctaaaggtcagatgctcaggctcaggttgggagagaaatgatattgaagggacaaaatagcaaacataagaagccacctttgctcatttctgcttcccagcataatttcccaaagcgcttggccctgtgacaacatacagtgctccaaaaaaaaaaaaaaaaaaagaggtcgaaacaaaataaaacataccccactacgtctcttgcatgagtcagtattccttaaaaaataaatgaccctaatcattgcttttttctaacataaaataatgtctgataggattaaaaattatgcctctataatctgtaatcatgaatcatataatctatcagtatcatataatctataagatcatatcttatcatataatctatatgagtgtagcttatagattacatcttatagataagatatactcttgtccctcattaccttaggggaagctctcgttcactggcagattgccatggctaattccagctgccgttcattcaaatgttaatacggatataggattttatttatttatggtagagttgtaggaaaacaaaatgtctctattaacatttctctattttgctaaaatattctgaaattataggctctgataaataatatgttatatcttataggtaagatacactgttacatccaaactttaatataattttacaggtactaaccccccattacctatatgtaaacatcagaatcaaaaattgatcccttgacttaactgaatatttaaacaagaaaaacaatcatctccaggtaaaagtcttcatcaaggaaacaaataagaagtatacacataaaagaatgcaccccgccccccgccacacacaggactatacaaccacacattaaagagttctgcaaactcaaacaccataccattttctgggcagctttatttatttatttatttatttaattttatttatttatttatttatttattttttgagatggagcctcgctcgcttgcccaggctggagtgcagtggcatgatctcggctcactgcaagctccgcctgccgggttcacgccattctcctgcctcagcctcccgagtagctgggagtacaggtgcccgccaccatgcccggctaattttttgtatttttagtagagacggggtttccccgtgttagccaggatggtctcgatctcctgacctcgtgatccaccctcctcagcctcccaaagtgctgggattacaggcgtgagccacctcgcctggcctgggcagcttgatttatgatccgtaggcatcagatatagatataaagtaaaaccctatgtcaaaagagtctgaagaaacacctgtctaaaagattttcctggactgtagactttagtctatagtcctcaagaaaacttctaaataaaacttacttccattctttaaaaacttaattttctttcactcaacgcagacctgtggagactaatgaaagaaagatcaaaggaagatattccagctggattatgaaggttgaggaaagatcgtattaatatgtatagaatttcaataacagcaagctaaagattgttgattagaattcattattctagagagtgttaaccagtttgaagagtggtctttttctaatttcaaaagaatccaacaacttaaagcagtctaaaatgatgattcaactaatcactaaatttaaaataaactgagcttgatatgattttaggttaagaaacagaatctacaaatgagaaagaaagccagtagtttatcctcctcctttgctgggttatgaggctggagtgggaaggaggtcttggattctgtttctataggtgaagaaaatcaggggcttgatacatcgccttactaggatgatgccaacaataaagatttcactgttagtcctaaatcttgtctgcaaagcagctgctgttatcttctctttgctgtggttcatcttaattagaaagactattttatggtaggaggaagtatagtcccatttattttgattatactacatgagaaattctaaaatcagagggttgaccctataatttagagagaataggaattttcagaagtgaatgtgtgagactgggcacaatgccattgtaatgaagcataaggcatagacatgccacttggaaatacatataattttttatgtaatgagtctgggaagttgaggaaaacctctcaaggctttcaaaactttctcttctgtgttcaagaaatagatatgaagacatgaatcaagttactttcattcctaaggcttcagtcatctcatctgtggaaatcaggcacttggcttccacgatctctaaagtctatctaactccactatgctgtcattctaactcttgaaatttttggtaaccacagaacattctaatgaagaaacagcatattgtcccttattaccttaggggaagcccttgttcactgacagattgccatggctgattgccgctgctcttcactccaatgttattatggatatagggctttatttatttatggtagagttgtaggaaaacataacatctctatgaacatttcactattttgctaaaatattctggaattataggctctgataaataatgttaatattaatcttattataatgtaatagcatattttatgagcttaaattcaaaagtatcccaagtgactttgtaaaaggaattctatgtgaatatatgtgtgtgtgtatgtgtgtgtgtgcgtgcgtgcgcatgcatgtgtgggcgtgtgaagttttgcagcagcaatagaagttgtgatgatatctcaaataaattcagtgactttaatattcttcccttttaatccagagtaaagtattgtggtctgactgatctctttgatttataaatctgaaaaaacttctctttgcttaaggggttcaaattaccttagtataaaatgcaaacttcttaacataaaataaagtacacctcagtaccagaattctgttagcctgtgtaagctttaggtccactgtttctctacctgatacaatctgaaatccagccattctgacctactttcgaatgcctgaattttctattttctttccagtgttaagcctttccagtgtctctctcctttgacagaagtacacttcccttgcctccttgcccgcaaactccttttcattcaggtgtcagctagacacatttgactttcagtgagtgggttataatcctttcatgatatcagttctacatctgagcacaaagatagacctaagattttaattgattagttaactaattcatatttaatgagcatctactactactgtgtaaaaacgtcacaaggaaacataaatatgaacaagatataaacccttgtttaaaatagaaatgtggaaaacacagacttattaatagtatagaatatcacatgcgaaatccaagtgctatgaaggtttagaatagagggagttacattttgttgaatttagagagcaatttatgtggatgttaccatattcaaagtttgcaagctgtatttgccctaaagacctttagctctgaaaggtacctctcaggctgctcttgggtgatttggccaaatatcaagtgagcaggtcttggatccccagattccagttcagatggagcagctccactgtattctggggcttaaattttgaaaaccactgtgtttcgactgcaataatggtatattatgacactaatggatattctccaggtgtttttcactatcaagaaaattgatgtataacaaacgtatccccttgaagtggcacttatttccccagtcactgacatgaaacagtgattcatcaattcgtggccttaagtgatactgaggtaactcaagacactatacacttgtcaggtgcattcattttcttctattagtatttatcagaaattacatataacatcgtgatgtttaagaacagcttagtaccctatgttaattgcaaacatgtcaatattttgtagcaggaattctgggttttgaaagcaagagaaaaggacatttcccttaagaacgacaaattcctgaaatacctgtggaagaaaaatgacatcttaactacagtacgactgacccatgaactccacaggtttgaactgtgcagctctacatacatacagcttatttttcgactaaatgccatttggaaatacaatcttctcaggatgcaaaatttgcatattcagagggcatactttttgtaaatgtgtgttttgtagggctgactgctgggcttgagtatgtgcagatttggtcatacctgggggttctgtaaccagtcccccacgtgtaccaagggactgtattttcttcacttgaatatgtgtcatagtacatgatttaaactactttcaatttctgtcttaatcctgttttgaactaaactaagtatgcttctctaggattcaagtgttcactgtatgaggtaaattaactcttccagtgctctagggtagcaattaatgccccagaggaggtaaattgctaaatggtaccccacagctttcggaagactgattctgtgtcgaatggttatgttcctctctggtggagagtagattactcccagtggttctttataggtcaggatccattttcaagtgggaaattagatttcatctgattggcaagctaaagcttctgaggtgtgtcatacaatagtcacgattagcctattgaagacataaatgtcggttatggaagctcaaaaagacagtaaataaatatgaaggcatgaaacaaaatattgggcagtactgcatatttgaagttttgtaagcaagtgagatttgtattttatcatgagctggaattttatatctttacttagaagcatagactattagtggtactccacaaacaccacaaatagtattcattcctctcttcatttattaaaaaatatataaatagatatatagacatgcagaaaacttttactctcgcctcctctttatgcatggttttgtgtgtattgcttgaatactctcactgattttaaaacacagtgctttttctatggatcttactctttggaaattttactttattttgaaataaaaactactttactatatgttatttgctcataatgtacaaatagttttgagtgcctattaagtatgatgcactacacggtgaaaacaaagcctggaatcctgacttcttgagctttacattctaacgagaaaaacgaaaacaaagctacacacataaattattacattgtgaaaagtgcaaggaggaaaacaggtaaggtatgaggtccaaggtagacagcacctggggtcagggaggtgggaagcagccacagatgaagtcgccattgagcacctcattcataagaagacacgcttcatcccgaagagtgtgaaggagcagcctgtgaatggcagagtggggtcaagtgattaagtgcaaaatcccttgaggcaagaaatatgttttcatatctgaggaacttcaaaaatacccatgtgactagaacaagctgggtggtatgagttcagatggagggaaagttggtgtcaggtcatgtaaggccttgtaagctaaaaataaagaagctgaattctattctaagtctagtggaggaagggttttaggtaggggagtgacacaaactgaattatagcaaaaatagcaatgatattaaatattcacacagcactttttttttttttttttttttttgagacggagtctcgctctgttgccagactggagtgcagtggcacgatctcggctcactgtaacccccgcctcccgggttcaagagattctcctgcctcagcctcccaagtagctgggactacaggcgtgtgccaccacgcccagctaatttttgtatttttagtagagatggggtttcaccatgttggccaggatagtgtcgatctcttgacctcatgatccgcctgcctcgacctcccaaagtgctgggattacaggtgtgagccaccgcgcctggcccacataacacctatttataccagagagtagcaatggtattaaatatttacatagcacttataataggccaggcatttttctaaggaatcaacatgtactaattttttctaataatcttatgacatagaactaaagcacagagagattagatgacttccgtaaaattgtggagctaggatgttgctgaaccaggattcaaggctgggcagtcacttacctgtgtggtagctagtgttctatgaatctgtctctatcgtctatctaacttctgtatttccaatctatttacatcaataatttaactgttaaaggttgtgcataagcaccataaaatggcacttgagttcatgggaacagattatatttttcagagaaatcattgttagaacacccaggactgagctctaagtgactctaacagtagagactgggtagaatgatgaaactgtcaaaagaaattaaaattagtaacccagtaataagaggaaactcaggaggaagaggtggcgaggaagaggtggctgacataggggagagtcctaagacaaaatcagaggtcaatgctgcggagagttgaaccaaatgacacgagaatatttgctagattacattgtgggatgtgtccatgaccctgagaagggttttcatgaagtaggaagttgacagacaggatcaagggtggatgagagagaatgctgacttagaacagggaggcagctcttttgaatttggtgttgtgataaaagagaaaaacagctggagaagaatattgggtcgagggagaacagggagccactggggatgccgaagagaaaatgataatgaaaatgttggctatgtagaccttcttgaagggacaaagcaagagagaattcaaagaataaatggaaggttcagcctttgatggaagagggacattctttgatcatcatacaagagaaaaaaagttgcttgcagggttgataaaggatggaaaagggcgaatcatgagtaagatctaataccgtttgtaaggaaccacactctatgctaaatgttttacatatgttatttcaagtaattctttcaaaattttaaatcattattattttttaaatttttaattaacaggcagtggatcttaggctcagaagaattaagtgatttgcccccaactgcaaatccactaattaccagagctgaaaaattaaggcaatcagcctcactccaaagcgtgatcagagagctaaaaatttacttagttattgaccagtcaatttgaagcccggagaactaaggctgacttacagagtatatgcaactcactgctgacagagtttcgtttagaatgcagttctcttcactcctactctagtattcttttcactgtacttatctatttttttcaattgctttagaggcagtatacattttaaagtaaaaatatatgagtattaattataaactttattcactgaaaatgtagtggtaattaagggaggaaactgtaatgattaaaattataagaatcaaatataattggttttcaagagagaaaaaaataagttaaaggactccgtatgactactataaattctcctagtgagaacaccaagtatatacaattagtttaaaaaaagaattttccaagttctttattaacttttaatcagaatgcaaagataattagacacagcctgtttatgtatggaacaatacaatgaaggacagtgttctgctttttggaagacacatacactacaggaacctttgaacatgcaattcagaggaagtttaatccttctgttaacaaatctgattaaaaatagcagtggcaatatttcaaaagttacatgtgtgtgtttgttaaatatttcttcccaatgtaatcgttttttaatcttcaatttttttcttataaatggttgtcaaatttacaagcccttactataaaatcccaggagaacttttaaattccataagaaaactgtatggtttttattcagtcttattatttattgtatactttcactctaattatgtaaatgtggtatcttgcagaatttttgtttgttttctttcttttatccaactgcctccaatgcaccacttcatatgcatgtcttttactctagccattgtgtgttatcataatcatgtctacccagagttcaaatggcttaatacaggtgtcacctcacagcacctctgctcagatcctgcagactttgcctctctctaaggaccctcagcagggcccacaggattgagcccctgttcctcaaaatggtggccaaattaataataaaacttgttttggtttccctttttccttttcattccctcattcttcacacatgctctccaggatggcaaactccaatgaactaagcactaaaacacttatagtaattaaatttctacctggagaagcataaaggacagatacatgtgtctttacttttcatatctaagtgacaaaatgaatcttaccttatcaaaacattcacagacacacacacagacttttatgtcagtgttttacaactacttgtctaggtttgtgattttataaaacaaatgttttagattagttaaaatattagaatttaactcattatgcacaaatgaaaaatgtgaactataatatggcaatgagtcagttgtgttttctttaaattaatcacgtggtcaaatgaaattcacaaaagagcctggggcaaatattttttgatatctgccattagatatgaaaacatgtctattaacttaataagccagaaataaaggggctgcttccactggaagtgaaaatgagagtaagtgtgcaaagtaactgaagttaaaccagtggtactattcctaattgcagtcacactaaatggaagaattcttatggtctacatcaatgctatacattaaaacgtgtattggcaataatagtgtctataataatgggagtatccttatttttacttcaattttcctctcatcatataatttgctgtgtcagactcaggtgaaataaagagggatgtatatatggatatagatagatatgtatagatatatatacacatagatatttgcatactgatggtgatttttgtgcatgaaaaagtgataatgtgttttctactagatttaatcattttctcaaaattctgtgacatagtgagaatttagacctgagagttttttcttaaaataattttttttatccgttagtctagaattttttaaatgccagaattataaattcattttgagtttttgggatgtatttctgataataacatttttctaatcaagtataagttattagagtattaaatactttaataagtatacgttattaaaaaccatttatccggacaaggcacgtcaattgctttgaatctgcagggaagaaaccgtgtgtcacattactcttcagacaacaatcataagaaataaacctacaaacaccaaacttcaaaaaaaaaatcctgcacaaaaagtatttttgaaatcagatgatgggcccaagaagaccaaagggatttaggatatgtggtcaaagttgttctttgatgtgtgtttgtgtattcagcttgtccatccatcaagggctccacctgtcttggagatattgtccatcatttatttatgtgcagagagactaaagtccgaactgatcttcatttcagtcatgcactgaatataagaattgtggaaaacattttggagctaagatacaccctttttttctgaaaagagaagttgtacttcacaggcattttggagtcttccagctcagatttacttttggaaaatgacataaatttcatagataatcccctgatccatctttagacagacctcaacattttgtcaggtcaaattatgaaacagaatcttacataagttttctcaatcatatctttccttgaaagaccatagttaatttcaaaatagacagtatatgaaaatagctgccttgagaaatatcagttaaactccagcattgtatgagaaccaatgaacaaacaacattctcatctctgccaaagttttcaaggagagtgcatgatttcatcctttagccatggtgattcattgttgatgactaatatcatggatgctcacatttatggaaagtactgtattgacacacattgtactacctgctttatacacatcgcctaatttaatcctcataaaaataccatggggtaattattatcaaatatattttaggttaagtaacctactcacttatcttgtaagcggcagagcaaatgcagttatacatttcattctatgcctgcatgattcagaaaaataaaacaaaaacatgtaagcctttggtgtacttatatatcaaaaaccaatttctttaatataagagtttaaaaagctgtacataatactactgtagatgaaacaaagtgtaatggaagacagattgaaaggaaatttgttactattaggatgcttgcaatcaaataatggggataaaacaagcacatacattcctcatctctgtatagacttaacattttacagagtcctttgagagactttaattttattgtatcaaatttttcatgtctaagttatctattcctttcagtctattctgtatgtaactcaattgcctttttgcctttgctaacacagaaatccattaaaatttttaaattaatggacattttaattacatcttcttccttagtactaataaaaatttatatactatgtatatgaatatgcatctagatgactatttcaatatcaatatatgaggagataaaatgaattttccacaaactatgattctgtgtcatctaaacattagcttgcacaggccttttaaagaaagcagagtgaggactccctggccagtgttctctaccatctcttctgcctaccttcttttctctcatggaagtaagaaaagaatccatttcatcaaaggttgaacattccacttcatccctgaattctctcttgctttgagttcttaggtacatctatattagatatcactttctcctctgcatccccaatgcccttttccctcctcagcatacctgatcctctgtccttgctgacctttgtatgtgtgtgttttctcccttgatgacatatccctcttcagctattgctctatttatattcagaatcccaggcaagcaacataaatagatgtctccaaggagtaagtgatttaattagcttgaagtattatatatattttcacacacacagacataaacatatatatgtatgtatgcatataaaacaaataagataaataactggaaaatatatgcaatgaagtcagtgaattagcagatgagataaacatcccagattggtatggtattgtacggtacggtgtggtatggtatggtttggtaccacaaggtctagtgtttagagctggctctgccagtcactatccctttgatactgatcaaatcatacaaaatcagtttcttcatccataataaagccttcccttgttactcagagttgctgttccagtcaaaaataaaatgttaatttatgatacagaccttgataagctgtatgaaccttacatgatactaatgtagtaagatgcaccacggttcattcagataagtgtcccagtgagtcctcagttttcacaaagtcatttcctatccccagttttgtttatttgtgcacctctgcatttacctagaacaagaattgttatattctaagtaattgccaagaagtatggtaacaaattcactactacttgattcttcagtggagaaaattatatacatatatatatatatatagatgcttgcctaaatgatatgccattcttccatacttttaaatactgtaacttgtgttattgaattaagccagccagtcaaaagcttgaaattaaacatagtattttcctatgaaatatattttttaacattataaaataaaatttggaataaaagcattatgtatatatatatatatatatatacatatatatatatactcataactcttcattcatttttgtgaatcagtctcattcgtagttttattgtacttccaaatcttcatttttctttggatcattttcctttgccagcattacgtgtgtgtatgtgtgtgtatgtgtgttttaaaagggccataagaggaaaacagcaagaagtctgtctcctaactttgaaacctaaattttagttttctttcacacaggaagtcatcttgtggatctaataatattatgaagttattctctttttgatggacatttaggaatgttttgatgtttcgtacaataattcaagttgcaagaaataagcacacacattttgcaagtacatctatgggatatgttctaaaaaattaaagtgcattctttgtcccttaacctatgatacgggcattctttattttgatagatgctgcagaattgtcttctaataagtcataggaatttacgttttcagttaaaatgtataacagttcttgttatataaaatgtataacagaaaggacttttgatttctatccatctgaatgatgaaaaatagtaagttatttattaaattattatttaccttcacatatgtatagtggaacactgagcatatgtttaaaagctacttgagtttttaaaatctgtaatctgtgctttactcattttctttattggctgttggttattttttactgatttttgatgcccctatcttgttaagaaaataatatttttataatatatcacatttatcacaagttactgtttatctttgagttttcttattgaattttgacatacacaaatggctcatatttactctttttatcagcagtgtctttgttagttcctggatttgggatatgcttagaaaagtttatcctaaacaaagacttgtgtacttttaatttattgtcatgtttaaatcgttgctaaatctggaatttattctggagtaagaagtgaagtagagttctaactttactttgattttgttttgttcttattgttgtttttcttccagatttgttatctagttgtataaaaaccaatgattaaaaaaaaaaagttttttcttgctgggcaaggtggcttacgactgtaatcccagcactttttgggaggccggggcaggtggatcacttgaggtcaggagttcaagacaagcctggccaataggtgaaaccccatctctactttaaaaaaaaaaaaaaaaaaaaaaaaaaaaattagccggcgtgacagcatgtgcctgtaatcccagctacttgggaggctgatgcaagagattcgtttgtacccagcatgcggaggttgcagtgagccgaaattatgccgctgcactccagcctgggggacagagcgagactccttttcaaaaaagagaaaaaggaaaaaaaaaacatttttccttaatgattttcactgtcaaaattattatttattaattaaatatgtgtgcattttacaagatgtcgagactttgtatcatttgtttgtctattcagacaccagcaccaaactgtgaattaatatagccttaacatatgctgaagcatttggtagaactagtcgccactcattaatctttttttcttttgaatactaaatttttatgtaaattttaatatcagcgtgccttgttccaaaggaaaccacaaaataataaagacaaagacaaatgaaagaactccccattatttgtatggcaaatgtgtgtacttatagaataatttggtgatttatatttgttatgtttataatatggatccttatccaaaacgtgcaaaagcccatttttatatgtaccttaataaagttttaagatttctttgtgatctatcaaatttattgttaatttaaaagcttgatagagctatactataaattgtatttccttaattatgttgcaatagtaaatgttgtttgtatatgatagctaagaatttttaaaattttaattttatattaagcatctaagatgaattattctagaagatgtaataatgatttttttctcctcttcaattttctatatagctaatcataccataattatcattataattttataattctgctccatccattttctggtgtgcatctgctatttcatcttttttgcctatggactacccttgcaaaatgttaaataatggtgataggagcctcaataatgaggcttttgctactttaacaacatacagtgttaaaatataactctcttgttccatgtgtatatttacatatctatccttttaaacttatgtaagttattttgcaatataatatatgccagtattagtttttttttttttttttttttgagatggagtctcgctctgttgcccaggctggagtgcagtggcatgatctccgctcactgcaagctccgcctcccgggttcatgccattctcctgcctcagcctcccgagtagctgggactacaggtacccgccaccgcgccagctaatttttttattttttttgtatttttagtagaaacggggtttcaccatggtctcgatctcctgaccttgtgatccgcccacctcggcctcccaaaggccagtattagttcttttgtgtcatttaaaaatattttgccagctgggcgtggtggctcatggctgtaatcgcagcactgtggtaggccgaggtgggcggattaccctctgaggtcaggagtttgagaccagcctggccaacatggtgaaaccccgtctctactttaaaaaaatgcaaaaattagctgtgcatagtggcacatgcctgtaatccaagctactcgtgaggctgaggcgggagaattgcttgaacctgggatggggaggttgcagtaagccaagatcgcgccactgcactccagcctgggcgacagagtgaaactccatctcaaaaaaaaaaaaagaaaaaattgcatatataaatttttaaaaatatgttatcgttttaattagaggagtcagagagaaataaaggtaattgtaaagaagaccctatatttacaaaataggacaatgaagaggatattagttggggacagaatgagtggaaagaacagatgttaaaatctatcttaattaagaagcacacttaaaggtccatttataacgctctcagtactcatttttaccctggccatatctttatcttgagtaactaatgaagtagaatacgacctatgcagttatgctaaagaagtttcgcgaattcctaatttcttttcagccaatgccatagaatggcttatatgtattataaatggttttcagagtagcagattttctaacacttaaatggacacaaaaagataacaaaccaaaaagagatagacagataaaacacttgaaccatttcatacaaaatttctctgagatttgtctactttttaatttatttgattacctatattaccattcctccatttacatgaacaaataaaagtttattgaaaagttcaccacatgttttaaaagcaactgaaaccaattttaatttctaagaagtaatgttattttcatgttcccaaatgatcacttcaaagaggcgagtaagaggcgagtaagaaggaatataagctctattgttaataaacctagacgtaccctaaatgaagaccaggagtgagtgaaggttggtaatttacttagtagagttgaggaacatctactctaggattctccacaggagttcagctcaaatgatcatttgaaaaatgctaaggatgcgaagagagagaaggcaccaaaaagaaggcaattggaaagcaatggaggtacagaaaaactcttttccctcatgtttgtataagagacaatagaactttgggttctcaccacaaaccttgttcattcagatgactacccatcttccagctgtctatgagacagatcacatattacctgaaaaaatcgtgtgaggagctctggagaaaggcatgtgataataagaagggtgaaactagtagagaaaattaaaacattaagggaaagtcagcatgctgaatggtaagattatccacttcgctgtacttcagaaacatggcagacattgaaaaatccttctcagggcaaatagatccaccttggagaaaagacatttaactgcagacatttggggatcttccacaaacatctaagtaactaactaacgtttacaaccatgaaaccgtgaagtggacacgattctcttcagtatcacagagtctctatttagctatttggtgcctcgccttaagccagaaacaagacttctaagtatctccaggcatttgaggaaaccttcagacatataaggagagacagtaactatacacagaaaaataaaaggaacttaacacatacacacacacacacacacacacacacacttaggcatgaggtcaaagcatcaaaggaagcaaagtgagagaagatttgatgtctttatgaaagcagaattttcttttttaacaaatattagaaatatgttgaaaaaaatggaggcaatctcccataaaatacaccagaaagataaaaggatggagtatatgaagcagtataaactcaaagcgtccaaaatcctagaattaagattcctggaagaataaaggaaaaaataaaatgatggtaaaaaattgccataaatataacagagaaaatattcccaagactgacagacatcagtctccagacataaaacataattgagaaattttatagaattggggtacatacggaagatccacaatggcttccagaaataaaaggtcatatacacgttatctggaattgtatcagaaacaccattctgaaaattcgaagtaactggatgaaatctttcaaaaagttgaagaaaaatagtttttaatcacattcctaaacaggtttgagaatgttttaaaactttcaatcatgtagtttttcaaaatgtgtgtgtatgtactttttctggtccaaggatatatttcatttaaacaggggtgtcaaccaagaaagaggaaggtatatgaaatagttgaagttgttgcctttgggaagcaaaatagacaaaaaagataatggttacagaactagggttggctttgtttttttgtttacgtttttaatcaaatttggcttttaaagttgtatatgtgattatgaaaaaaaaagtggctttaaatgttctaattcaaaagtaagttaattaaaaatatctaaaatcacaaatgataaagagcttccaaatttaaagcatttatgaagtgcacagattttaccagaaattcactcacaaatcttagcaatctcgatagtcatagaaatatttaatgtcttctcactaaatgtgttgtatatccttgctgttaaaagatcagttatccttatacttacataaatatgctacaaaagctaagaaaaacgggatgactagaaagatattcacaagaggccacattatcattaaaaattcactttagctgtgaggaaggatttaaggaaagagcctgttcttagtaggaggcctttgatgtagctgaataagtgtgtaactgatgtgagtggaacctttttaattgacactgacaatgaaagcaaatcttctgggctgctcatcagagtcagaggggatatgggaaattaaatattgtgttctagctttttctaaagcctataaagataatcaaacaagaggcatcttttaaaatctatttgtgagttgatgccattcatacggattaaaataaatagtacttgaatatatgtggttttggtttattttaagcgtcttttcaacaattttatgattttgtaaatggaatttacaactaagtaagtgaatgtgcaactacagaatttgtttaaaatctgatgaagtattatcagatatttacgctgatatgctagtttaaaaattctcatatgctagtttatatatttccctgaagaaaatatattaaagtgtgattcagatattatttcaactgctgatagaaccacaaagaaacacattacatattgcctttgaaagatacactggaaaatttatttttaaaacttcacttgtgttcacaaaaacaaaacttcttaaagcaatgtcatttccctcatttcactgtttcaataaacaatacatttactaactagttcattgcttctctgttaccagactatctctcaacaattatttcaaccattgcttttactttcctggttgaaaagaaatgcttttgctctttctctgcactactgtcaccagtcatattgcaggagtatggactccagccagaataaacctctgtgacatctgcagagacatgcggagaccagagcagactcacccaaacaatcacagataatcttcttccagctaaaaccacacactgagcttcagcaccagtcctgtcagagaagggattagtgggtgccttttgctgtttgcggtgtgaattacattcatctaatatgaggctggattgaatcctagccttatggtcctatgatgaaagaataataaaagattggtggcataaagaatctaacagttcctattctccgaattataattagttattactacagtttatagtttcttatggcaaattttgtgagatttgaggcatgtttaatgaataactctgattgcttttaaaaaggcaaccaaacaatgaaataaatatttttcccatttaagtcagttatttaaacatacttgattttgtagatgtagattcgatttcatcgtgtgacccagtgtacaacactgaatgatattaagcaaggtctcctgatgagaaattcttataatctcctataacttactcttatgtaaattcccttaaactatcccttcatcactgtatgccagatacgtgggaaaatctcccataggttaaaccttcaccttctctttgccttcaccctaacagaaaaaaagtttgctgaagaaagtcacacaaccaggttgactggttttactttaaaatcatgagcgtataactgccaccaaattgacactcagcattgtagggtatcttgctacctctccccagtaagatagggttcccactcttttagttggctgcttgccttatgtttcagtaaaaacaaaactataagagcgagccaccataatctctccacaacctaatttagaagtttgctagtacacatatctatagtctttgctttttacctctggatacaatggggaaaaaaattgtagcttctttttttaagtttaattgcacttcttgtgctccgaattccttactctcttagagtcttacagatttaatctattcgttacctttgttctttttcttcactgctcatctctcttctaaataatcattctcttcagaatatacagaatacaacatgctataatatttctcatcgaaagcaaacacataaataaaaaaagaaatgttaaaaaaaactttacaccataagggttttcagtttccctcattttttggctttctacctatcaaaacttcttgtaagagttttctatattggctatttttattttctgttatttcatctgcatgtattgttattgttttttccagtttatattttaatcaagaaataattcccagactttggtatatttctcatgccccatgacttatctgaacacattgttacggtataaatgcatgtgtctcatccaaatctctattgttgtaaccaaagacccaatttgataatattaagaggtagggactttagggagtgattatgtcatgaaggctccatctgccctcatgaatagtattaaaatcctaattttagggctcaagagaactagctaagcccttttgcccttctgccttttccaccatgtcaggatatagcattagtcccctctggaggccactgcattcaaagcatcatcttagaaccagagactgggttctccccagacattaaacctgcaggttccttgatcttggccttctcagcctccagaaatgtgagaaaataaatttccattcttatataaaatatacagcctccggtattttgttttagcagcacaaatggtctcatacacacattggcaatgtaatgaaactcagaaaaactctaggctctccactgagtctaagttccatttcattttggcttcctcacttcagctgcttttattgatgtcaccagttgccaaattcaacacagagcaatgtgctctcttttgtactttgaattatacaatactgtggaggattttcgcctataaaagtttttccatcttagcccaagtgttccacatgcttctcgttttctcccattcttgcttacttgttctcctcaaggtccttttctgttttctgccgtctacctgctgagtgtctaggtttaggctcctttcaatttctatttgctctcttactttaagtaccacctatatactgatgactattaagaatatatctctgaccctgatggctcccttaatcttttgggtcatatatccaactgcatgcttggcagttctactggattgtctaatgagaatctgaaacatactatgtccaaggagtaactctagacccctcccagtcactaccggccactctctacagccacttgatcaactttttatcttgccaacttctctgtctcagtaaacattatctctgtctacccagttgctcaaattaaaagcctggaataagagtctttatctttaatgatatatactaatatatttagagtaaacttatatgatgtctaagatttgccttgtaataattagggcaggggctataaaagaaacattcatcatgagttattaattgttgaagttggattatgagtaatataacatgcaaattctgattcaataggcccaacgtggggcctgagatgctgcacttcaaacaagctttgtgctttcagtacctcctacctcatccacaattcttatgttactatgctacttattttcttaatgggaatttcataatacttatctgcacttacttatctgttatccttgttaattttctgcctttctccctataagggcatgcattgtatatgtcttacttatcgccacatcagaccagctcagtgcttggagagtaggtgctttataaatatttataacaatgttatggagggcaatacaggaaataataacaggtgaacaataggtgtagatgttagtgcagtgccatgaaactgaattttgtaatcttggttgtgagattacaaatgatatttgagtttcactctcaaaattctggattaattggcttgaaatgttgccttttgcagagcttcccaggttaattctaatgtgccagcaaagttaagaaccactgccttagatcatgacgatgatgatgatgatggtgatgatgatgatgatgatgacaatgacgacaacaaacctaccatccactttgctctttgcttggagctatttcaagtactttatgtgcattaccttatattattcttataagaatcctatgaagtagatactgctatggttatgttagaactgaggaaattgagatgtagaaatggtatataatttccttaagatcaaccaatttatacatcatgaagccagcatttaaccactatttaaaccaaggcaatccgagtccatacccttagccattgacttaagatgatggcatacatgttacaagcactgggaaacaaaattgtgtgtatttttatttctaacatatcactcatctaaacaatgtgaaacacaatactcaaatatggcaaatgaaggagtaaactttcttgttttccctaaaatgacgactttgggactacttatacatttgctgaagcaaagtaatcattttaggtcccaaagctatcattttagagaaatcaagaaagcagagagacagagataaaaatacaaggaccatcatgaattatcaataactcaagaattactgtgcttggtttgaacaactagagcaacagacatgagccctgctcttcgcagagattgttctggtcttctctggctctcctttgcctgcatcccacaaggcacagtgtgtgtggggcctaggagacttgcctatcttgagcctgtgcctctacacacctcttttaaaccaatgctcttagtacccagaaccttgggattttctgcagaatgggtgcctctttcctgggtatgttttctcagtgaagagtaaaggtaattgtttgagaggagggtgaaattgtaatttggaccaattaactggggactaatttgtgtgtgtgtttcagaggcttatttggcatatgtatttgagggatgttatcagggaggaaattggggtacagactttggacatctacttgcattctcaccctaaaggtgcatctgcggtcaaattccaattccagagataaggtcaaggagttaatcttaagaaagtaaagggtaaatcttgaactgaagatgagactctagaaatactctgttatcttaggtatttgaccaatggcaacttcttccctattccattctcagactccttgaggaatttggcaataggtaacgctactcatgttaagttgctataagatagaaatggggcttccattgttcactcttcctgtgttaggagaaccaatattgcagtttgtcatcttgtggacattacattctcaccaaagaagcctcctttgcctcctccaactctgtttgacctagagattgacaaaggaatctgcttaggatcacttgggattcttctttctataggcatgtgggacgataatttgggtcacgtcctgagattttaaataaatttcaaaagtgcaatgaggagtcagctttgtaaaagaaaaaaaaagacacttccataacagaatttttttgtagctttcaaatttagctaagcatttgtttcctactgaataatcaacacttacagagcctgaagttataaatgtaagctgttttaaaattatgtacagactttctgcaattattttttctagaacaagaaagtgtattctctttccttttcaggtaacttaaaaagagctgaatatgttgaacttaatgtgctttatgagaatgctgacttcttaaatgaaaataaaaaatattaattttctgcttaggaaatgttgagaacaatcagtctcataatgattttgcattttaactgagcatatccctgtatactgcaaaaaatacactcaaattgcccatagctaccatgaaaggtaatgatgcagtacacttaattactgtttagcagtgcttttttatttgagtattttgaaatattagtaaaagcgttatatctcatatttttatgaaggacttcaataaaaatgtggtaatggagatcggttaaataagaatttcaaaactagaagtgattttttttctctaaaagtaactgatgtcgtctttttagaaaagagaagaacaaaattaccatggaaagcatttctggttttgtctcttcattattcttggcacaattaccaaagatgttttgaagatcttggccatcatagtaactgatcttatctttaaccatcataaaaaatttctggtgtattaaatgtaccaaaatattttaaaatattttttcagttatttgttttgcatttcccattactctacctatgtataccatgttgagaaacagggacaaattattctttgtttgtatcatttcttactgtatttacacataagtacatatgttactaacttcaaagaaaaaaaatatttcttgcttcttatgcacgttctttttttttttttttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacagggtttcaccgtgttagccaggatggtctcgatctcctgacctcgtgatccgcccgcctcggcctcccaaagtgctgggattacaggcgtgagccaccgcgcccggcctgcacgttcttatatactcacctcccacaatgactctgggcttgaccatgtttctttggcccatgagatatcagcgaacatgtcacaagcagagactcaatgcactttggcacattgggacatgcttttttaatcattgacctgagattgctacataggaaatatcaaatctattaggcttttgttcacaaatttgagaacaaatctataaggatcttattgaagaattgccatagtagagttacaatattaatcaaaaatatattaacttcttttttaaattggatgagaccatgtatcctagagaaagactactaactttagaattctgtctcctctttccagatatgagaccttggggaggtcatttaaactctttgtgcctgcttcttcatttgtaaaatggtgataataacagtacctaccttgtaaggtttttatggggaactaaatgagttaatattttacagtgcttaaaatattatagggggtacataaatataatagttgtcaaataaacagagaaggattagacatcggggttttatgaggacaagctctttgtaaaagttcaaagacctatatcagttacatagagagtaaagtaccagaaagaagagctaaagataagggcttataagattcattttattttgggaagaaatctcagggacagaagtaaaggactagagagacaaagaaggagggaaacacaaatacaatcgtatttttttactgctggtccgctgggcttgatcttgcctagggctctgtagactgcgacttagaaccatttgtcccagggaaaatcagaaggcagcgtttatccatgagctctcatccttccctgattaaggtttgcccccatatgataataacttctttggaacttgaatgttgttaataaaggagttgtggttgagtttcttcaggttgctgttttggtagcattaaagaaagcctattgaaaatatcaagatatttttctggaaagcttgagcaaggtattgtcaggttaaacctgttggaaacttatgacaaagtaatgcatgaaataaagggtagactgaaagaatatgaggcaagaactaagaagatgcaatgggggaacaagtagatgtcacctagacttccagacgtttgcatcttaacattgcagaagcaggtgcaatcgaacagaaaaacaagaaagaatagtgcatagaaaaaggaagatggtaacctacttgaagagatgaaaggaataaaataattttcatgataggcaggaagaagagtaattggggaaagcattgatttgctgaatgttttcctgtgctatttcatttttatctaatttttgatagagaagtttgcttgaaaacaaggtaatttctgaggttttctgaaaactatgtcaatgttcattaggctacaccaaacttactattaataaaattgcataattactttataaagtacatataattacttttcaggtagctccatctagcaatttaacaaataaaatagataagtaacatttaaaaattttgacaccaacctgaccatggagatgcatagaattctgtaaataggataattcacttaataagccagaggtgataatccaatctccatatcaggatctgcttaaacaaataaagttagcagtcctcattagtgctgtgaactgtacttagatgcttttagaacggtgctgccatgagttatgactaaccgagaaaaatgtattctatagccaaatgaaatcagaaaaattatttttaaaaaatatcaaaccatagatgaagaatttgaaacgactacataaaacctttgaaaattaactcccaatgtaacctatgagattatttttagttaaaaaatatgattttccccttcactgataattttctccaaaaatctctttcaaccttttgaaataccattatagctgtaaagccttctggcatagctggcattttcattgaactcattgattaatttagtatcatggaaacaatgtgaatctgtgtgaaatagctacagattgtgagagaagttggtgtactttattctgaaatgtaaaaataatatgctgcacaagcatgctgattttaaggaagccatcagtatcatagactgattaattctgtgttgctttgactgctaaaatgtgctcttccaatcaatttcaatccaattaataaaaattataaactggatttgaatatctatttaacattaggtcttccatgcagtttcacatactgtatatcacttcacaagcagtatggcatactggaaaggtcctcaaaatgggagtcaggtagctggtttttaacggcatttctgatgaaaatgatctggtggaaaatttgggatacctttctgcatttacgtattatttatttcataaaaaattcagctacatgattttaaataccccatacattctaaattgtaggatataatttaatatagattcactttttggtgtgacctaggtgaatctgatctttcaaattactagtttcaaactttacacttacacatttcccactgctaattggtaggaaattaacttggtatatttcttatttcttctgttttattagttttgtttttataattttgatttcctttgataaattctgaccatagacattttgagtaaaggcacaatatatcatttggacaatagtcttgttttcatttggatgttaactatcactatgaaagtggagatgccttttttggaagagttatcatatctagagtcagtatctctggcttttttatgtgttagcctcagcaaggtttttgatagcataataagtatcaatgaattaggttaattttttcatagagaatggaaaaatcttaccctcaacctgtttgttagctgtaatgtaaaagagtgtcactgattcgatattgagctttggctcatgctcagatggcttagacagatgggccatacaagactctgggcatccaaagtctcctgcggagaaaggaacaaaaaagaaatttctgaaattcactgagcatcttagaaaatacccaaagaaatatatcagaaagtaaaagtaaaataatgcaaaatgtggtacataaagtgaattgtgtgctcctcttcccagaaaaattagcaaagttaatgccattctaaacccaatcatattgttagaactttcgttgtacagaaattatttctgcttattgacatatgaagatcagtggagcacaagactcctagcttgaaacatttgatcaagcagtgaagatatccagcatatcataaaatgagaatcataaaaccatgctgaaggagtttgtgagtttagccttttctgagtcatcaaagacaaatacttattaatagaattgtatgttataatttattatatgaaatttcagattttattttgagctaccatatcctctgtaagtattaaatttattagtagttaaatatttgaaaataaaccaaaaggtatttgttctccatgtctttttgaatcaagtatcattgtgtaatcttatgtagagaaagagtactttgtaattgatcagtttattaataagcacaatgtttcttacaagagacagccaagactaatggttaaaaaaaaatgtacatacacacatactcctcagtgaagaaacagaattgggtttaaagttgggactatgccttttgtcttctgaaaggccttttgactccttgactgtgttagtcttttttcgatgtaattattacttcccctaccataatgtcatcacacttcagtagtttatttgcctgattgagcataataataattgagggcggtaaatgggatgatctggttcactattttatcatcagtgtttggagcaagccagaaacatagttggtcttcagtatatttggtgaatgaataagtccttatttgtatagtcactagactatacattgtcaatcaaagtggcgcagcatatacatgttaagctgaactcaacttttcactgatccaatttgtgctgcacccttccattgtatgaaatcaccatattccatttttttttctaccactaggtttccttccagctctaacatttcttaattctactgatataaattattcataactcctattgcttgtaatcttgttgctcttccagggctagaaaagtcctaaagggcttgcctagggattaaagttaattccctacagtattcccacctgtacagagccatggcatgggtagtgctgccccaggggaataatcttgggtttatcttggttttaaaactggtaactgaaaaaacaaaacaaaacaaaatgcaaagaatacccacacatcccaatcaagtgacatatatgaatgtttgtttataattcagctaagaatagttaattcacgtcatgcctcatgattaagtgcaaaccatttcaaaatatgaaacaaaacaaaagataatttaaagtccagccaagtaatctctcttgtacttgaatttggatgagatttatttgatcttctcacctaaattccatttataattagggatactcttgcttttctgctgtctcctcactggagaaccaaatggctggagattgactgattactgatcccttggggtttcagagaagctgctttctcataatatcagagttgaaatagttttcattccgttgcaaagatatatgttttaaaatgcttacagtaatgggttgttaactctatccttccctggatgaggtttctatagtaagctgtcattgtattacaactgttttaaaggatagataaagtaaaccaccttctaggtagtaaatggcaaacaatgtgtttccattattgaatttttattttcataagcatatcacatacaagtagtttaaaatcagatagtactaaaacaggcttataatgaaaaatagcagattactggcctcattccctgctggccttatccccaacaggacaacttgctgtcctgctccctgggtcaatagctttcactttcttagctgtttcttctggtgtttactcttatattcataaataaaatatatttactagtatttctgaataagtatattttatacatgtatttattttctatcctccaacacccaaactcccatgctcatccctcctcccctccatttgtcccattatagaatatatcaaaagtttgaattaaagcaatgttcaatgctcacattattttgggtacatagctactgtttaaaattaaatcacttggaatactgtaacttcacattatgttttatgttttatttgtatttgtattaatttatttttttgaaacagagtctagctctgtcgcccaggctggaggacagtggcatgatcttggctcactgaaacctctgcctcctgggctcaagtgattctcctacctcagcctcccgagtagctgggattacaggcgcctgccaccatgcctggctaattttggtgtttcagtagagacggggtttcaccatgttggagactggtcttgaactcctgatctcacgttatccacccaccttggcctcccaaagtgttgggattacaggcgtgagccaccgtgcctggtccacattctgtttcatataacttgttattgtctttattgtaaataattgcctcattttcatattggctatattttctctgtatcattagttcttttccaaaaattttagcagtatcatataatgcttcagagaatgatataattcatgaaatctgtaatctagcatgttatttcctctttgaaatagtgtgcccctcaaataccttgacattttcctttaaggttgtggtttgagatagagggaagactggactcaagttcttgtttgctttcaagaactcaccaagtgaagggagaatgcccctaaaatagagaagccaaagacactctcacccaaaacaaaccccaaatcacagtccccacccctaccctataaaaagcactcccaagtcaagcctcgtttaggaaaacagaatttgaggaaaacatctttgaagctgtaatttaccagcccttgatctttgaggaagatgagaagtgaataatgcccatgtgtttttcttactttccaagtgaggtctggggcttttgggctttaacttttctggatttaacttccagagcacctgcactggaggtcatagttagagcagaaactattcaacccaaaaccaccagagagaacaagagcagacattcaagatccttgtcagctgcctcctgccccaggtgactcacagaaacaagcttagaacagcctactccccttcagccctagaggtgtctcagtttatgtattcattattccctttcatttgtttcttctctacttcttccggatgggtagaccttggaagaggatgccagtcttcctagtactttctcattttggtaggacaaatggtcagtttcatgaagtaatatgtttactcttgctttcttatttcataaagagatgattccttgagacttagctcatgtgttcaaaaatagactggttgtgcccaaaccctactgcatagtagatgggacttaatatttccatcaggctgtgcaccttcttttccaccttgttctttggcatctatgtttctggctgttttattcctcattttggtggagaaatgaggcctcaacctcctgggctgaggcaggagcctccaccagcttcctaagaaagggtgcacccaggagacaaaattctgagacttgtatgtcaaagaattcctttagtttacctttcctctcgataaatctagacatttagggaaaaataatttttcttcaggatgctaaaggtatttattttacagttttctgtcatcttatttttaagatgacctattctgagttctgatttttttatatcatgtgtgtgcatgagtgtgtgtgtgtgtgtgtgtattctttatttgaattttctaaaagcttttggtatcttctcttgatatgttttagtttctttttattttttttttaatttttaacatttattttatattttttcttctcgggaatgcttttggccgggcatgaggtctcacgttggtaatcctcgcactttgagacgctgaggcaggaggatcccttgagcccaggagtttgagaccagcctgggcaacatggcaaaaccctgtttctacaaaaagaaatgcaaaaaattagctaggcatggtggtgcatgcctgtagttccagctacaagggagtatgaggtgggaggatcacctgagcccgggaggttgaggctgcagcgagccatgactgtgccactgtactccagcctgggtgacagagtgagattctatctttaaaaaaataatatttgtgggtatatagtaggtgtatatatttatggggtacatgagatattttgatgcaggggtacatgagatattttgatgcaggcatgcaatgtggataagcacatcatggggaatgggggatccatcccctcaggcatttatcctttgagttacaaacaacccaatcacactctgtaagttatttaaaaatgtacatttaggctattattgagtatagtcaccctattgtgctatcaaatagtaggtcttattcattcttcctattatttttttgtacctgttaaccatctctaactcctcaccagccccccactacccttttcagcatctggtaaccttccttctactctctatgtccatgggttcaattgttttgatttttagatctcacaaataagcaagaatgtgtgatgtttgtctttctgtgcctggcttgattgtagatcttgctgtggctcctttcaatctgttgtcagaagaagatgcagagacaagcatctagagaggaaagaaaagtcacatagcatacaggggatcctgacttcagaagaactggctttccaaacaaattaatagcacaagtgttgaaaggccaaaacaaaacaaaaaaactataaaatttctaagtttactcatcctatctgtggtgaaataacagtgtctttgtcacgtgattattatattcgcaaaaggcttgacttattttcagacatcaatatagcaaaaatcaggcacaacattatttttattatggagcaaattgtaggaaatagtcacacacacacacacacacacacacacacacaattttattccctatataaacctaaagaggactgtcctaaagaggacatctgtgttttagttttgcttcaaaactgaaaactgatgttcttaagttctggaaaattttattaatttttcttcttcttatctctaccattgtcttaattctttttgtaattcctagaattactttttcctactatcttttctatccttttttctgtctttgtctttttgttattctttctggaaattttcctcaaattttgtccaattcatatcaacttttatttttaattttaaattgtatagcttttattttaaaataagagctttttcttgtttgttttctttccctcctttttctatagcagctgttctatttttatacatgtaacatttttatcatccctgcattgtcttttctctgagccatatttctttttttcttttttcttttcttttttctttttttttttttttgagacagagtcttactctgtcactcaggctggagtgcagtggcaagatctcagctcactgcaagctctgccttccgggttctagcagttcttcctgcctcagtttgccgagtagctgggattacaggtccccactaccacgcccagctaaatttgtatttttagtagagacaggattccaccatgttggccaggctgatctcaaactcctgacctcaggtgatcctcccaccttggcctcccaaagtgctacgattacagatgtgagccatagagcccagccccgtatttctttagttttggtctctgcctttcatattgtattctggtctcaccctaaacttgcctaataatttttagtaattaaaaagtaatattttacttttagtaaatattccaaaagtaattgtgcaatattactttgttaatatttttaaatttacttctagtaattaaaaaagtaaatattttgctcttcgtaaatatgtaaatacaaaagtaaatattactttgtaaatatttgtaaatttacttttagtaattaaaaaagtaaatattttacttttagtaaatacacaaatagtacaaggcattagaaactaggtgccacattaactgggtgatcaaacttagtatcaccactaatggaacatatggacatgatggactgtaggatgagacccattgacgactgcaaagtgtcacaacataaaccgaatctaatcaggaggaaaaaatcagacaagttcagattgtggccaattctacaaagcaacctgcttaaactcttcaagtatgtcactcatgaaattaaaatatatgtatatatatacacactatatatatatattctttcatgtaataaaatacatatattttcatgaaataaaaatatatatttttttcatgaaataaaaatatatatattttttcatgaaataaatatatatataagtctagattgtggcaaattctacaaagcgactcacttaaactcttcaagtgtgctattcatgaaataaactaatatatattattatattattatacatattataatacgtattttagctgggtgtggtggctcgcgcctgtaatcccagcactttgggaggccgaggtgggcggatcaaggggtcaagagattgagaccatcctggccaacatggtgaaaccccatctctactaaaaatacaaaaattagccggacacggtggcacgtgcctgtagtcccagctactcaggaggctgaggcaggagaattgcttgaacctggcaggcagagattacagtgagccgagatcgcgccactgcactccagcctggcaacatagtgagactctgtctaaaaaatatatatattattatatatcgtaaatatatattatattatatatttagtatatatatttattatatattttatatatataaaataggctggggatgttttatagttaaaaggacatgacaagtaaatgtgatgcctgcttcttgattgatcctgggacgaagtggctgagaagcatgatctggggtgagtaaccaataaacaaagcagcctactgtgattctgttggaagaaagccttgctttttgtgctggagcatcgtcagcacttagatgatgtgagcttttctacaacccaaccatctgctttttatctttcaaaacatctctcctcatatcttacatactatagcctcccctgtgtgttttttgtgggtttatattattcttattatagttttatgagattgccagagggagaaataatttatgttcagtatgtcttattaaatggaagtcaaatatatttttaaggatgtaacttcttttctacagccccaactttgatcttatacattaagcataaatctaagctaattctaatttctagtcaaaggttcaaatgactatcaattcacttcaacaaaatacatacctgtggtatttggttttctgttcccgcattagtttgctacagatcatggcttccagctccatctatttccctgcaaagaacacggtttttgttgttgttgttgttgttgttgttggctaaatgattagaacccatggacacatacaggagaacaacacacactgggactttttggaggatagagggtagaaggaagagaggatcagaaaaaataatgaacgtgtactaggcttaatacctgggtaatgaaacaagctgtacaacaaaaccccatgaaacaagtttacataacaaacctgcacttgtacccccgaacttaaaataaaagttaaagaaaaaagaaattcataccaatttaattgcttttaataaattttggtgagtagtattaagaaatcatatgtatttacatgataatggttaaatgcttgtgtgcaggtatgttagaataacctagaatttagtactttggttaaggtccaccttggagattggtgtatgccttaagcttcaatttcccaacttttaaatgtcattaataataattataaatatttcatggtatttttgagaaataatacatgccaatgacttatgacattaataaattttatgatttctgtaatattatcttcataatgatcaatgatgtaatatcattgagaagtatcagaaagtagagatgtttcacaaacaaataaaaaatcaaacaaaacccaaaattggaatgtgcattataatgatgtaaaggataaagaaggatgaatcaaaattaattacaaataatcctctaaacgtttgaccaaatcagaattcatatttctccttcagataaaatttctctttttcggttgaaagcacagagaaagaaagtggaaatttcagatgttggagaaaatattcggaatttatgtgacactggataatactaaatgctcattctggtaactgcaaccttctttcaatattcctctttcctagtaaaaccctaagcatcacacaagaatatattttttcttctgcttttctccctgattttggaacagtttcttaacattcccacaaaaacatggtttgaggtaacgacactatcgactgaagaaggaatgagtttgggaagcgttgagatgtgggaaagactaattgtgccttcatataaagactcttagaaaatgacctcaggctagtatttccaatcatcttcaaatcttccgttgaaagaaagtgactgctgagtaatcatttgcactcagagttttgcaaaatatttgagatttagttaaagaaaaggggaaagaagaatccagtgctactgacaactgtggtacccagaccaatgacagcaaatgagtctgtgggatcatcttcacagcctccgaatgacagagcatcaatgaaatgaagaaaatagtgctttttgcgcttctattatcttctaactgataacgtgcatacattgttagtatttttccacagaatggtttatgtcaaatacttaggctaacagcatctgtactgagaagactctactcaggtgcttagaaatttttctactgaagtgtttttccagtgacaaagttctttcatattcttcccacctggaaacataatggcatattcacagttttcaccctgaaagtgtattaggtatgacataatagatgcctcattccagctaagagttgctaaataaataaatccacctggcagtgacatttatactagtttcgggaaatttttctttggcagtagagaccttgataatgcaacttaatgtggccatgatggtgtcttgcattgtgaggttaataggaccaatcagtggggatgaattatggttcacctttacaccattttatccctgctttgctgatatagacctgaaacagcctatctaattcctttgggaattctctaatggagcctccctaactcaagttactataggatgggtagatcctccactggagctgaaagcctcctgttgggtcctcatttgtttagtttgttatctctcgatacttgcttaattctctggaatgtcttcatagatgtggctggcaggcaatgccatttaatcattttttttttcctggttagccttatagaaaatgtttctttttttctggatggtgaatacataaaaatttattaaatataatcatttaaagatagggtaatttaaaagaggcataagcttaagcatatctgcatgtagcctccatattttgttcaaagatgtgtgtacattcagtgtaacataaatttaatatttgttgactaagaagcaaaaatatattgttaacaggtattctatgacacagttggccagtcagcaactagttttcttcagatcttttcaaaggctgcttgttgtcgctttatccaaaggagttgatagatgtgtatgaagcattctggctgacccatggcaatttgtgtttggaagaatgagatttagagccagggttagtacaccatgtggattgccatgggcattatttaggtgtagataagcttatctgaaattgcatctggattacctgactaatccaaaaaaggaaagaaaagtagagacctgctatggaaatagtcatgaaacaaaggagcgctaggggagaggtgggtaactaaatgctagtttttaaataatgttatatcagacttaaaagatacatggaagataagacaggcctaagagtttgctagcagctggatcagattgcaaggaagaatctcagtctatcctttattactcaagccagagcacaagactagtttccacattttataaatatagagtcttttttggagactgtgaaatttggatagaatgttttatttctcattactgtttacagattcgttatgaccttggcctgtatacactttcatgacaggttaagtgaacagaggttaaaggaggcaaactgagagtatttaaataaagtttacttgctatatttgtcttatctccccatgaataataaaaatatcatttattatatgtattacaaaatgttctaagtgctttatacacctaatattagtatggttatttcacacaaattttatgatgtctgatttctttttctttttatagatttggaggtacaagtacagttttgtttcatgcatatattgcataatggtgaagtgtgggcttttagtataaccattcccagaacagcgtacattgtacccactgggtaatttctcatctctcaccccctcccacctgtttgcatctccagtgtctatttttccactctcgatgatcatgtgtacacattattttgctaccactcataagtgagagcatgtggtatttgactttatatttttgagctagttcacctcaataatgatctccagttccatctgtgttgccacaaaagacattatttctttctttcttatggccgagtaatatttcatgatctatatacatatataccacattttctttatcgcatcatccactgatggacacataggtggattccatatctttgccattgtgaatagtgctgcggtaaacatatgagtgcaggtatcttttatagaaacttttatcacctctatttaacagctaaggaatctgaggctcagagctagtaagtggtgggtgtgggattcaaacccagggagtccaatgccagagtcttaactacttcaccagaagcagagggaaggggagccattttattattcttgatttcaaataagcggtagtttacagttagtactgcgtacacattacatgctcaacacataatagtgctaaatagttttttttgttgcatccctattcaggatgggggtaggtgagccctcctctcccagtattcctcatccttagaaataggcactaaatagttccagatcacagtttaaaactattgctatgggaaatgaattgaacaaatcatgtgcttaccttcagcactaatattctaaatcaccttagattaatgccagtaaataccaagacagttaaaaagtgcattcgatgtaaataactacaatgacaagttcacaaatagcaacacaactaggaattccacgtaggagcagaatataaagtaaaatgaaatgatgatctagatagacagatgatagatagatagatagatagatagatagatagatagatagatagaggagagagagagagagagagagagagagagattagatggacaggtatgtagtttcacctataagcaaaggcaaaaatgagtatctcagaaaggcagatttagggaccactaagattttaagttgcatcattctgtaaattggagattatcacttactgtactgtcacaaatttcagataagttaacattcccgaatgttcttggcacagcataaatgctcaatatcttcaattatcatactttttccccttcatccctgccctgacacatgatagatcatttcttaaaatatactacagcatgtattaaataatatttctactgctcagttttctggggaaaatagtgtttagttaatttctaggttttgttaagaatttacaaaatatatttcataaatgtgttcttttcctttcagaaataaatgtataattttactcacaacatttcaacaactttcctaacttgcatacttcatttttctagtgtttcataaaagttctaaatttaatcatatgatattttaaaataagatattaagcaagaaaacacagcatctattgtatttttaaacgaatcttatggtttttattttattatttcaattactgttactaaattattaattctaggttagaattataaagcattatcaaagatacagtagattgcaattagagtttacttgatttggcaattattaaaaaatgaacatttttttctgtgtcaacaatgaagtcagttaaaatgttttgtggaactaatatgctgatagcaatgctgcagaattaaaagtcgcattattattacacaaacattttgctaaagtttggaaattattcctttattggggttctgttagttttggagaatatttatatacatatatatatgtgtatatatatgtatataaatatcctgcaaaatgtagacctttcctcttagatcagtactagcatgctaaatattttattttttaaatatatattaggtaactgaaacaaagaaaaaaggtttttatttgcttagagagataacaataatacttaacttgtaaaatattcctttgatacattcataaataagaagataaattttctaattcttatctgagaagcatagcaatttactttttagaagcttatacattatggcatcctttgattaatgcagtacattttttctcacaatttataatggacttccaataatcttgcctttaaactgtatttgacctcccttattttactttccaactagaatgaagagatgggctactagttgtagttcactgtagaggctttatgctatctgaaaattttagacccagtggctttaataacattgtaaactgattctgggtccattttctcttgattgacatgtctacttccacatataatggtaaatgccttgacttttctgctccttgtgagtagattggtttgcagatttacataaatacatttcccggagaccacatttaccacatttgctcatgacagcaatgatccttggtcatttcacatgctgtagttacatgccattcaggaggctattgttgattgcctgtcatttctcctgcctagatgtcattcaaagggttatttgttattttaatttataggaatttgtacattaagttcaattaacctaacagggccacacaatgagtcaggttcaaatgaaagctgcagatattacttgtgaaagttaccatggaagatgatgaggaaggagtttttatgactgacctgtggagttagacttatttgtttttccaatgatctctactccttatgtttccaatagtttaagtgattttgaaatgaagtttttcataatatctggaaatacccacccctccaaatttatacccataccagtttacaatactttagacatgacagtatataagtaggaataatccattgttatacaagccccaaaagagaaagaacaaaatttgagggcagattggaatagttaagatattttatgtagaactatgtcaatattaattttgtataccaaaatttgacaggcttttatttatttatttatttttgacatggtcttgctctgttgtacaggctggagtgcagtggtgtgatcttgcttcactgcagcctcaaattcttgggctcaagcgattctcccacctcagcctccccggtagctgggacttcaggcacacgccaccacacctgactaatttttgcattttttgtggagagcgtttcaccatgttgcccaggatggtcttgaactcctgggctcaagtgatccgcctgccttagccttccaaagtgcagagtgcagggactataggtgtgagcacctatacccggccccaaacttttttttttttttttttttttagcatatcagtgtattagttcgttctcccactgctaatttgtaaaggaaagaagtttaattgactcacacttccacagggctaggaaggaatcagggaacttataatcatggtggaaagggaaacaagcatgtccttcttcacgtggtggcaagaagaagaatgagagcagagcgaagggggaagccccttataaaaccatcagatctcatgagaacttactatcatgcgaatagcgtggaggaaatccctgattacctcccactgggtccctcccacaacatgtggagattatgggtactacaattcaatatgagattcgggtggggacatagccaaacaacatcaaccggaatcttgtattgcaagtttttattgaattttaaatcatgaagctaaacacttctttgataaacatctagaaggtgagaagtagctcaactctggagtaaggctaaactgggtctgaatatgttttatattctctggactttgaaatatgtctcttgataataaactagttaggtctctctgtgaaaagtcaaccctgcttactctaaaaatatatatatatttatttggcctgtaaaagtttaaggcccaccagggcagggagaggctggaaatcaatatttttcttatgaatttaaaattttagaaaacctatttcttttttaaaatacttaatatttaataaaaaatatatggatttttattttcaatcctgtcataataacctatgtaggtagaattgccttgaactttctctttcctctgttaaatataaatgtttttactcatttgtttgctgagttattttttataacagaatacattttctttttcctttctttaagaacgttttgacaaataaacatatatatttgtggtatacaacattgtgttttaatatgtttacattgtagaatggataaataaagctaattgtcatatgcattacctcacataatttttggggggtaatgagaacactttcttagcaattttcaaatacacattttattaactataattaccatgatatacaatcaatctcttgaacttattcccattgtctaactgaaattttgtatctgttgagtaacatctcccccaaaccttgtcccttccctccagtctctggtatgcagcattctactttctaattctgttagtttgacacttttatgactccatttatacatgagatcatgctgtatttgtctttctgtgccggacttatttcacctaacatgatgatctccagcttcatcgatgtatttgcagatgacataatttacttctttttaagtctgaagattattccactgtgtatatataccacattttctccatctgtttatttgttgatggacacttaggttaattctaaaagttgcctgttttaaatatgctgatgaacatgggggtgcagatatagcttcaacatactgatgtcagtttctttgactatatacccagaagtgtgattgctgtaccatatggtagttctatttttaattttttatgactccatattgtttactgtaaaggctgtagtaatttatattcctattaacagtgtacagggctccccaccgcccttgccacattcttgcaactcttgttttcctcttaattttattatttctacttcagtttccttaactaagaagagaaataaatttgcttgttgcttattttgggatgatcccacaattattatactaattctgttagtataataattataacacttatggtgtctttctgggaaaactgaactaggtggttaactgcagttctgggaaagtctagaagaaaaagtccagttttggtaagagaaccctcttgcctttttaccttccctgggctaggtatggttcctgaggcaaacctccctccctccctccatccctgcctcctaccatagcgaaccaacaatttcctcagtctgaactgttccatcatgctatgagtgactcttaactattcatggaaacttctagaagtaaaatcccgaatttgtgcaatgagttaactggagaaagctattctagtaaaaaaaaaaaatatgaaaaaaaggaggctgggagacagcaaaacttctttgaattaccattttcttccctggtaggtattgttctcgactttgtttctgctatagtaaaatatatccaggtggagtaactagacaggcatgaggacttgatggaaaagaaagcatggatagtcatcacattcaagttgttttagttatctcttataagcaaaataattgagaagtaaggctgtcacataactagacagtgaaagttagtgagagaaggaacaggctgtgatctttggaaaggagatttctatttttgcagaactgctgagaatagtgagtaaaagtctgcataagacatactgagtgaaagtttggggttgttttctttaggcccatgacataactagctttgaatgataagttaacaatgtgaacatcatgtgtgcatagaatcagctttttaactattagttgttgattgtgctctgggaaaccttagtgggacactgaaaaatgagttaatgttaaataaggagttgcagaggctgacagccttggaacctttgggcacaggcatctgaataactttgcaggaatgacctgataattcttggattaataaggaaattctccctttacagaagatgacgtgcagattattaaaaactgagaatcttttttggaacctgtggcaaacccaaactcacccaatctatgtcataattttagtgacttggtattgtttgattgtaatgactaacaagcaaaccagaaagtcttccagaacacatttaagaagttacgaaaagggctatagatgaagaacaaaacagcactatttaaatttcattgcacacctaggactacaaaaaatactactttgtagttttcttgagtctatataactttcctaatgttttctatacattctccctgccgctcagctaacagctagaaatcactttgtagaataaaagggctgaggattgtatttatttccaagacagtagggcctacagaggctaaaaatcagcatctcatttttcagtcgatatggccagagactaggcaagtaacggagctggtggcagagaaaaaaataaaaaataaaaaataagtagattagggagaaatggaaaagaacaaaggcagctagggcaggtcaatgaacttgacagagaggaggcttctatgttccctcattttttccccggcataatattttgtgatttgacatttatttgataccccatcaatctgttccttggaacacttgtactgtagttgattttgtagagtagcacatgcttatttttcacatatataaattgtgtgttcaaagagtatctttatggtttactttctgattaataggctctgaggatattttgcttatcctggtgaataatttacatctgcctcgtgtgttttgcattttcctttggcttcattttcattccatgaaattttgcaagatgcgttctctcctttaagtggatgtgaatttctactcagtgaaaagcaatctagacaaaacagtgtaatttattagctatttttcttacaaatctcctacaacaaaactttattttatcactgccaagtaacatctccagtctgttttatgcaaaagaaatttcatatcctgattggtcacagtgtaaagttggtatttaagaaatatatttctcatatttatagctataatgtaaaaagcataaaatgtaaaatttgaaaatgtgttttattttcaactaagggcatgaaataaatataacttttataagtattatatgtagagatgaattttcctcagaagttgaaggtcttccataagtatgttcatatataatgatcttttatacaatttacattgcgcaactgtaccacttatattcttaatagatgagtgtgcgttcatttcatgctgttaatatctgcaataaaccttcaaattaccaactattttattgatactgtgttttgtagagcaccatcaacgtgtgaattcttaacctgtgcttcagctgttttctatgtatttgagctaaagtactatctacactttgcatgtcaatttttaagtctatatttttctcaatacaaaagagatcagagacaatctctcctgcttggttcagggaccagaaacacagtaggttctatccagagtcatcaatagccattgttctttttattgttctaaaataaaatgtaaaaccataaggatagcttaatcatgctacagacgaacttatgttacaaaagaaattatttacagtaacactctaattatatctacctgccaaaaaggaagtaagcaaataattataacacaaagtgataagtctttaagtacagtatactgtgagatattggaattgtttttgcagaatttgaaaaagttccttagatataactaggtttctatttattagcctatataaacacaaaaataagagaaataaatgtaagtggtaaaataattagacttggtgactacatcaaaaagttttacttaaaactttggcagatttaataataaatttcagtgaagtttttatagatatgaatcttccggttgaatttttgactttgaataacttaatcaaatgcggctctggattgcataattatagtttacacttgcataattgcatttttatacttttgccttatttgaagtattaaagtaattatttattatttgttacactatacattgaaattaatgacctagtcacacactcacttatatatatttgtatgtcttatggaagttattcatacaaaatgttgagattttaatgaattctaattgatactcaaacttgtcatattcactctatatgcatttcataatttttggtaagggtgtggctatagaggttagccaattcacatcaatttttaattatatactttttcaaaaactataatcttctcagtgttactaattatgaaattcataaaataatatccatgaaatgacttgggtgataatccagtaattatcaatagtcacttgctatcatattcggatgacataattataacttagactaacaaagtttgggtcatttgatgaatgggtggcttccttttattttattacaattatgagacttgttaataatgtatagaatttgtataatattaggtttaaatttcttttctgctgcgattttgttcgtttgtaataaaactatgaaacacactatttgagataatgtgaattcgccatttttatttttgatcagtttctaattaatacatttacttttggggggaaaagttgatcaataatgagctgaaatattgcctttagccctaataaagtatattttggaaaacaaatgttaccttaaaatgacaataacaacaacagcaacacaaaccttcacataataagagcccaaatgagatagtttaaatctagcttaagctctacttaataaacaacaataatgtataacactattggacaaaacaaaatattaaaaacctctccaaacataggtctagaacagagactagcactgtcttcactgggatagtcatgaatttccagtttcggtgtactgagattcagtcagaacttggacttaaaaaacaaagacactttgggaggccgaggcgggcggatcacgaggtcaggagatcgagaccatcccggctaaaacggcgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaacaaagaacttggcctcttggttttagtgacttggaaataagaagatgaaaagatgaatattcactgaagaactctttctttctcactcttttctgcatcagtgttttacaagtagttgtggagtgagttatgctgaagcagatggggacgcagagaagccagtagcagatgggcacatccaggttaccctgcatggttgggccgcaaaccatggcctggggtggaatggagaaatctgtacacatccttttcacttgtgcgttttagcaggtgcagcatccgcagcaacatccttaatgctttctccccagttcaagcttagtttctcccttagactactgtaataacttcctaactgatttctccatctcatttttttcctcctccaatccaatttcaaattatcagtcagggtgatcattttgaagtgcaaatcaacttgccacaataagttatccattggtctgagaataaaaaccattctggagtaactacaaaggcctgcaggatctggaacctgaacgcctgtggagcctcatctttactgctcagccatcccttccttgcccctcccttctcctttgcatcactccagcccacttgccatgcttcttccctcctcgtccttctgctggagttggccttgggcttcaaagcctcccaaacttctctacttagctaatttttattcatccttcacatgtcaactcaaacttcatttcctttgagcagtcttcccctccgttccacattagttccggtcttctactgtagcgttcaggatgccctgtacattatcatatttgtaatgacatatttatcaatgattaggtgatatgtctttctaagtacagagttactggcctctgagcacagggcttggcacatgatcaaattttagccagcagagacttccctcaagatatttggaattggaagtaaaaaggaaatatatttcccatctggtgcacgaagctgacaaggataaatgcaaagttggagataagagaagtggagatgctctaatgagccttgttgttgtccctgaagctacctgcagccctgtcctgatggtaatttgggttgtaagtcaataagcatcctactttcatttttaagtttgttgacttgggtctctctcactggcaaggataacaaccctgactgaaagaatccttacattatgaaactgtaagttccataagggctagaatcttgcctgctttgctcagcaacgttgatacctaacaaaagtttgttaaatgaatgcatgttatgcaataataaattcattttaagttttctggtagatatagcctgtcatcacactttcatttgatgtgatctgaaaataaatttttctgagatatataagggccattgaatttaaagataactaatattacacgtaggtattatttctctctgaatttctagaattatacgtacagagagaacatgattaagaaaacaaatacgtaacaggtaagacaaattaaactggctagtgaattttttgatactcggaaaaatcagatttttagtttgtgtttgaagcaaatattcagaattatcaggacaggtttctacaaggattttaatctgattccttcaccaaaatcattttaacatttagctataagatatacaaatcatatttacacctactgtgttaaaaaaaagtttaacctttttaggacagaatggggccagtacaatcagacttatgtaagaaatcctcaaataaccttcttttgtcacgatgacaactgggagcaaataatatttaaagcatgagtgagtagttggaggagtatttgacagtttctgtgaggaaccattgactgaaaacagtgatcaacccactagatattttaaagtaaatttaaatgagcaaatcacaattcctgtcactgagaatgacagcactaattgtcaaagtgaggaccagaggttcagagctaagtggatgtttagttatatgctaatagaaaaatgcttcctaattaagatatgcttgaaagttctctctctgtctttcatctctatagcctatatttaaatctcctgactcttcataaatatgcagtggtgaccttaggacagggcactgtttagcaaatatcttttaaaatcagaatccacaaattctattttttaacaaaatgttgtattgcatcgtcctccttaggttttaaaaacatacatgcacatttaatgataaaccaatgattttaaaaggcatgtgaactgcttctcttcagacatggttgaggatttttgaacatgatgcaatatatttctttctaggacagttacagaactggacttttctttcttcctggtgtggtttattaaaacaataaatcaaagcacgtagaataaggagctgagatcttgagaggctgacatgcagaaaagctgagatattggcaaggcttaatcgttgaagcacccagtcaaagactcagtcagaagaggaggtggaggagaacagccaggaggacaaaggggtttcaggcttgggctgaacctggcatcacacagaggggactacacctcctcctctggggactaccttgagtcaacctcgcagaaccttttgtatcagagtaaggtatctgaaaaaccagagcagctgctctaatggttcagggctatcatccttagatctgaagggtcatggctacacatgcatagaatatggaaagcagccaggtgaaggcatcttccacaggctctcatcattctagtgtgtgtttttcaatgcatcatttatgtcagaagtgtttgaaaaaagctgttacaaagttagtccttattttcatagatcactttctaagtaaacatggtctaaattataggatgagagttttgatcaatagcatgcctgtattgggtgctaaaatagtgccttgggtacttgacggcagaggacatcagtaatgtgaagaaggctatagaaagaagcaacagtagacacagaataaaactgtgcttttctaattttgtctaaggttttcgttacaaagagtcaggacaacatgaataactttattatttccaggaataccaaaataattggtatttatacttaatttctagttgttttgtgtcttgtggaaaaagcatgatcagttaaatatggtgaagtaattaaaaatatggagataagtatagtgagaatcatcattacataatttggtaggtggtgtcatgctgttactactgtggttccatattgagcaaacattcaagtctcatgaaatgtacgattttaccaactcaaaatataaatatcttaagactggacacattaaattcactgttatagtgtattactgtttataatgtgagttacaatcttgtgcaatcattttggtgtgccacggctacgcaagctttgattgaggagagaactgtagagaaaaccaacatagacaacctcttccaggaaacttctgggatagtcatcaacgcagaaacttcatttgcctcctaatcatctactgccatttccccagaagctcagaaatgtgtgacttcacatggtcaatgaacattgaatatacagttgactcttgaacaacctggctatgaactgcacggttcactgtaatgtggatcttcttctacgtctgccaccactgagacagcaagaccaagccctcctctttccactcctgcccagtctacttaatgtgaagatgacaaggatgaagacctttatgatgatccactttcacttaatgaatataaaatatttttttcttattttcttaataatattttctttgttttagcttatgttattgtaataatgcagtacctcatacttataaaataaaaaaatgttaacagactattatcaacaaggcttctgaccaacagtaggctattagtagttaagttttgggagagtcaaaagttacattcagattttcaactgtatggggagtcagaaccacaatccccattttgttcaaaggtcaaccgtatctggaaaaaagtcacacaaatcttctaaaatagatgaataaaaagttgaaccatattaattgcttcaagcaaaattaaccattaaaaataagcaattcattgcactttatagagactattaacagaatactttaataaaaataggactttttttccttgagttaaggatgatttagtaaaataaactggttgcaaaaaatgtacacaacaagcagcacttatacattctttagcacagaagggactgcctcagagacctctttaaattcttaaggcaaatttaaaatcttggcaatttcctcgaaggtgaacaactaatagtcctttgtagggacatggatgaagctggaaaccatcattctcagcaaactgtcgccaaggacaaaaaaccaaacactgcatgttctcactcataggtggcaattgaacaatgagaacacttggatacaggaaggggaacatcacacaccagggcctgtcatggggtggggggaggggggagggatagcattaggagatatacctaatgtaaatgacgagttaatgggtgcagcacaccaacatggcacatgaatacatatgtaacaaacctgcacgttgtgcacatgtaccctagaacttcaagtataataaaaaataaatattaggtaaaaactacttaataagcatggaagcatctatgtagatatttgaaataatacacagatattaaaaaaaaaagaatcaagaaaagagagggtccttgcactcatgtgggcctggaatcaaatccacaccgaattcacatgccttcattggtcactttagcttcagaacccagccttctcatctggagaatagacacaatgatgactatatatataataatctcatctaatccttgcaacgatcctacaacttagaatatggtaggtgtttaatttatttttgtattttactctatattttcttacccatgataaataaattatgttgtgcatcacaactctacttggggaatgtaaataaattccatgaagtcattcaagacgtcattttaattttgagtcagtgtttcttctccagaaaaatcaatacagtattaaatatctaaaggtataagtcattttgcgaggctaataagatgacaccttttataatttatgatttaaaaaccattgcttaaaacaaatcacttgaaatcacctaaaaactagccaatcgcttaaaaagaaaacaaattttaaatagagttttagtagcaattaagtaattttttagttttaaagatacattagaaatgtttattagttggaaatgtttatccatatagcacaggatgaataagtgattacataattcaagaagtaaagcagaaaacattcaaccaattagaatttttgaacatcttgtcctttaaatatcagatatgtcaatatgataaataaatgatatctaaaacatctatcacaaaaactgggtcatgatgagaatatttatatgttaaatttgttagcttttctaattttctcaccttcccaagggtaaaatcatgcttatattcaagattaatcactgcatcctcctccccaaaggctttctacccttccactaagattttttattcctaatacaaagccaaaaacctttacaaaaaccactcttcgaaaaccacctgggtcagggtgatagagaagaaatagtaatgcaccagaaattacagttccaaattctttacatccttgacatttaccacttcaaggtctcagtagtatgaaagcagggcagtggggtggatgcaatgactttcaaggtccttctgacttggtctttctgtgtgtcgcctgtgctctgtaatgattacttagaacaccccttaagtgagaaagttggggctggacagaacctaacaatcaaggacctggtatatttgcagtaaagtatctattccaactcctctcactgttctctcttgtctctactctggactttcccgtatttattttgatgctaatattcggagtgatgttgatgtctcatcacgaatgccattccctagagcaagcttgggcaaatgactgcctgtgagctaaattctttcaaccttttatttttgtaaataaagttttattggaacccagccatacccaattgtgtacccttgtctctggctgctttcatgctacatgggaaaaactgagtagttatgacagaacctctatggccacaaagtttaaaatatttactatcttgctatttacagaaaatatttgctgacttctgccctacagaaacataagcaaacagcagtaatcactaatatcaattaaatggatattattggaactcttaaggggcactttatctatagatatcatttttttgacttttattttaaattcagggggagacgtgcaggcttgttatataggtaaacttgtgtcatgggagtttgttgtacagactatttcatcacctaggtattaagcctggtaacagttatttttcctgatcctgtctttccttctaccctctaccctctgatagacttgagtgtgtgttggacccttctatgtgcccatgtattctcataagatactaatttttatctttgtgaaattttgtttccttgaccaacatctccccaatccctccactccccagctccaaaaaaccaccattctagcctctgcttctctgagttcaactttttccgattccatagataagtgagatagtgtggtgtttgtctttctgtgcctggcttacttcacacaacataatgtccttcaggtttatccacgtgtttgcaaatgacaggatttccttcttttaaggctgaagactattccatggtataaataccaaattctctttctccattcatctgctgaaagacacttagggtgattctatatctaggctattgtgaaaaatgcaatgaacctggaaataagttcaagacatttattatacatcacagtgactatagttaataacaatatactatatacttgaaaactgtgaatagagtagatttttttttttttttttgagatggagtcttgctccgttgcccaggctgcagtgcagaggcacgatcttggctcactacaacttctgcctcccgggttcaagcgattctcctgcttcagcctcctgagtagctgggattacaggcatgcagccaccactcctgactaatttttgtgtttttagtagagacggggtttcaccatgttggtcaggttggtctcgaactcctgaccttgtgatctgccagcctcggcctcccaaagagctgggattacaggtgagagcccctgtgcccggctaatagagtagattttaaatgttctcaccacaagaaaatatggtaagaaggtgaggtaatgttaattaacatttgttaattaacttgatgtagccattccacagtctacacatatatcaaaacatcatattgtacgccataaatatgtataattttatcaggcatttaaaaattattaatttttattaaaacggttataatagttccaaccgtgttgtgtgtagattcacaaccattagaagttacaaattgccacatataaagggtggtataatataaagtcagttttaaagagattggcatggcattttgtactgtatttgaaacatgatcaacattgttatttttattttattttattttatttatttacttatttatttatttatttattttatttgagatagagtctctctctgttgcccaggatggagtgcaatggcatgatctcagctcactacaacatccgcctccctggttcaagtgattctcctgcctcaacctcccgagtagctgggattagaggcatgcattaccacaccctgctactctattttgagtagggatgaggtttcaccatgttgatcaggctggtcttgatctcttgacctccagtgatccactcaccttggcctcccaaagtgctgggattacaggagtgagccaccgcgcccggccaacattgttattttgaaatgtttgtatgagaatagaacaaagcagccaccttccccctggagccctgcaggtcggctcctgttaaccaggagccagggacgtggccaaacaagtaacaaagtcactacacgcttcacagccgcaatgctcttatctgtaaatcagacaaaatgcttgtgtataaatgtctgcaaagatgtttccaataaaagaaagatttggtttgtggatgtgctttgttattcttcttattaatttggggctagagacaagagaagagtctcagggaaagaaattccttgtttgaattaatttagtcaaatcaggtcagagaatccagaacaagacttagctgatgtttcttcagggcacatatgtgactgcctttccactgtgaataatatctactcaggccatgtattcattctaccacttgtgagatttatgtagcattcttgcctccatagtgctaaagatgcctggtagggaagtttaaagttactgcagcaatttcttttcggtgcatattaaagttgtggtgccttatctatgaggcggagctgtaagtcgctgtgatatcttgcttcgaattaattcactagttacattcaacggacatagaagtagagtttggcagtttagaaagctggcaaattttctgtggctcctcaaacattactgtaaaatttgaaagctttaatatgaagggtttcagtttagtcacagagtaaacctaaaatcctgggatgactgcttcccttttatctgtgcctcatgaaaatggatacatttttttatacctcatcagatagacttttaaattccaatcgtatgaaaatgaagacccccctcagttagagtagaccacaaaatgtggctgattgtcggtgaatcaggctattacagttacacaaactgcgttgcagagcaaaaaacaaaacaattgttactgtaagtaatgaaaaagcagcaaaatgcagccacataatggtaaagacatgagacttctctagtattttaaatgaaaaagcacttgactagctgagcttggtgcttaacacatgagaaagatgcaggaaagaaaatgatcaaaaggcatggtccagcctcatgagagaagagggtctgcatgtcgtgagggccactttctcaatcctgtttggatcttatttcacggcttcaggttggaccttccacttgcaacttgctgtggaggtgctcttctgcaagtcccaagatcccaaaaaggaaatacaggagtttcggtgtttttgagcaaaacaaagtaaaaagctgagtaaggaaacactatacatagctggaaataggttattttctatttgcagacaaagaacaatataaacaaagctcgagatcatctgggcaggttgaaaatagcttcagtctcaaaacagttacacatctgatctgatttcatcacattttaatttttcttcctctgcctcatcttcctcgttctccttttcttccttttacttgttcttcttcttccttatctctctcttcctgtttctctctttctcctgctcctccttctcatacttttctgcatttgtactgcatgtgagatttcaactactcaaatgaattacactcataattttcccgagtggggcagagagaagggggactttcaaaataagcctttaaaaggaaagcactttttacctatatttttcttttcttttttttcttttttaaaagttgagcttataagatcatgcctggtgaagctgtgttcatccactcctctcagcattagtggaagaattagagtattaacgaccttatagaccaggtattttgtagcctcctttacagtttgtcaagttgttaaaaattgatacaagaaaacttaattatttcttcagagaaaagctggacatgtgaactatgttaaccataaaacttgcctgtcttatgtttctataaacagccaggtttgaagcacaagggcaaacctatgcatctatgtgtatatacacacgtttctattttatatgcatatatttacatgcatgtatagtttttgtaaatttattcgtgattcttagtggttatcaactaaatatgaagcagtgttctagctgcttaaagagttggaagaaaagggtggtgtcaactctgcgattttgctgatcaaatcgagattacagatacatgttttgcttagcccacataggattgttttaaattacattttgctgtgtttctgcttttagaagttgagaagtgccccatgagtatccagagcttgtagcttctcttgagaaatctgaaggtcttgcaagactagacctgctgccttccccagcagcagccgtcatctggaaggtgatagttgctaataccctgagtcaggggagactatttctccatagtcctggcagctgcctactgtgttatccctgagcttcactcatttgttttctggcctgatcctattgttatttcgagttcctactcctatagatctataaggggtgactgaaggggtttggaaaaagactaggttgggggtcagttgtggggtattgtggcaaaaatgctgggtttggaagtaggtggtctctctgatgagcttgcttatgcctggtatgcacccatgatgttttccacaacaaaaactagaaaacacttgccaagtatctgggagtggaataacaggcttgagagaaaggtccccttttggcatagaggcgtgcatttaaaagcctttattctgctgctaaatactatttgaaagagaataaaataagtacagtctcttttggggggaatagggtggaaaaaaaggagtgttatttgcaaatatttcaaagtattctataatgactaatacttgtaaaaagtaacttaggaagccttggcagcgaagggcagaatgccatcggttaatattccaagttttgtgtgcctagtgaagcaagttagcttgtaacagtgcttcaactggaaaaatcacaattgacagcttcaattcataaggagcaaagcaccacagtccatgaagaaagtaactgccatggtgagcactctgcatcagggagaaacacacacacacataccacaccacacacacatacacacacacatacacacaatgatcaccttcctggaggaagaagagtagtgaattttaaaatgaatactttttatttgtgtttttctgttattgccaactttaaaatgtactcgttttgattaagctaggttgtgttacaatattaggaattaatttcaaacacattgtgtttttacttcaaaataatttacttcaaaaaaatctttatgtgtatttacaaaaatagtacagctagtaaaatgacactgtattggcttttattgccaaaagaaaaattaagtgtaatgcttaatgaactctttgaaaattttaactgttagcataatgcaactcattctgatttccattagatgtatctattatatttgacccacatagtttaagaaacctgtaattaagacactccacttttgaatcataggaaaatctctacatcttatcttccttataagtttaaaaaaatttaaaaaaaatttgcaaccaatcaaagtcatgctattccttattttaatgccagttttcctggtattttcgataaatttaaaaaattacaagtgatatttatatatgtaaaatgagggaaaattctacaactataaaatcaaattgttttcatttcttaggaagtcaatataaatggtctttcagttgataacaatgtctgttcattcacatcaataaataatttcataattccaaggctctctttatccaattgtattttaaagagtacacattttgtgatagtttataaattaaaggatatatattcaaagtcacataaaaaatatttgagttaattacaaagtaatcatggaagaatattccttacatttctatttattattgcatgaaaatggataatttcataactttttatatataagattccaactggcctttatttcattacatataaaatgaaaaaagatgagttgatctgacagcacagcccaagttttcaaaatttgttaatgttattgtattgtcaacactaaatgttaaatatatatacacacatatatatacatatatacctatatatatacctatatatataatataaaatgctaagaatataaatgttaaggacgtacatccacattttgacctgctccatttccgacctgggtcagtttgcctctcgtttgcaaccacattacacacagctcctgagaggtcaccacattgatgccaaatagtgcagacatgtgatcagcatggcacattataaccaggagctcccaggcccaagcaatccttctctcagcctcctgagtagctgcaactagaggggcttgccaccacacctggcacatgcacattttatttctaatttaattttttaaaaatatgcagcttattatctaaagaaagacctttctaacccttccatttaaagccataaaatcatacagaggcaaaaggacttcttggagctctgtggttttcctctggtggctaattgtggttaactctgcttatcagagttcttttatctggaaatgactatctttctagtgcatttcaagtatcatctactttaagttctgatcacatttcatttaccacttatatttggtgtgaatgcaaagatgaatcaattacccaatttcgccatctttttaaaatgcatagcatctatgcactaaaaatacaatacaataatgtgcaactcaaaaaattccccaagcaagaagactgatgatttcttaaatattatgtgaccttctatcgcctgattttagaaattctaagtgaggacaacttggattgtatcctaaaatattatgctgtggactcactctccatgtatacaataggtttgacatttgatagaaattaggggacagcagaagagaaagaattcttaactatgtctgtacatagttaactaccctaaggcactttaattcttgtccatcctttattctagtaaaactgtcactgaaccaaaagatatatctgtataaagagctctgtactgtcaaaagtaaagctacttggcaaagcttatgagactttatgtcagttttctacttgaattatagttatttcactaactagttatctttttcacatctattgtgactagagaatgagatgtagcagcaatctttgttgcatgccatttgtaaactaaatttatgtcatagatttgcatgctaagtacctctctggtaagaagagctctcaaaggcagcatgtttatgccactatttgtgattaaattggaattctaaagcagacccaagttaaacatgaagacaactttagatcttggtctgaagtcaaatatagactgtttacttaccattggagttatcttcttcttcttctttttttgtggctattagcaagataatctgtgatagtttttaatcatctctcttttactaacttcatagttttaaaattttctgtgtttttggtgttggcataaaaggtatgtgttcaaaattcatgattggctaaaataataagatctggagtttgaaagtagtttcaacaggtgatttagtatataaaattatatatacttacatatactatgtagttattaattaggtaccaggctattgtcatcacataaatcataaacatcttcaccagaaagttttcacttattcattcatttaacatatatatgttgagtgtgtatgaggcaccaaatgccacactaggctgtcaggtgccatggtttaccagatacactgttcttgaagtgcttaccttccagttgggggatataaaaaaggcacaaacaagagaatgagttagagaaacagaccatgtgaaatcacacaaacacatggacagctggattgaccatttggtcccatttttcactgtcatttaacttcttagtcttcctcatctgtgaaagagaagaagaagatgtgacttacctgttttaaatggtgatgaaactcatcacagttttcagctaggggccaaagccctgagttctgtgtgcgtgaatggtctcagcctggagttctctctagttgctctgacttgcataactctgtttcactcggccacaaattaagtgtcagggcacatcccagcacctacttgacctcccttaaataaccccagtgaggatctctaagataatttttaaattatgaaattaaatgattaatatttttaaatagaaaaggtagaaaaatgaataaaagatgaaatctctctgtacttcttttgcaaagtttccccagagggaattactatcaactgttggctttacctttttctatatattttctaaatagtttttaaaagagaaaatacaaagttctgcaactttttggctggttaattttcttaaattggtacataatgcgtatttattttctcattattaactactcaaatactctaaaatatatacagggaaatccttctttggtacattctttctctcacctgtaaccccaggaaaccaatgttatataaaatactatcatatcctctgcaaaatattgttatgatttgaattgtgtcctcctgaaagaagttgaagtacaaagtctttacaaatgatcaatttgagatgaggtcattagggttaatcctaatgacacagaggctgacatgcacagaaggaagacgaagtgaagacagggacaagatggccatctacaagccaagcaaggcctataactaccagacattagaagagaggcatagaaatattctccttcactgtagtcaaaggaaccagccttgttgacgccttaattttgcacttctagccttttgtatttgtccattttcacactgctgataaagtcatacctgagattggggtatgcctttatttttctataaagaaaatgatttttttataaagaaaaagaggttcggtggactcagggttccacatggctaggaaggcctcacaatcatggtagaaggtgaaagtcacatcttacatgccagcaaacaagagctaatgaaagctaaacaaaaggagaaacctcttataaatccatcagatcttctaagacttattaactaccatgagaacagtatgggggaaactgccctcatcattcaattatctcccaccaggtccctcccacaacacttgggaattatgggagctacaatttcaagatgagatttgggtggggacacagccaaaccatatcacctttggaatgtaggacaataaatttttcttgtgtaagccacccagtttgtggtacttctttatggaagcctgagggaactaacaaagatttcatacctatgtggattggccattttaattccaattattatcagagaacaataaaagtgaccagaaatatcttctttttatattctttaattaaaaaaattcaatagtaaatgggcaagagttgaatagacatttttcaaaagaagacctacaaatggcaaagatatgaaaaggtgcttaacaacattcttcatcagaaaaatgcaaatcaaaattaaaaacaggtatcatctcacccctgttaatacggcttctatccaaaagacacaaatattgcagtgtttacattcctgccaccaggttgcccacagttattttgaacactgaacttctttgaaagatgactgaagtctacatattttatgcccctaactactatggtatctctggaaatctgaatgtaaacattgtcatggtattgtcaaaacattagatggatttaagaaaataatatagagaactttttataccctgtatacagataaggcctgcaaaagtctttccatataaaaaaaggaaatactttattgacagaactgttttccctttgggccaccctctaggaagagaagaaacggagctctgttgaataactttttcagagattcctgtagcccagaggcatctgagaaatatttgtagacatggagaaaaggaaaatgaagcagttgtcagtactttactccatgtgctgattttaacttacacaggtaactttgaattggttaaaaaacccaggcaatttgactagagctcatctattggaatctcaccttcaagcttgagagtcttgaataaacttattctttgacttaaaatgacctgatttctttttgcaagggtttctgttaatgaacaaagtctctgtctcccccgtcactgcctgatctaaaatatcttattccttgagtcttgcccatatttaccagatcattggagacaggtgcaatagtgaattcgcatttttaacatttttcaatctaagttttaagattctattattgagatgaaaatatttctaataagttttctggcaatattaatgtgtgggcaataaactaggtatggcagtacacctgcaagaagacagttagatatggtctttgttgtccactgtctcaccccaaactaaagtcttctctacaacagtccttgtaggtgggtgtctatttttccattaaatgtttgtattgatagagagatgctaaagctgtctgattcattttactgaggcttgaaaagtatgtaatgtattcatgatattacaataattccattgagttatataagacacatcattaatgtaggaattgtaacattttcattgtttcattattgatcaagtgatgttagtagcaatttgtaggcactcagatctatctttggggattaatgaatgaagaaagaaacaaaagttatgcaagctttcacattggactgttcagaatgccctgatagtcacattttagctgtttatgataacatatccactttactatgcaaagattttcggcatttatatgagggatttattaggaaaaatgaactttgaagtgaaaggacaatcacaggtatagagtgaaaaaaggtatgatgtcaagaagagtacaactgagctaaaaatttgtgagtttatagaaatactgtaagatttgtcatctgttacatctcctcttaaaatgatgaaaccatataatggaatttattttgaaattgaccatatttctctcttaacaagtatgtataccatggtattgacatagaattagattgaactattactatagcatcaagttggctatcaattgttttatttaaatgcatacagaaataatgaagcataatgctagttgtgaaaaacataaacaaatgtccctggctcttgcttaactaacttctaatctattactagttataatgattagttagaataatattaatgtgtatatacacagaaggttttatggaaaatgtgattgatttcaaattaaaattgagttttacaacaggtagaaaatgcaggtgcaaatgtaattcagaaaataatcttttaaatgtttaaatagtcattgaactattagacatctacatattttttcatttaaagttaatgatctaaatatttataattatcaattaataagcagttttcagaatattgccaatatctagatgtattaaaagtcaaatccacatttattacaatatagatgaaagtgaatatgctagaaccatagaagatatcatagacatatataagataacatatactgagtcttctttctactccagggacttaggctctttcacagaagtaactaaatcattaattacctttgtatcttacaaatttcccaattatatactcatatacatgaatttatatataaacaaatatagacagattttttttacacattggacttttctatatattatagatgcttgtttcactgaagagtacaactttaagatctttttatattagcacacagaagtctactgcattctattcaacaaaagtgataccagtgcatcatttccatatgggtaatttttttttagtattttcacatcaactgtattatttattattttttaaaattaattcttatctcaatagcttttgggatacaaatgtttttttttacatgcatgaattatatggttgtgaattctgagattttagtgcacctgtcacctgagtagtgtacattgtacctatggaggttactttatatgatgtttattacagaaaacattgcaataaatattcttatacatgtatcttcttattcttatgtaagaatacatatataagaatatatacataagaatatatatacatatatgtatgtgtatatatatgtatatatatatatgttagccatttaagtcataattctgtgtgtggtctttattttctaccttcaaataagttacttatgctattttgtcatttccatagctgaaaaaaattccatgtgttatctggaagaccactttttttttcccacttgacatttttcatctctatttgaaaaactctctatcaaatgctcaaagcatgacaatttgtaagagtaaattgccttatagcacacaacacaaaatatccactaataccaatgctgttttatttttatatttttaaattaactaatttattgattttggtagagacaaggtctttctacattgcccaggctggttttgaactcctggggctcaagcaatctgcctgccttggaatcctaaagtgctggaattgctgacctgaaccatcacaaggctcacaaatgcttaatttttaaagtagtgatagtctgcccattcaaaagagaagctagtttacttatactttagcaaaaaattaattaaaatatgccttattggagatatatgtagtgcatcataagataaaagggatgaaatataaatcaaagtcaagattaagacattttctgtcttcagctctctgtattttctgtgaagaaaatactgttacagcactactaaaattattttctggcctcttgcaaaatgtacctaatgctagttatttaattattgtagttagccaccttttcatatggattctctattctcattttattttacattcctttctttccagtctttttacctcttgtgcaacttttcttattatggttccaattttcatttctttatttgttctctcttgggaaggaagaatagtcatatgtaaaataacatattgaactttctgtcttttaagtatttagtgtgtattataattacagtagcgatcaattctatgagtagatttttttgtttccttagctgttttgttcatatttatttttctgaaaatgaatattacagttcttcccctcaagaattttatgattgatggatataacattatcattaattggagaaaaaagtgcagataaaagccatggaagaaaatgtcagaagttttagaagtgtgtatgcaaggaaaaaagggttagagagatgaatgattgattcctactcttccatcttgagtacctcatggataaagacaggatatttgtgctccaatttttagcagccacctgcttttctgctccccaaaggggaaaactagtgacagtaacatatgagaggaatgtccagaagccttgtccaaatgctctgcgtcatgcagattggcctctttgtgtctccaagtgagtcttctaggcatggtattcctttacacttagcatttattttgctcagcagcacttaaattcataaaaacagttatagcaaacatttctagaatatatcagaaggtagatcttttcttttttaattttcaggaaaaattatacaatataagaagataggctttagtcagataaatcttaaattcagataataaggctatgaaatgtatcacgttactcaatttctgtgatgtctctgagctttttgtcataggcgtgctggagagatgaagtgaccctcctcagttaattcttttgagtattaaatgagataatatgtctgaatcactcaaaatatttagtaactgttagtttttttcataatatcctcaaggagaacttgggggaaatttcataatgctcccaatttatggtggtaaaatgaagacattcaatgtgaaaattaatctaaaatgatggaacagctgtactcagtgggattcatctgcctcgaattctcaataaagttgaattgaactatgcttttgagatcttcaaactccccctggcccattttctgtaattcactaaaactcacaggattcggcacatagccaaactaacggctatgattgattacagcaaaaggatacaaagcaagatcagcaaagggaaaagccacatccagagaaaactcagtgcaaccttccaagaagcttcttctactggagtcagacgggacacacttaattcctccagcaatgagttgtgacaacgtgtacgaaatgtctactaggaaatcttgcccaagattagaagtttaggatttttatcatggttcagcaaacgccttctgtcaaatatatgccacatttctagtctttcagtaggaaagccaggtattcagtataaattatttagtttttacaaacagtttaagcacaatggactcctattatcatttagagaaagttttatatccgtgtagggaactatttacccttcaagttactgaatgccagtcaagcgctaactttgcaagccgtccattctaagaataacagtctcaagcttactatgttaatttgtttttgcatagatttcatctaaaaacagcagaaaagagattaagggaagggctcagagagagtagagccaacatgaacagcaaatctgttatttaagtactagttctaccctatgtagtcattaaaacactgtcaataaacaagtgttgcaaacctctctgacatattgaaaaaaaaatttacaaatgaagccttataattatcagtggtccacaatctaatacgttttcaatttacttacattttattattaatcactaggtataaaaacaaatccagcaggggaaatgtgatagatccaccatgacatccgtaaacacaacactagatttaaaaacaaactaacaaacaagaaacagaacaaataataattaaaaagctcttttctccaaaatgatgtttttaatttacctttgtattcatttgggttttgattattagaatatcctcacccttttctaaccctttcctgatacttgattttttggatagtttactattatgtcatttgtgttttttgatgagtataaaacccattttgttaggagaagaaaagtccccattacctgaactgttgccataaagctcctaggaaagtagaaaatgcccaaagttattttcctttttcttctcttaaaaacccctttccaataaaaacaaagaattggcaagcagccattttgagagcaatcagtattggtaaagctgataaaaagagaaacatctttgaggctgtggtcccttctctaccatccatgtattttagtacatcaataattattttttgcagagtgagaaattcaggaaactgggcactttgctttcctaagctaaggagatagggcgcagaatgtattttcttatatctgaagacccttgtggatgatgaaggaattgaaatgccacagtaacaaaaactacaagtataattattgattaacattcttgagggataagatgtgccagactgtgttctaagcgctttacctatgtaacctcatgtcattctctaagtgaaccctatgtggtaggtttttattattatgattattgtcttccaccttttgaggagaagaaactacaaacaaacaataaaaaactaaataaattttaattaaaattaaaagttaaaaaaacaaaaaaaggctgggcctggtggctcatgcctataatcccagcactttgggaggccgaggtgtgtggatcacctgaggtcaggaatttgagaccagcctgcccaacatggtaaaaccccatctctactaaaaatacaaaaattagctggccgtggcggcgcaagcctgtaatatgagctacgcgggaggctgaggaaggagaatcttttgaactcgggaggcggaggctgcagcgagccaagatcgcgccactgcactccagcctgggctacagagtgagacttcgcctcaaaaaaaaaaaaaaaaaaaaaaaaattaaaacttaaggaactgagacaaggtgtcattatacaagtacccactgcaggagcagagcagacattcaagcactagcaccatggtaccagagctcatgtgttgctgttttaggctcacgtttgcctcagtgtctttctggggtgtttctgtgtgcacgtatgaaaacaaaatgtatatatatatatatatatatatacacacacacacatatacacacacatttatacacacatatacataaatgtgtgtgtatatatataaacacacacacatatacacatatatatctacttgtacacgtgtgtatattataaaacattttaaaaaatttaaaaatatttaagagcattaatcagttaaatcagttttaagccaaaagtattacagtgactcatttcaataacacctttaaaaaaaaaaaaaaagcaaaacacagtgaaacttacaaaaagaaagagtaaaatgctagttgccagaggctggggaggtggagatattggagacgtgttgttcaaacgacacaaaatatcagttagacaagaggaataagttcaagagatcttttatacatcacggggactacagttaatatattgtgtacttgaaaattgataaaagagtagattgtaagtgttcttactgcacacacacacacaaaacaaacaataataagtatgtgaggtactatatatgttaaaaagtttgagttagccgttccacaatgtatacaaatatcaaaacgtcatgctgtacaccataaatatatacaattttacttgtcaatgaaaaaaactgcttattttccactattcatctaaagtaaaaagaaaacaaaaactattatagttaagtgcttccacatattaaatatctgaaaagataacgttatttttcagaaaaaaagcaaacctcccctccgtgatcattaaaaagattatttatatatgcatctttaaatagatcgcttttaagtttcacctccaaggtcatatttacttaatgacttggaaataagtgataagatagtctttactggaaatgatttaattctctgccatctagctaagggacaaatatttttgggaaagagccagatagcagatattttaagtttcaggggtcaatctctgtcgcaactcaataccgccattgtagacatacataatatgtaaatgaataactgtggctgtgtttcaataaagctttattatgaatgctaaaatttgaatttcacttaattctttcatgtgacaaaactttattcttcttttgatttttctttttaccattaagaaacataaaaagcattctgagcttaaggacactagaaatctagccattgaacaggattttgcccaagagccatactgtgttgatcctggatctggataacaagaaactgctaggattatctgtgattgctttgccttgctaaagtctttcttttgcctatagttacatacgttattttgtctatagctatatatgctcattattttatcatctaatgtatcttttttaaaaaactgttttcaacttttaagttcagggggacatgtacaggttattcagttttgttacataggtaaacatatgctatggtggtttcctgcacagatcattccatcaccaagtattaagcccagcatccatcagctattcttcctgatgctctccatccccctgtacctccaacaggcactagtgtgtgttgttccctgccatgtgtccatatgttgtcatcattcagctcccacgtatgcgtgagaacatgtggtatttggttttctgttgctgcatgagtttgctaaggataatggcccccagctccatccgtgtccctgcaaaggacatagtctcgttccttgttataactttatagtattccatggcatatatacaccacattttctttatctattctatctttgatgggcatttaggttgatttcatgtctttgttactattgtgaatagtgctgcaatgaacatacacatgtatgtgtctttataatagaatgatttatattcctttgcatatataccccatattgggactgctgggtcaaatggtatttctgcctctaggtatttgaagaaacaccacgttgtcttccacaacggttgaactaatttacattcccatcaacagtgtaaaagcattcctttttttatccaaaaccttgccagaatctgttgttttttgactttttaatagtaaccattctgactgctgtgagatggtgtctcattgtggttttgatttacgtttttttaatgatcagtgatgctaagctttttttcatatgtttgttggcatatgtatgtcttctctggagaagtatctgtttatgttcattgcccactttttaatggggttgtttgtttttttttcttttaattttttttaagttccttgtagcctctgtatattagacctttgtcagatggatagattgcaaaaatcttctcccattttgtagtttgtctgttcactctgatgatagtttcttttgctgtgcagaagctctttagcttaattagattccacttgtcaatttttgctttcattgcaattgtttttggcgttttcatcatgaaatccttgcctgttgactatgtcctgaatggtattgcctagattttcttctatgactgttatagtttggggtcttatattttagtatttaatctctcttgggttaatttttctatctggtataaggaaggggtcaattttcaattttctgcatatggctagcagggaatctttcctccattgcttgtttttgtcaggtttgttgaatatcagatggttgtaggtgtgcagtcacatttctgagttctctattatgttccattggtctatgtgtctgtgtctgttctcataccagtaccatgctgttttggttatggtagccttgtagtatagtttgaagccaggtattgtgatgcctccatcattgttctttttgcttgtgattgtcttggctatttgggctctttcttggcaccatatgaattttaaaatatttttttttctaattctgtgaagaatttccaatggtagtttaatgggaatagcattgaatctataaattactttgggcagtatggacattttcatattgattcttcctattcatgagcatgaagtgtttttccacttgtttgtgttctaatttttttgagcagtggtttatagttctccttgaagaggtcctttacttcccttgttagttgtattcctaggtattttactatttttgtggcagttgtgaacgggagttcattcataattctgctctctagtttcctgttgttggtgcatagcaatgctagaaacgttttcacattgattttgtatcctgagactttgctgaagttgtttatcagcttatggagcttttgggctgagatgatggggttttctagatacagtgtcatgtcatctgcaaacaaaaataatttgatttcttctcttcctatgtgaatatgctttatttctttaccttgcctgactgttctggacagaacttccaatgctatgttgaataggagtggtgagagagggcatccttgttctggcttacaagggaaatgcttccagcttttgcccattctatatgatataggatgtgggtttgttatagatggctcttattattgtgaagtatgttccttcaacatctagtttattgagagtttttaacatgaatgaagattgaattttatcaaaggccttttgtgcatctattgagataatcacatagtttttatatttagttatgtttatgtgatgaatgacatttattaattgcatatattgaaccaaccttgcatcctagggatgaagccaacttgattgtgttggataagatttgatgtgctgctagattcagtttgccagtattttattgagaatattcgcatcgatgttcatcaaggatatttgcctgaagtttttttttttttgttttatttttttaatctctgccaggatgtaacccatgtcttagtgcattaagaaacaccagtgcatggaggaagtctactaataatgcacatgtccaaataatcacagaaagtatatctatttatttatttaaaaatctgtaactttgttcaaaatatttttctggaactggagtatcttacagcagtaaaaatatttcctaaggtaaaaccaattttagagtatataccacttgtaatataatctacctttcacttgatagtctttatcgaatctttcacagaagtagacaggatatgaatgaatgaatagataagcaaatgcagacattctcttcattttatggaggcagtaactgctattaagtggtgttatataatgtactcaggatctcagaacaattaatcagcatggcctggctgcacctcaattcttctaactacaagatacttttacacctaaagcagctagcatttaattgactgttttaatagaaatacagggtgattaccaatctacttgatcctttttcaattctaattatttttctaccaaataattgcacgttttgagagtttctaaatactcaactgtgtgtataaatcaatgattaatttttccttgattttaataatgaaaatagagcttcatatgatcaagaacctgaaataatacagttcaattaacataattccattaaaaacaaaggaatggaacagttaatctattcgtcgtcactgtgagacatagcagatgttctgttaggctgtttgaaatattagaagtatttcataaggctcctatatctgtttttctagactacatattgagaactgctgtaattacagtatcatcctcagtgttagatgtaaaatgttaagaaaaatctgtccatctggcaagaggaggtaaaagtttgttagagtgggcagaagttaggtctgatagcacctaggtctagagaaacacaaactccaggtaatacatatattctagtaaggtttgctccatttaaaaaatacaaacttatagaaacagaaaggcatttattatgctcatttagtagcaataaatgccttctaatatctttgaaaatttatcatgcattctcttcttaaatgtcttcaatgtgtacagagcccatagttaataacaattctaattattaaagaatatttccattgatttcatttaagtctctggtcctgcaacctccatttgttgatttttggcttggccctttggaataactgctcagaacaatcttatcttgtacataaaattgctttagttattcttcataagatatgatttctatgtttatgactgcaatatttatagccaacctgtgaagagcgtactatttgccaggcatatttctatatgctttatgtgaatcaataatttaatttttataatagatcaatgagttaagttgtattaccatttccattttcataatgagaagactgcgttatcataaggatcaatagacaaaagtcacaccaaagtcacacagctggttagtaagtaagaaaaagttttgatggttggaacaaagtctcacagctagttaaacagggagccagaattcaaactcagacagcctggctctagactaacacgtttattttgtgctttattaaatacccagttattggattatccttctggctccaggttcttttttaaaaatagctttcgtatgatctgagaaatattcttacatcaaatacatttgtttgctctctctttgagatttcacacacagaaaaaacataaatgctcaatcattaaaggtggtgaagatagctctttctcatcttgtggtcctactgaaaagtcattaagaacaagaaatcctgtccaatgccctgttataaaaagtaatgacagtaaagaaattattctgagcaaaaccaactaatttcaacagtcacagcaaaaagtcaaactcagatgattcaatttactcattgatgtagaaacaggagaaaaaaacatatttgaatcagatgatcaatgatcaaggaatgatgtgtttcctgttaaataattcttaattaaagaggaatgtttttatagtttttcaatagaacatcttgctatgtattattatcttgagtcatgctcactgtttttacatactataaagtttaagacatgttttactttcttgtcttaggaaattcagtaaaataaataaattgaattatatattttttgatcattcagaggtctagcattttttattttcttctaaatataaattctcattatgaaactctgtaaatgtagaaactatggaacaaacaatatatagaatgctctttggagatcaaaagaaaattaatctttttcaagtgattttgaaaatgtccattctagtggaaggaatgctagccaggtagaaaatgagggttctaaaaaaactctgccactaattcacgtctttcctcatttgctaaaataaaggaatagggttaagtggccacaaattccatttagttctttagttgcattattagaaaagtgatgtttgttccttatttttaaagtgtgaagagcaaaaccaaaactgcaggtatttgaaattagctgtactctctttaatatagtttattgtgttgatgcattggtctcataagaatcaaagcctgcattctccgtgccggttgactttggagcactaatgagttgtaagtgcatttattaaaccagtatcactccacggcctaggcctttctctacagagaaaagagctaatgaaaggaactaatgaaagagactcgagctaatgaaaacaaaaatcaactcaacccccaaacaatggtgtctggagtagctgaattatccttcctcctaaactaagaagtgtctcgcatttccaaaccgtcagtactctattgtaattgcttttgtttggactacaaagtgtttgggggctccagaacgtagggtgattagtgatcccaatatccatgttctctctgctaaattgaatttagcatatttgttacaggtgatccctggggcctttgtacacacagaaagaaatcaaattaataattcaaaacgtaaaagctatctgttggtctctcttaacttaatttgtttggggtcaggtccacaccttctaattcagaacgcgatttcagtgactcttgagctgtgatgctcagtgaatggagagtagaaaagctcgaggagacaaatctccttaaacacaataaaaccgacagtgggagaatttccaaaatggggttgtgattgaaaatacacattgacaaaggcttctctttacttctgcttttcataatataaactcaaatatgtgtgtacatatatatatttaaagtttcagactgctgtaaaaattagtctgtctatggatccagagagttcatctatatcatagtggaggaatgtggaagatgagtgagaaagcaagcatgaagtcatgagttcagaaaagattgcaaaatgcttctctatacagatggtccctcatcacgctgtgttgtggagtgtcgtacagacaactgtgaaaacatggagagcagagtcttgtgtcttaagccatgcattgcctggtgcaaatgagaactccgtcatgatatgttgatttgaataaatgtatgtacacaaatgtaatcattttagaagaagcccagtcttacaggcataagcagcaaacctaaccacagcttccacctttcaaaagtccttcttacggtgctgaaggaatttattttgcattggtttgctggaaagaaaataatggtcttgactattacagttctttactttcttccagaaaagcgaccatggcctgggtatggttttcagactgcatttttacagagtatttaagggcaaaggggcatttatttttgccaaacagactgaatttcacaaatgatacatgaggattagtgaatggtgttcactgtagcattaaactgctttttttatggccagataccattccaatctaaatctgcagaagctattcatgagagaattacactgtgaggttacatttgggttggttctactcaataaagtgacataaaaagaagagccaatgtagtcaacagaatttctaagaggcaatcttattagttttcttatttataagcgtggctaaagcattaatggtgctttcacagattttacgccattgtgaatgcatgttgtcaggggactctctggatccacaggctaattttcacagcagtctgaaactttcaagcatggattaaaattatgcttaccctttacttactattagttcataaccctcaacatttatgtgaataatctaagtttctttataaaacatagaacagagtttgcaggcatgatacgcttcagaagaggtgggagcacaattttaggcaggtggtgaagaaattttgaaacaaattctgaatcaaaatttgtttagattacaaaaatagaagatgatattgttaataataacggcacaattatgtagtttctgcttaactgtttcagcaatggattaaaacaatattagagaaggttaaaacaatagaaattataatagcatatttctttgtagtaaattagaaatttaatatatattgttttatacttaattcctggggaaaaaaaagaaacttgtggcagttcagagtggattgcaataggatttattgaatcccctatgtgtgccaggcactcattcagggccgctctgcagggctttgtgatacacaaatcaaaagtgtgcaattcacagaaacttcaatgcaaacttttctctctctctctttgttgtgcaactcaggagccatggaagtttcttatttgatatagaaaatcaaaaggtatagaagatgaagtttctgcttttgagaaatttctactatgaggggaataggtgttacttttcaggatagtctcatggtcagagggttaattaacttgcttttggccaacatagctagtgggatgagtatataaaatctgaaattcagatggtctaatttaaaatttagtgttattaacattatattgcattaatttcttttaacctaaaactttgcaccaataataaacttttttaacttataattcttgtaaatttaactcctctctccaccactgcaaaaagtgcttggcaatgtgagtaccagctgcttttagaccctgctaaaaaactgtgcccaatattttgagtttccatttcagttctgcgtcttgtgacttctagttaaaagaattgtgtgcctttgtaagcgtagagtttgtacgaacaaatgatatgaaatcagttagacttgacatctaattttacatccgttagttatttatcagctgtaaacatctctagtagaattttaaaatctcagttccttgtacataaagggtcattgaagagaccagtgtttcggagatgtttgggagtataaatcaggcagtatattatataggcacttagtacatctgagagaattgataaaaacgtgtgtatgtcatgtatgctaatcacttcttagtaaacatatatttcaaccccctttatttaatgcttttatttggacatatgttgtaggagtcgttcctctcctcacaacaagatatgatcatgctatcatatattttaaagagttaagttaggaaatggagtcaattctcaacaggagcttatctgcagtagattgctttggtcaaatccaagatatacatacagctagtaaataacatacttggtaaatgatatgccaagatttggctgaatccaaagcctaaacttgtatatttaccagtatatactttctttttgcaaacaatccagttattgatcacatttccctataatgccgatgagttattcagcaaaaatatgacagtttagggaatgtctacattattcttaatttataatatagaaaatactgttaattacctataactagcaccatgtatctctcctagcaatactcttagaataaaccatagggctaagtccgcataatactttggagattttatgttttttgtgatgggtaagtgggtaaaaaaatcttcattccccatacaaatagatgatttttgacttagattaataatcagtgtctacaaaagaggtatgctcttatgttcttgctattagcaggcatgttgatgtggctatatatgttgcagtggtgataataaaaatgtggattcataatttttcacatgtatattagaaaacaacatgtgacaatgtctgtgttgacatattttccaaatttaatataaaacaaaactatttcagttttaaaaataagcacctaagtaatcacaataaggggagataataggaaaatttaaaataattcacatacttataaaatacaataggtaacataaagcaaaatgataaatacagaaaagctaaaaacaataaaacacagtttagaagaaacaaaaacacagagattatttgtatcctggaaacagaaacctctaaaacttgataaatatttttaagaacctaactttaattttgaaggatgcagtatgaaaacaatttatgaaatttcttaaacaggacaatagcaagtgcttggtgtataaactctatggaacattaactataaacatgttattccgttatattaaagaatggagaatataaaactgagaagaggctaagtagactgccctgttgacaagcaatatctaaagctgtattgttaacatttgttgacattgtagaaatattagaaagacaagaatctctataaattataattctaaaccatgggtccccaactgccgggccacagactgatgctggtgtatggcctgttaggaaccgggccgcacggcaggaggtgagcggtggcaagtgagcattactgtctgagctcacctccctttagatagcgttggcgttaggttctcataggagcgtgaaccttactgtgaacgtgcatgagagggatttaggttgcgcgctccttatgagaatcaagctaatgcctgatgatcttgggtggaacactttcatcctgaaaccatctaccccaacctcaccctcctgtccgtggaaaaattgtcttccatgaaatcagtccctggtgccaaaaatgttggggacgactgttctaaacgacaaaactactatttcaaagatataagcatagctcatgtatgtatgtgtgggttatacactattataacacagaataaaataataaatgccatattgaatcaaaactatatttcatattatctagtgaaatgcgtaccatgtttaaggtgactagagataattttggcatctatttaccattctccctcgcattcatacaaaaatattatggttgaattgtaagtgcattgctcaaaaatccttctcatgaaacgtaagcttatttaaaccagtatttctcaatttgtgcttcattgacacttaatcctataaaatggcaaactaaaaaaataattgtacatcaaaataagtttggtaaataatgaactttaaaatttctccttagatgctgggataaatatattaatgcctgctaaacattccatttgtttccttatattttctagcctgtttgggcactcaaatttgtgaggagttatggccaaaaaatgtgatcaaaagtgaagtggattttggactaagacactggaaaactcatgtgcaattccccaatctcgtttttttttttgtttgtttttgtcccctttcttaccggagtaagggaggaagccccatgttgcagatggtacaaccacaaaataacagtacctgtattagccaggggttgttatggaacagaacatcattgctatcccatgatggggacatagggttaacaatatacacatctttattgttaagcccctaggagttcagggtttgctatcgagacgtaatctagcttacattggtcatatgctatacattatacatatgtatatcttactagcaagcccggaatgcctagtatacatatgtgcaattcgtatcatataataaaaaactcttagtcttcatgcagtaaagggaattctcaaactgtttctgtcacatatcctacagttatttatccatagaagctttttttttttttaaagagtctattcatatccccttgatccagggttccatggaacacagcttgtgaaacactgattttagatggtttttcatcttatttatttcattatcctttttagcaacaagggatcaaacactgtgaaggtttactctctactggataagagagtaagtctatctttgcccaaatattaccttcagaagtttgggctacatatttataatgagctgaaaacttgtgttcatatttatatttcttttattagtttgcattttaattatatctaatttttcacattttcagacatggtaggttattttcatgaaaatagcaataatactactaagagtttctttttaaatagttttccaagtctttaatttagttgttctttcctggattttctagaattcttttactcataattgaacaccaaaaactatttttacaatggttgtacaatataatttctaaaagattaagataggttttttattgagctttggttgatatctcaaaacatttagagtggacaccagggaatactggaaaaatagggattcattttgctatctagttctttctctcgggcacacacttgttgaacatggtctgtcatcctgagcatagattttaatgcctctaaaatcatttctattcttcaggctattttcataccttaagaagttttcttttctaatttattcatgttagctttacattgcattttcaaaaacagaaaacagtgtaggatttcattatatcactttttggattatttattactaaaaaaaagtaccgccacaggtggatggagtatcttaacattaatacatctgttctcttttttaaaactggagagcacatttctccccagagaaggggactatgtatcccttccttatatttccagtgtttaagatattcattttttaaaaaacactctcttcaatttcaaagacatacaccaaagttatgttttctctcatatagtatgcttgtcaaagtgtttagcagcttatctattgatgtagatgccactaacttctttgacatgaaaacatttcttattctttatttctcatactgcttttagagccagtagctggccttcttttttcccttaagtatgaatattcatcaaggaacttgttggacatttttttgtttgtcttctcttctttcctcctggtattatatatgtttatttagccttaatcattacttcaaagtagatgatttgaaaattgtatgttctgtccaaatctcatctaaaaactcaccccatatttccagaagcccccaaacaaaatgccatctgcatctacttcttcatatttgaagtttaatttctacaactttccacaaaacagaattttttccttattttcatatatatatgggagcagaatgactcttgtcgtagtcacaaaggttccaacttgattaagcactttagagaggtacttaaaaaaacacctttccttacattgtatgcaaaattagcatatttttctggatttatgaaacaatcccactttcaaataatctctctcggataggcgtggtggctcacacctgtaatctcagcactttgggaggcctacgccagtggatcacctgaggtcaggagttcgagaccagcctggccaacattgtgaaaccctgtctctactaaaaatacaaaaattaatcgagtgtggtggtggaaacctgtagtctcagcaactctggaagctgtggcaggagaatcgcttgaacccgggaggcagaggttgcagtgagctgaggttgtgccactgcactgccctgtgggcaacagagagcgactccatctcaaaacaaaacaaaacaaaacaaaaaatctgtcctatattaacataagtatattaaaatttgacagaccagttgctgtactttttggattggtttttgaaaacatagactttagtagtaagaaacttagtggagtaaaagtaaatgaagatgagtacttttaaaatttaaagtgtggtcagttaaaacttatttaacctaacactcaattaagtgtatgaaaagtgctgagatttatccattaatttttctcataagaaactagatcacgtatttcttttaccaaaattctatttgacattcaacttaaaatccaaagagtgtaatgaaagcccttaagataatgactgtgaaatagcaatatagcctgacgtttaatgaagtggatgggtatgtctcttacctaaagagaagatgtgaaaatttaaagtcacactggttatgctgtctgtgtgtatatcttcatttttaaaaaaatcagactcttgagaatttcattacctagccctccaccaaaacaatgcatctgcgtaaatatttcacaattttccattgttttaaagttggctgatgagaggttacttagtactgtttggtatttttcccaaatcttttataccacaacccggaagtacccatgcctcacttgtggtaacataaatacatagattcatatttctgattaagttataattattattttacataaatatcttgtctagttatctgaaaaacctaatattagaatttaagatagggagatgttagttcagtgaagcagtatcttcattaccaaatacgtaatgtgattgttgattgtacatttggaatgtcacacagttcattcttgttcccactggacataaatcaagatgttacattgacaacttgtcctacaagtctaaaataagagtcagttttgtcagaattgtaggcgtatttcacttactcataagttgaagattttggagagatgaacgaggtgatcagaggatacattcaataatgtttttgacctttatttaaaccctgtcagtatgaaaacttcagaataaaactataaacatatgtaatgagtgtgactgtcaggtcaaaaattcaaccgtgaaaaaaattttctctggaagacaacttaatatctttcttaagccctattcttctgggttggcaaaataaaattttttggggggtttgtgactaagtttcagaggactttcatattgcaagacaattcatatgcaagttgtcctcaagtcatctctctatgcggtatctcctgaaagaactgtctccctatttggtcttcgattacagatacacatcaactctcttccctgcccacctgttcctttcatttaaagtggccctctctgctgctgattacatgcatggccatggagatcattctctggtttccatccatggatgtcagtgtctacaagatgagttcattggcctaaacctggcatgcatttcctcttgctgatgctctggagtctactgaggaaggtcctctttgctcttgaatctcgcattcctctctgggtttttgccagttcccaaaatctctacctgagaagaaggcatggagctcctctcagcatcgcctctcatctcttctgctgtgtctctcttttcttcgctcctgggtctccagctggagacaaggacacagagatgatcagatatttactagtttctgcattattgtctctttcccaagaagtctcatggaagaaacaaacaaacaaaagagggtaaaattggaaaagataaaacatgtaaagatattaattttttgtatcttccttgtaagcttgacatcattctctttcaaaacacaaaggtactgtcatgtatttgcacatccctcatgtcttctgtcattatttactcttctgaaattatttcttctcttggaggagtactttctctgtgtaattttcaaatgttgtttgtgtatatttctgtgtgtggcaaaacttttgaagtcttctattccaaagagtatatatatttcaacctcactttcaagtgatgaaatatctatatataaaactgtaagccacaagttatttttcttttacactttagaagggttcatccttatcttcttgcatcgagggtttcttatgcccatctaatttttgttccttgtttcgggaagtcttttgaatgtttgcactttctttacttaaaatatactatgatacatctaagtgtaggtttttaattctaaatgttatgtgtgttagtggtgagataggtacaaatgcaatagaggaaactaggaaaaattctcaatccatttggggtgtgtgtgtgtgtgcgtgcgcatgtgtgtgtgtatgtgtgagtgtgtgtgaaacaccttcctccaaatcttaatcttacaggtctttttacctcatcaaaaaaactcagtaggtcaaaaactctgtgttgaattggtacctcttgaaagagcctgatgccccactaacatctgtggtccatcttgaatggggacagcttatcacaatagaaggagctattgatcgtgacttatccttgagtcccctcctgctcacttgacatttttgtggtatcgtactagccctgcacagcacacctagccctgttccgtggatttagccttcaggattccaacattagtacttgaggcttgaggactgaggaggtgagtgtaagcactaagcattcttcttgtcttgggtgcagatttcacagtatttccaaagattcgttcatactccatggcttgtgcttttgaagtttcgttttcattaaaaataaaaacatgggccgggcgcggtggctgacgcctgcaatcccagcactttgggaggccgaggcgggcagatcaccaggtcaggaaatcgagacaatcctggctagcacagtgaaaccccgtttctactaaaaaaaaaatacaaaaaaaaattagctgggcgtggtggcgggcgactgtagtcccagctactagggaggctgaggcagggaaatggcgtgaactcgggaggcggaggttgcagtgagtcgagatcacgccactgcactccagccttggtgacagagcgagactccgtctctaaataaataaataaataataaataaataaataaataaataaatagataaataaaagcatggtcaggttttgagaatgctgacatgactaaaaataattatactttacgaccatcttttccctgtaaagttaaatggtaattgcataatcgtatttagaataaaagagagtttcagagtgtgcctctgctctttccacccctttcattcataccactatgctcaggcctccctgtttagaaatttggggactactcctgagatacagagtgagaagaaggaaaaattaggacaaagccgtaataactcttactgctcccagtatttgcattaattttttgtgttaaataatttaatccatctaacaaccagtttataacattagtgaccacagtgtcgtcattttgtaacaaaggctatttggaaaattaccaaaacccaaaactgagtaagtagcagagctatattttatattcaggttttgtctgcctgtcaaccactttttttataaagaagacatctagattaagaggcaaaagacagagctgctatcctagcgctgtcaatagtgtgatcttccataagccatataatttctttgtgccccaattttatcttttgttaattaatagcataaagccctattctagctggtttgagcattaagcagaattacataagtatagcctgtgaatatggctagtattatcacagtgttctgtatacattagctgaatttcagtttgtgaaaaattaatccatatcccattttctcagtagaataaactgtctaattagttggtatttatcatgttatttatttatttattaaatttttttgacagaatcttgctctgttgcccaggttgtagtgcagtggcacaacctcggctccctgcaacctccgcctcctgggttcaagcaattcttctgtctcagcctcctggaactacaggcactcgccaccatgcctgacaaattttcatatttttagtataaacggggtttcaccacgttggccaggctggtctcaaacgcctgacctcaagtgatccacccacctcagcctcccaaagtgctggaactacaggcatgaaccaccgcacccagcctatcacattttttaacacagtaaaaatgaactgacttacatgaatcagaaatttgtatagtgtaaagatttactaataatttaaaggatacaggtaatacatagatacaggtggaacatggcctgaaggacccaggattcttcctaggtggatagatacatcctggactggatacatctgctggaccaaagtaatggatgagccattgcaatgaaggtcgctgttcacctcatgtagccagaagtatcatgaactgttgccactttactgatcattcagggattacatgacattttccaagagcacatgcttcataaatccatagatcctctctctcttttttttttttttgagacagcattttactctgttgcctaggctagggtgcagtggcatgatctcggctcactgcaacttctgccccccaggttcaagcgattctcctccctcagcctcccgtgtagctgggattacaggtgcctgccaccatgcctggctaatttttgtgtttttagtggagacagctttcaccatgttggccaggctggtctcgaactcctggcctcaagtaatccacccgcctcggcctcccaaaatgctgggattacaggcatgagccacccaccgagacacataagccaccacgcccagcccatggattctaagtgtgttcacctaagtggttccacaccagggacattctgctcaaatcatttcataaacaaaaaaacttccttctaataagtattagtacagtttccaggaagggtcagattttataccagagtcaccaaaatttttatccagggagagaaataaaaccaggctatgttcaacccaatcctctccatgtggccaaagtataatgagattgttgtaataaatactgcagtaaatattatgattttattttttatgcctgacgttgttgtaactgtaaatggggcaaaatcaaatcaagtatcatagattgagtagctgttgtgtacatggtagctttgaaaaaagagaaatttacttgtgatcaaaattcctttcaatgtctagaaatgcttgcctcttcttatgacatgataccattcttatctttgaaacagaataccttatataatagaaacctagagcaagcaatttcacatgaggtaacaaaagagttcccagagtttttccagatcagtggaagacttaagtacaggatggagggaaattttaaaattgttcaaaacaagaaagcatttccccattagagaatcaaataactgaagagagggtgtgtgtgtatctctttacagtttcttttctttttgctgtttatgtgcttgcattatcaagacattttcccaatatcctacttttattttagtagcattttcaaaatctgtatcaaataaagatagcaagtagtagagcaagatgaatgagggagggagaaagaatggattggtagtggaaacaacatttcccacaagcctatttattgtagcattgacagtaggaattcttataaatgctaggttaacttgaaattctaccaaatgtctgttactgtttgttttaaatagaattctagtatctcgggtaggaaatttattacaggcaaccctaagaagatatattccctaaactctccttcaggtgatgggattaatcttggtaaagtgactaagttgcttcttgatggttggtacattttgaaaaagaagaatcacattaactccagagcagaaaagaaccgtagatcattcttactaagttcattggtcttacatgtaaattgagaaagattgctgaaggcaagattgccccaaggaatttaacttgaaatcaagaggctacataaatgtaaagtgctactgcttaaataaaaaatattatgttttaataataatcatgataatatgacacagtatgaagcaaatatagtgaaaactagaaaacagtcttggaaacagttgctacattgttattaaggactaaaccaatttagaggatcgtggctgtgaacattttaatatcccactcagctccaaattatctagagaaatcttctacacattctacaatatggaatgcccaaggctgagggtgttgcagaaaataagataaaaaaaagaaattatatttgcaaccagactagcactttcttcagaacactgtgatgtcagtttcacatcagtgaacatttattcttaaaaacaaatccctattattctttgcctcagtggtcactgagctaagaaaaagaccagttggttctaggggaaaaaacaaaacaaaacatgtgagacattgaaacagtaagtgagaagttggtgaaggtagctcccaggtggattctgtcacatgctgatttattttcaactctgaatatttagcattgcacagaacacttgagcaactcttgaagatccttatttagatggctggagagaaatctacttgaaatatacagtatactcacctatgagtcctgccctacctcaacaaaatattccatcgcttttattgttctatattctataaaggcccaaaagactgactatggaagtggactgcttacaacatttatcttagtccagctctgtatacagcatattaattttagactttttaggtattcaaaaagtagcaatttatactaactatggcttcaatacctagcaatatttttattttattgttaattttgctttaaagatatctattataaagagaaaaattcaaaacagtatcttaggaaggcactggtcagcttgcctaagaatacaggtcatattatgctattcaagttacatttcagattaatatacttctgctagatttatgctgcatctaacatttgggggaacaaatggatgtattaatatgattttaaatgctgctctgtgcttaacttttattgctcaatggagagtgtacgccacagcacagttatgccaagaatatggtttcagtaaaagaaaggagctaatttattgtctcaataactagctcttttcttatttgatgttaaagaaagaaatgtgcatgtctgaagttgaggttcagcaatgcattagtatttgccaaattatgagtgacccttctaaaggctataatattttagtttcacctattatgttatatttattttagaaccaatttacaattttcaaattgtttcctacatttttattagttttatgatgtaacatagaatatatactgacaaagacaatattattttctttgacattacataaaccaaaaaatatgcattgttataaaatatgagaatcttgcaactgcaaatcagaattgagaagctttcatgcttcattaacacctgtgctataaattcaggtttaacaatttgatgaaggaatatttcagattgcaataatcacagaagtatttattttaatagtttcaaaggccaagcagaaatctgttacagttaataaacatcctaaaatggttcgtgtatgataaaagaatatcaatggtgtttactcattactctggggattgaaattaaatcatataaaaaaactgtgtttaagttccatatgcatttgttccttaattgtcagtgttttgaatttacgtcatacgcacatttgaaaaaatggggataacaatttgtgaccttttattaataatattggcttccaaaattggatgataataagagagtctctaagagcttatcttttttcaacaggaagcttcctcttattcttaatttaattcacaagattcccatgaagtatgtaacttgaaatagcatttactgagtaaagaaaaatggttaatgctaccaacaccaatacatatttaatgattgagaaatggctgttaactatgacaaaactatcaaatcacaaattaagaggtgcctcagaaatcgattgtcatccttttatccacatttagggaaaccaaaacacagaaaagtaatgacaattttctaagacaaaacagcttgtcattccataaagtggctactacaattgggtctcctgccttccagctcaaaatatttcccctatactctgtaatttcagaagggggataaagaatataggattttttttttaactttttaaagttatttttatttccgtctcttttattaaattctttgtttatagaagattgcacttaccgttgctctgttctcatattttataagcactttgtttttgttttttttttattatactttaagttttagggtacatgtgaatataggatttttacagtaatcgtttgttaaaacattttatttaaaactaattaagatgcatggaaatttgcaaagttagtgcagagattccatgcattttaaactactttcctctaatggttgtatcttaccaaactagcataataaatggatattggtatgatgtttgtgtaatgtcgatcacacataatcactgcaattggaatatagaactattctgttaacacaaaacttttcttcacactacacctttatagttaaaaacgtcacccatcagccctatacataacaacttatatccgtctgctggatgtagaaaccttgactccctgtaagtccttttcagctttgattatcccagctccatcctctttcatctctttttctgttactctgatgacatgaatgctaaatctgttattacagtgccacagctccctaaggctctgttcattcttattttcagtctttcttttctgtgttgccgaggcaaggccattgataccattctttcttctaatttactgattctttcctctgccctatacattctactgttgagtagatcctattgagttttttattttgcttattatattttcagttctaagattttcatttggttcttctttatatcttctatttctttgttgagactttctttcattggtttcaggaatgtttattatttcttgttaaaacatttttatgatggctgctttaaaatccttgtcagataatcccatcttctgtgtcatcatagtgttggtatttttctattatattatgtaatttgtggcccttttttcctcttgtgcatgttggtatttctgggttattggcttctctctataagaaaatatatgaagcaaaaagaaaatccaaggaattcactgccatgtatcctcaggtccctatgtccccaatgaacctatcttttctctgcttttcagaatcttcttaatggatgtttcatctacagtatcaatgacttggggctgcagttcacagaaagaatagagaaattatgtgtactccatcttggagttgaactggtagccctagctagccctttgatatcacaaacacatatgtgataatgggtattattgaaagaaaggaaatatacttaaaacgacatttaagatggcaccttagacagaattttgcatatttcatgaatgcccctaatattaaactggttgatatgccttttagtatgatgacaagctttagttgacagtcgtacaaaacctgtgattttacagatttcaatcagtgatgattgagagacggcactatcctgtcagcacagaaccatgttccttgtattcaggtgaatgaagattatttttattagtgatgtacaatccagttgatttctgtggagcactgacatccaatctgcctagttatcagtccactatttctatacagaacacaattttaatgtcattcccgtgttcctcagtatatccttacattattaaatacggacattatgcaagttatttaccaacactgtttctacgttgtaccttttctaaaaagcttttcttttccaaggagataaaacaacaacaacaacaaaggtaatagtcataatacattttaataattaataacatgaactttgagctatcttaaagccaatattgcattttaaagaaaatatgacatttagctgtattaatactttgtgttttatatcttatagcagtttcagttatctattgctgcatagcataccaccccaaatctgacagattttaaatgacagtaatttatttcttataaatttgtaagtatggaattctgtcagggccaagctggttagttctattccacaagggtgggcaggatttactcattttctgcattaagctggtagctgggatgaaatttccaagaaaacttgattaacttatatgggacctaacttcctcgtgtggcttctctactgcgttagttttgttttccttaagattcgaaacagacttctaagagcatacaaaaatggaaacctacaaatcctcttaaacgaagccacatgttgtctattctgtcatattttactggtgaaaacaaatcaccaagccagcctaggtttaagagaaaagggatagactccacctcttgatgaaaggaaagacccaattttattgtaaaaggcatgtggaataaaagatattgttttatgatcttatcttcaatttttttcctcttggaaaattaacatttttgaacctcagggatttttacaaataatttgtaaattaagtaagcaattttcggtcttttaaaataacacatcacgtagattgaatgggatttcttatttcataatttgtaaatagagatgctgttattttcatagtaaaaatatttatttatttatttatttatttatttgagacggagtcttgccctgtcgtccaggctggagtgcagtggcgtggtcttggctcactgcaagctctgacccccgggttcacgccattctcctgcctcagcctcccgagtagctgggactacaggcaccgaccacatcacccagctaattttttgtatttttagtacagacggggtttcaccgtgttagccatgacggtctggatcccctgacctcgtgatctgcccaccttggcctcccaaagtgctgggattacaggcgtgagccaccgtgcccagccataaaactgtttatttctaaataattgtaattggtcagtgcagttgagcctttataatgtttagagaatctatgcccaataacagagattttaagagtattcagtcgatttcccttttctctggcattaactcaatcaaaccatctcactccttcatgtgttgtatagattttccaggcttatctctgacctttccaccactccacagcctacactcttgacataaacaaggccagctccatggggatgcgacctatgcattccacagggtgctgaactcaaataggctgcacattaggtatagtgctctgctgtcactgtcttgaaattcttaatcattttttaacaacgggccctacgtttttattttgcactgcgttgcacagattataagccagtcttgtttttatgtctagaatgagctttctatacctcacaatattctactggacaagttttcaaacagtcttcaagactcagcttaaatatcattttgattttcaaaattattctaattccctaaccctagctatagaaggaataagaagaaataaggtctcttctatatatatatatacgtatatatatacatatatatatacacgtattctatatatatatatacgtatatatacacatatacatatatttatttatttattatttatttatttattttttgagatggagtctcactctgtcacccaggctggagtgcagtggcgcgatctcgactcactgcaacctctgcctctcaggttcaagtgattctcctgcctcagcttctcaagtggctgggactacaggcacgtgccaccatactcagataatttttatatttttagtagagacggggtttcaccatattagccaggatggtcttgatatcttgacctcatgatccacccacctcggcctcccaaagtgctaggattacaggagtgagccactgcgcccggcctcttctatatattttgtcttcataccacttaccataaacttctattataataattgttttattattatttgtgtattcattttcatcctccattagttgggtttaaaaagcatgatactcattattacccacttagtaatttcccagtacataatctatgacatgtatagtaaatattcaataaatatttgattgaatcaaagaacaagtgaatagattaatgcaatgtagttatgtatccttctttaaaacactgtacattgaggtacggtataaatttgttcgataacagtgtttgccttatatctctagtgaaacttctcagttatatttttgtctaattctctttgatcctcactggaaatataagacatcttttgttatcagatattcaatcgcctttatacagttattacttgaacttaaattctttctttaaacttaacttctcagagataataaaagccatgcatgtggtttaacatttacttttacttaacatttgccattctgtatgttttattaatttatatttggaaactcatctaccactagattctaagtccttgtagaagcttttacttccagccaaggtggagtagcagggaccaaatttgctctcccctctgaagaaaacatcaacttagagaaaagagaatatgaaatagtgattttgcaagactctgaacatgagtccataaagctgtaaatgaataaagtagcatgatctttgacaggttggaaacaaatttgaagagacctacaacagccccagctactgtgtggaaagaatgattccaggatgtcatgcaggtccaggaggttgtctgttgtctctctgggttgaggcagagcagtcttgaaaggccaagctggccatagtccttagagaagactggtggagaggagagcactgcacagaaacgatgttccagagatctaagaagaaaccctccggaatgttcagtggagaactgattcgggagtgtttgaggaaactatctgaggcaggtaaataactactgaaatgattaaaaggaacaattcctgaagctcgcatagagctcaaactatctgctgcttattcccacaatccagagagaaaagtctcataattcatggggcatgggatagagtttgcatcagtagtaaagcaaaattaaccctacactaaatgctgctctgatctcaactaacaactttcaagcaagacccaaaatgtttccaagtaacttaacttgtcataaatgaagcttggaatatttctaggaaacacaaatgtccagatccaatgaggtaaaattcacaaggtctgtcatccaatcaaatgttgccaagtatgaactaagcaggaaaatataacctagaatgaggagaaaaaaatccaaaacaatcaatcaatactgaccaagaaataatactgatgatcaaagtagtaaacaagaacatttttgttttactattgtatcccatatattcaagaagtgagaatgatgagcgagcatgaaaattagaggtacagaagatataaaagagactctgatttaacttctagagattataaaatgcataggctgtgactgttggcagcttagagattgtaaagatgagtgaagttgaagacagcaacagaaaccattcaaaaggaaacacaaagagaaaaaaatgactgacaaaaaattaacagagcatcagtgagctatggggcaacttggggtcctaaaagggtggagaagcaggagaaatgtttgaagaaatgaggagtgaaaaatttccaaattcgatgaaaactatcaattaaaagatagaaaattttcaaaaaaaatagaagttcaaaaaaatggaaaaagctaaagtacatcattatcaaattggttaaaactaaagataaagataaaattttaaagttatgctataaacttcttgagtaggattgaatgtagttcaacatagtgacatacacaaaatggctgcttattctatactagtagattcattttatcaaataaaatcatttcttgttatagatattttttaaaccttagatctgtcggccatttcttagtattccttagtatgaagtatttcttaccccctttacgtatttctaagaaggtaggtgacatataacaaataactttgaaataaaagttttagtttgagtttgtttacgcagaagcaagagattttgcaaaaggaacacttgttttcaataatgtaatggtctagctgatggtcaactgactcaccttttaaaatttttactgtgtagtaagaaagttgggaaggtagtgtgaatccatttacttaatcctgggacacgttaaaaagaggactttatgaaagtcctctttagtgtataaataaataatactttatgaagtattgtataaattagtatatacataatagtatatataaaaataggtatacatgaatactgtatgaagtattattttcataaggcagctatattgattgcattgctgaactgtaaaaatgattgcaaaccaaaataagagagatagatagatagattagatagatagataagatagattagatcatagatagataatagataaaaattaattgttttggaaaaatttggaaataaagtgaatataataaatacatatatatgttagcttagaactggcatctgttaatggaaaaattgtattatacttttccctcaaagttccttactttctctgaaaccagcctgtatataacaatagccagtccgtatatggctacgcagtttatcctgatgtagttgcacaccttcctttgtgccctgaatgtgggctctttgagatccactgctgttaccaccatctggagactgctcgggctcctctctcagtctgtggttttatgtcaaatccttttatcctttaatttccacatctgtacatcctccttagcactaaggcatcttttgataatgattataggcatgcaacattgccctagatgtaaatcaatcatggcaaatacccttgcagagaacagtatctctctataaggacatacaaaagaaaactgtattatgcttgaaaagaaatatttctgagatcactttattcttgatctctgaaagtcattttaatcctgcatttttattcactgatgtatccttgtatctgccatctctttctacactacatccttttatttttcccagggctaagtacccgtatgcttttcctttcaatttcaaaatgtggaccagatgttgggacataagtactagtttggaacaaacatctgtgcccttttcaggcaagaagaaatgagaatgaggtcaggcatctggttaaggacacaggaggcatccctgtctcgtttcttaattagttcttctaagaccttctctcattctatacataatgtttataatttaaaattcatagggtcttatgttgaaagggagaaaccactgtgtggaatataaaataaaaactcattttacagtggaaaaataatttaatctatccagcttattatttttcctgggcataaagaaaatacaataattaggtagctgcatattttaatagcttttaacgctgattgtaaactcaatactgaagaaattagtggtcagttggtctttctatttttattaacgaaaactgccaatgagaggaaagctaatttaaaaatcgtacaagagtaaccttaaaagtgacttaaaacatgaaatatataaaacacatgagccacttatgctgttataatttctaaagttataccatattggctataaaccatgaattgatatgaaatctgagcacatgcatacatatcactcatccttatacaagtggagagttttttcttaaaaaaaagggggaaatgtttatgtttcaatatacttgttccattcctaataaatgaaattcattgctgatctccataatgggaattcttggctggtgtcagattaaatgtgaatttttggaagtttgtgaatgccagaaaataaaaggtggttgatttccaaaatcaaaagtaagatactttaggtatgtatgtatatatgtattttaatgttttcagcaaagccaactaggaacacaaaaagcaacagcagactagcaaatcacaacaagatttccgggtcagtctgctggtcaaatgaaagttcttatctacctatgatttaggtgtaactaggaaagcaagttgcttgacagaactgaaaatagaacaaaaagttccagattcatccaaatctgaaagtttagatatggaaaacttcctctgcttgggctttatataaattttctgaagtctcacagatcctttcaaagggtttgctgttactgagaatagaaataaaatctccagattcctcaaaatctgagattctaggcctggtttacttgttcttttggagttttaatttttaattaatcttctcccaaacttcccaagttctccttaaggcctcacatcagtttttccagctgtgatgctgtgaagcaatgccttgtcagcatcaggcctaaaagaggtcagtatccctttaaaataaatcttagggtttcactaaaaaaataaatatgtctataagcattcagctgaatgtggatgatttatgcttctatacatgcaacagcccatttgcaattttgctttaatgggatagagaacagatctaattagtataaagaaattggtaggaaagacagtcttagaaatcatctaatccacaaagtataaatgacaactttctattctttgtccatataaaaatttttatgtaatttaattaatatttaaatgtatttttttcaaactgcattgcataacaccttgatctttattctactggcctcattcagattaaagttttgcagattttgatgtggaaagcactatggaatcaagcctgagaggatcagaatcatcatttgtcatttgctaaatgcaatgtcaagtggtaattcaagataaatgccttaaagataattctgcagtcacagacgtatttttagaagtgttgaattagatttcatattctcaacacttctgtgatctttatagaaagtgatggacatatgaggtacataaactatagatagttatgattgttttagaagctgaggtaaagtgtaatgtcatcaagggactgcatgtgatgaataaaactaatgactagaaagttaatcagtgtgaatattcaaaaaatgattatatattcatttttgaagctataaatgaatcaaattataatttgattcatttatagcttcaaaaatgaatatatatatatatatatatatatatatatatatatatatatatatatatatatagtcacccaggctggagtggtgcagtggcacgatcttggctcactgcaacctctgcctcccaggttgaagagattctcctgcctcagcctcctgaggagctgggactacaggtacgtgccaccatgcccggttaattttttttatttttagtagagactgggtttcaccgtgttagcaaggatggtctcgatctcctgacctcatgatccacccacctgggtctcccaaagtgctgggattacaggtgtgaacaactgcgcctggcccaaataatgtatttttatgtttaatttgcaaaaattattatttttatttatttctcaaggcacatgagaaaatatcaaaaattatttttaaaaagcattaatatataatatgatcatcactcaacaatgagttactgtcatacacttgtttgaaggctacttaaactatccataaaaggaaccaaatcatatcctttgcagggacgtgaatggagctgggggtcattatcctcagcaaactgatgcaggaacagaaagccaaacacctcatgttctcatttacaagtgggagttaacgctgagaacacatggaggggaacaacacacactggggcctgtcaggggtatgtggggagggagagcatcaggaagaatagctaatggatgctgggcttaatacctaggtgataggttgatctgtgcagcaaactaccatctcacatgtttacttctataacaaacctgcacatcctacacatgtaccctggaacttaaaataaaagttgatgacaaagaaaaaaagactgtgagatgcatgttagattattgatatctaattaatttcatttaataaatgtctattaagaaaaaaatcccatctaatacgaaaaccacgcaggaatgtacaataacaaaatcaaagattcagtcaccctcacatgcatctcttttctggaattttggtttgtagcacatgctacaacattagacagtagggtttatgtggtacaatttttgtggaacattagattttacatatgtcctatacacatacatatacatacatacaaatatctatgtaaaacctgattcattttgtgtgccaacttgactgggctatggggtacccagatatttggttaggtattattctgggtgtttctgtgagtggtatttgggaggagactgatacttaaattggtgggctttgagtaaagtagattgccctccataatgtctgtgggtctcctcccatcagttgaaagcctgaatcaagcaaaaagattggcttctcatgagcaagaaagaattctccttcacaatgctcactgcagatttaggacttgccaccctcgatgattggctgagctaattccttataatatgtgtatttctctctatatatacacatcctattggttttgcttctctggagaactctaatacaatacccacataaaatatgtcacttcttgttggttatgaaaatactcttgcatatcaaaaactctcagcactacttaacaatcagaaggcaacaagattatatttctttcaaatgtaactcacagattcccctcttaattcctaccatgtaatggagaaatcaggcctgcttcatttacaccatctttgcatgacttctactcaccgatgaaattgattttctcaaaatagcatcaacattaaaatttgtcccatggatgctgactccttccatggttttccaagaaggagaaaatatatagatggttatgtgtaggtccatgcgtgtgcattttaagaatacgaatttccacatgctgttagcaccagtcatgtgatattagctcagcaggtattaccacctcactccctcaggtagctccaattgcaagagtgatatagccaaaacttacaattggaacctggttataatatcaacatcacagcacaaattgcatgtagctcaggtcactctctttacttgcctccttgcttcaaaggaactaccttctccttgcaaatttacccaagcctataaagtgcatggagtgtcagagaataaaatacttcctgaacatgacatttgggtaaagtttgattgtctaattattatggaaagaggaaagggaaggacgcacaaaaagccacaaggaggttttaaaacacaaggaggggccactggacaagcgcggtgcctcacgcctgtaatcccagcactttgggaggcggaggcagatgaattgcttgaggtcaggagttcaagaccagcctggctaacatggtgaaaccccatctctacaaaaatacaaaaattagcctggcatgggggtacatgcctgtagtcccagctacttgggaggctgaggcatgagaattgcttgaacttgggaggtagaggttgcagtgagccaagttcaggccattgcactccaggctgggtgacagagcgagactccatctcaaacaaaaaacaaaacaaaacaaaacagaaaacaggggctactggatgcttgtgagaggcagaacagaggaagtttaacaacaaaatggcggccaagcttgggatttagaactattggaacaagagcagattcctaaactggccaaatctcaggagaatgttgacaacacctgtgataggttatatataaattaatatacaaattttgaaattgtcaggagaatgaagtctagcttcacagcaaaagcagttcaatacattacttgttttaataaaaaattataacaaggattattaattcttattaagtgttaacaagcatgtggagaaaagggaattcttgtatactgctggtgggaatgtaaatcagtacagccattataaaaaagacagtatgaaggtttcacaaaaaattaaaaatagaactactctatgatctagcaatcttacttctgggtatatagccaaaggaaatgaaattagtatgtcaaggagatatctgtactccatgtttattgaagcactgttcgcaatagccaagatatggaatcaacccaaatgtctattgactgataaatggataaataaattgtatgatatatatgtatatatactacaacatacacatatataatgaatatactacaatatgcaatgaaatactatgcaacctttaaaaagaaggaaatcctgtcctttgtgacaacatgaatgaactgggaggatattatgctaagtgaaataagccaggcacagaaagacaaacactgcatctcacttacatgcagaatcttaaaaagtgaacttacagaagtaaaatgtagaattgtggatgtcagtgtctggggtatagggcagggaatggggagatactggttaaagggtacaaaatttcagttacataagataagtcagttctacagatctattgtactgcatggtaactatactttaaaataatatgtaatcatgtattatgcttttgaaaatcgcatagatcccaaatgttctcagcacaaaaacaagtatgggaggtgatggatatgttacttgggtggacttaatcatttcacaatgtacacatagatcaaaacatcaccactgtacaccataaaaatatgtaatatttatttgttaataataccttaataaggctgggcgcggtggctcacacctgtaatcccagcattatgggaggccgaggtgggtggatcatgaggtcaggagatggaaaccatcctggtaacacggtgaaaccccgtctctactaaaaatacaaaaaaaaattagctgggcgtggtggcaggcacctgtagtcccagttactcaggaggctgaggcaggacaatggcgtgaacccgggaggtggagcttgcagtgagccaagagagcaccactgcagtctggcctgggcaaaagagcaagactccgtctcaaaaaaaaaaaatataataataataataataataccttaataaagctggaaaacagaaaaagaaatttagtaagaagatacagtaataacttttagtagcatttgtttattgctttgcaaaaatctttaaatttttaaaataaatgtgattctcacagaaaaattatctaagggagttagaaaactgtagtggaacgtgtctagacaagaataggtgaattgtctgaattcaaatctagtgaggagtagaatcagacgttggtcccttaccttttgactccgtacactgtatgtggtaaagaatatgtgaaaaataggattcagtacctgtctaaatttaagtgtatttgggatagacaacttaaatacccacactagacagcattaaaagtcacataatgctttcacataatcatttgtaggtcagtgttctggaaaaaaggaaaatcaacgtagactaggctatttttatgtcaatgtaaactgtcactgctaaaaatgaaccagaaatgtgaaagataaaatattttcttgtttcctaataagcttctctcatgctccatggttatttttattttttgaatacagtgcaaatattactttaaatattctaaattttttcttagagtttttcattgaagaaacttctatttggcgtagtgaaaagacatattctctgaggcttgaatgagttagaagacctccgaaaaataggtgatatgatccagagaatagtttggagccaaaaagaataataccacatgtcactacctggagtaattaatacttcttggtgtgtagcacactgttttatctctacttaaaccaaagcatagccttgttttgttgtataatttatcagttctcttttcttctttgtttctcctttacaatttttcttctctttcttcaagaagagatctgaatgagaattagtatgtttactagctctgactcatatgcagaaccctgataaagaaaacagatgatcctctatttccctacacagccacattctcccccttctaacttcacacataaagggaagttgattattatccagacactgtcttcccttctgaccttggtgttttcctttccgagcatctcaggatactaatcactagttgatctctttattaaagtaacactgctcttgatattggtgtgagatgcactccattagtacgttttgttttcagaatatctcttatcaaagccagatataatatagcacacaaaatagtatgtgttctgcaatatcaagaaaggagattttttagtcaaaatatatcattattactggataaatacacatgaggcccacgcagagttcttgacattggaaaaacttatttactccttgtagcggggaatagtatgttgacttagtagcattgtggatcacatgattgatcccttgcaacagtttgggcgtctctctcatcatctctttctgaatagtccagaaattagtagtagttctaaaaattacttaaattacccaacatcaggctatttcctcaagtcttctttagagggaaataaccagattgatggaggaggaaacaatgcatcagacattaaccttcccccttgcaggtgaggtaggcctacactccagttcgtcatgggagcaagggaagggcagaaagaggaagttgaatagactagaaagtattagaggataaatgggaagaaatagagggaggaaaataaaactggaaataaaaacttaagacagaaataaaaacaaaaaggagagtgatgaatacaagaagagaactgttatcttgctcaattcttcctgtctctgataatctattctatgtttcctcaagggctttgttatattaaatgagttttgccagaattatgtgtactgttgccatgatttccatgtattcacctttctttttgaattcttctgtctcttcctccttcccttctttttgtctcctgctacccccattagttccaaattctaagcaaaggtaatctactcttcagtataaatgaatgtttctgtccagtggaatcaatatgttaaattatcttgccaacctgttaaccacgtgtcaggaacattgttcttaaatgtgattgtgacaaagcaactagatatcacagtatacaagtaatatatatgatacacacacacatatacgtacatatatacatacgtgcacatgcatatatacacatgtatatacatatatgcacatgtatgaatacgagtaatatatacacatacatatgtgcatgtatgcatgtatattatatacatgtatacagatatatacatatgtgtatatgtgtgtatatatatagagtaacttaaaatattttgacaaaaataagttttcatcaatactagattctaatatagtgttaacaagtgctaaaatttaaaaaaatgatggcaggtttgtaaaaaacaataaaatacaatctattcacttatctgtttcccataaaaacagagaaaggttgacatcctttgtttggtgtggatcactattttaggtgagcctgggaggaatgatttgagaagcagtgctttagaatatctgaatttgagaccagatcaggaaacatggatatacaatgtgtttgatcctgctattattttaaattttctcctacttattttcttatattcaatttggtcacaatgcattttcaaaacaaagcgttcattttttgaccacaaaaaacagttcgttaatgaaccatctcaacagaatacttttattttgctcaatgtctttcctttgaaactgtttttttttttttttttttggctctctttcttttctctccaaacaacaaacaaatgaaaccgcaaaaaccctgtcaatagaagtaaagtttttaaggcagatttattgtctttcctcctccctatcagaatatttaataagggtgtggctttggaaggaaattgtctcagtgatggcagaagaaatctacgtaacagatcatattgaatatattgtcctaaaatgaattatttcagagaatagaagaaaacctcttatttgttaactcatctgccttgtggaaattggaaacataagctaattaacagtaatccataaaacccattagaggtgtagatgggaaagatactttttgaagtagtaagtctgtaaatacatagttgcaccttcttccctctttttctcttcctcctccttctcctcctccaattccacagctaatattttcactatttgcgaacttatcatcatttttaatactgaacacgttattctgaagtgatccatcttgcattctaatatcgagtgcttcataaatgagcagcctagcaccacgcttagcacactatgttggaaagtcttataaatgactttgatcacaaaatgttaagaaaaagttgtttccagattggctgggcaagcgggaatgaatttgagagttgtttcactgcatcattctggttgcaaatactctcttgaattttaatgatattgtagcctgcctcagtgcttggaccccatcaactttacttccattttctagctgccttttctgcagtctatgatcattccatttctgaacctagtctggtgtctgctttaattggcctgcttttgtgatttgttcagttagattggagcttttcagaaagatagtcagaagccctgcccatcaccgtatccccagctgaagcctctttgactagtctaaacatacacacacacaccacacacacacacacacagccctttatttgtgtttgtgttttctagtgcaagatgttgcagtcttgagtccaaatactcagaggctataaaggcaacagtagctagctaaatttttccccactaaaaagcaaagattatgaagtttgtttttttaaagggattaaaatgtggcagggtagcaaaaaggactcagattgtggaatggccttgagcaaagcattaaggtgcaagtctgcagcacagaacagtcagaaacctacccagctgtgggtcttgttcttcctccatctaagttccagagctattagcagttccagctctaactcttcaatgtgacttttagtgaggtgtgtagggtaaattgaagtcctaggtctcatttgtagaaaagtattaggtgggctgttccctagtctgtttgaatcatcaaatcatagaatttctgtgcattccatgtatgtgtggcagaatcacttccctttacacaagatggctaaatgtttaaccagcttctggagaggcatttaaaaatgggatcttctgagactttgcatgctgtcttcagacctatcttgtttcagagtactagagattgatacggcaggataggttattataggaaacatattttcgtagtccagaaaatgagaatttatttggtttatgttgttgtttttttatatgattctttggctaagacactaagaatgaaatctagttattgaaatcaattttatcaggaattatcacatatacggtgtatgaaaattattatctggaagttggaaattattttctttgctcttttgttgagtcgcttattgacttaagtggtgtttgctacttacctgagtagtgggcatttgaattccaggactttgattggacctctggtctggttttgactgtttacgctgggctacaccataaaagctcgttgggttctaaagactgagggaaatgatgatgtaaactagaatcaaaaagttgtttttacttccaactaaccagcaaagaagcgattcttgaataccaagtgaggggattaggttcccttcacttccctttctttttggtaaaagctgatacaaagtgaaggatgcaccgggtcagaggatctgagaggtgagaattctgactttcatgtgagtggctgggagtgggatcacatcagctttcaaataagtttttgcagcatcgctattaggaattctgtgctgtttcgtagaacttcatctttcctatacacaatttcgttacagcagggctgcatttgaactacaacaatgcttaccaaatgtgtttcaacaggctgttgttttcaacactggttaactgttaaattttacctaatacaaactgatagaaaggatcattactacagattagtgagtacatttaatctatcttttcacccttttcccaaattccctttcctttattcatttggacagctttccccaacaatatttattctagattccagtagaaaatgctgattttgaagtaatcaggaatttatagcataataaaagaataatagttttaagcgtaataaatgactgaaattgctcataattgtttgatgattttagtcattgaaaagcctgattaggcttcatcttctgatcagaccaattgttgaataattgacaagcaactaattaatcctaaaatgaaacagtctgatctaaaatatccctacttaatactttattgtgcttggcatactgctgttcctgtgaagacagctatagtgttttgatgattatgtgcatagctgtaaaaattaatatggtttacacatacctcttcagtaatatattttttatacattcaaatttatttcaatgtacttttatcttgtccctctttaaactcttctaagtacaaagtggtatcattgggggattaatggctatttaataatttaatgttaacaaatgacaatatatgaaagacttccatcattcaagtagcctaaactatttgcaaagaatttatgaactctatcatatttgaaaattagcgtgttaattttaatcagttttcaagtatattaccacttcttaactatattactaccatctggtcttctattccttaaaatgtagaatgttctggtaattattttgcctttaagaaaaactaatacaaaaaccaagtatttgtgatggagtcgttgacatgactgatttcagtatctctaagtaattagttaaaatatgcttgttgctttcattaaaagcaattttacacagactaatgcaaaagatgatggtagtaaataggttttcaggtcatttctgataaagttaaatgtggttgtcatttcaattgatcattctgcatcttttccagactgtccatccatctcttggaacagcctgttcaataaattctacaggaaataatttgggtgattttagagaaagtgcatccttagattaaatgcttttgggtacttttatttatttctatgatggataagaatatatttcagagtgttagtttcctgatttataattattgaatttccttgaaaaataactatttgaataaatcccaaatgaaatacaaattctgtgcatctcaaggaaaacaatgaattcaggtaaagttgatctagtactcacataactatatttacatatgctagataaaattattgattacttagcacaaagttataatgtcttcctgttattgaaatattgaataataccttggaatagtgtgagagcaatattgttcaatgtaatagtagttgattaaaaatacatgcatacatggcagacttgacaagcatcttatttattttgggaaaaacttgttcaagagttaaacagtttcataaagaaggtgcatttgtgttctctaatacaatcaggtaaaagaaaaaaggtaactagagataaaacagaaatcttgatagacagtatagaaagattttgggtgcaaaagaaagcataatattagacatctaaaattttttaaaaagtacatcaaaattatctcaatctggagaaagtcaacgaagaaaactaagaataataacacagtatgataaagaccgtgatcccccacttgtaggtaagaacatgcatcatggacataaagatggagacaataaagtgacgactactagagcagggaggagtagaggggcaagatttgaaaacctgttaagtactatgcttagtacctgggtgactggataattcataccccaaacctcagaatcatgcaatacacccaggtaacaaatctgcacatgtgccacctgaatctaaaatcaaagtcaggaagaaaaaaaaaaaaagaagacaatgatctgggtaacacaggaagtgcaaggagagtgtacaacccagtctaatgagtttcaaggaaatgtcaaaagactgtgagattgaactgactctgataattatcagtaggaatttgtcttgctgttgtgctgaagttcatgcaaaaatgctcaacacatagttttttttgtttgtttgtttgtttttaaagaatttcgacaaagaaataagctctctgctttggaaggtcggtaaaagtctaagttgcaacttaaaaaaagatggcaaagctgattcacctgttgcttctaccttcctcagtaagaataaatagttgggaatctggaaggagtttaaaaaactctgcaaaatgaaaattatagactgagataggtgaagcaaaaataagagaatgcacaaccaaattaaatgttagtctctagaacctgataatatgtctaaatactgaagaattagaaaagtgtttaaaaaaaactgtggaagaaaaagaggcacaggatactgtatagaacacttgttttctctgatgtcaagtaaaagaaatgatcagattctaaaggcaataaattgataagttaggacaatttttaaaacatttcctgaaatactgtgttgttgcaaagtaatatgcagcatccagctcctccttccaggaagatctgctgtcccagttgcaggaagtgctggaggtgagctgcctttacctgtcgccccctttggggttccctgagagtctggctgagggtcaagcccacatcacagcaacccttctccttctgaccaatccagctgccttcccctccctttcaccagtgtttgccccaaagcaaactccagtagccatcctgcacatcatctcggtcccagagactgctccccaaagaagataccctgagaaaatgttggaagcattaaaaaaaaaaaatagtgccactgcccagttaaagaaacagaatatgtataaccatttcttttgaagctcatacatgctctttctcttctcaaattgtttccacaaacttcagaggtaaccactgtcttaataattgacttttttttttttttttttttttaagatggaatcttgctctgtcacccaggctagagtgcagtgacgcaatcttggctcactgcaacctctgcttttttggttcaaatgattatcatgtcttagcctccctagtagctggaattacaggcacctgctaccaggcttggctaatcatttatttttatttttagtggagacaggttttctccatgttggctaggctggtcttgaactcctgatcgcaagagatccacacgcctaggcctcccaaagtgtgctgggattacaggcgtgagccaccaaccccagccttaattgacattttttttttttttttttgagacacagtcttactctgtcacccaggctggagtgcagtggagcaatctcggctcactgcaaactccgcctcacgggttcacgcggttctcctgcctcagcctcccgagtagctgggactacaggtgcccaccaccacgcccggctaattttttgtatttttagtagagacagggtttcaccgtgttagccaggatggtctcgatctcctgacctcgtgatctgcccgtctcggcctcccaaagtgctgggattacaggcgtgagccactgcgcgcggccttaattgacttttaaactaatcactcctctgtttttctttataaatttaatcacacatttgtatttgtaaacatcatgttttattttgcatatttttgaaatttatatacatggaatgagtctgttgatagtattctttattttgttttctttaccaaggcagctgaagatgcaagggaatagaagatgagttcacaaagaaaaaataaagagataataaataaacatcattaatgaagggcatatagagaaacaactcttacttgcaaaatgcctagcacatatgactcccactacctgatacgtccctttctcctttctctgcctggtggagacttgcccagatattgcctcttctttcctgaatgaatctttctaatttttcttggttgtgtttcttgctatccctaactgccatattttattttattttattttgtttcatttgttgagacggaatctcgctctgtcaccaggctggagtacagtggcacagtctcggctcactgcaacctccgcctcctgggatcaagcaatgctcctgcctcagcctcccgagtagctgggattacaggtacgcaccaccacatccagctaatatttgtatttttagtagatacagggtttcaccatgtcggccaggatggtcttgagctcctgacttcatgatccgcctgcctgggcctcccaaagtgctgagattacaggcatgaaccaccgtgccaagcccatattttatttttttttatctgaatcccatgtatctattttactaagtagcccagccagataagagtaagccttactaacaagaattctgtaaaaagtcttcctacctttgctttcagaaccatggacccaattaccaattttctgtttgtaacgatacttacatgggttaataaaaaatacaatattcacagaatgattgggagtggaataagaatcacatattattccccaaaaagagttagacaaatttaagttatattgaaaacaagcaataaacaatacaggtggatctgataaaaatcttaatccaggttcactagaaaatttgatgaaaacatgatctgggtgagaacttgctcttgttctccattgtttactggccttcctctgtctggccacatcctgcaacatagaagtcacttccttgaatcagagtttcagacaagtcttaagtcgaacctttgatagcttcaagttctccttattagcttgtatgagctgtatacatttttaagtcttaaaatattcttggttctctgcttttatgctataaggcatctcagctgtgaatcaacaatggagaaatagctgctgggtttaattggacccaatagtcttttctgatggcaaaaatgtaatgagttccatgatgtttgctgtgatagagcactcctttctgttccatttccatgtggccttgtgccagcataatgaatgcctcacacatagtagtttctcaatttgtgtgtgcagattcaataacaaatgaatgctcaaatgaaatctcaataagataaatggcgtgtttgaacttctcatgtaacacatatatagttaacacaaaattattttaatgataactattcagatagtgtaggcacattttgaattatccagaaaattgactttttaattcctataagtgagtgttggctattgcctaaatttgagaatttcaggaattctgtggatagcaaatgattagaaattaagatccataaatcactttttttgtgggaaatggggaccagttctggtagctgaataaagaaaattccaacagattctgtcagtttcccagatttcttaagaatctgaaatgaacttgcaagtttgaatgaaaatgtccccaaagtagtgaaaataaaagctctcatgggcatcctggtttggaaaaatattataaacattttatgtagctcaatttaactttcctacattatcgtcattctgcaaatgcaccgttacataggccactgttctgtatggtgtttcaggtagttctgtttcacagtgggtggatatgactacacagttccacattaatatatttagacctaatgtagggaatatggaggtctgcgctatatatggctcgtaaatcaataacaaatgagtccacatttatgcactatttacagtgaagttttgtatattctgcatccaaataattgcacttattatgttccatattttaaagaaaaatcacatcttttctgctgtagaaaatggctaagtagataacggatttctgaactaaacataatatgtagcctcaaagttaaagcaatacgcttgcattgcactcggataaccactaggacctcagagcatgagagttctaatcaattttgtttcatatgatttgttcatcattaatctaaaaatgtattactacccaacacttacataaccataccataaatatgaaaaagtaaaatcactacatctaacaattgatggaaatatatatgtgtatccaagctttaaatcaatatagattctctacaagcaaattcaaatattttcttttgcatctttctagtattaaaatacgttttacacaagatttgaatatattttcctttcttagccacgtagttggtattttgcaaggtcagtcagcctagctgagagtcgaattagtttgagcagatcatacttggacgatccaatgcacttgtaattctgctccttgagcttagagcctcttttaatattatcatttttatatattataattgtacatcttttcattttaaatgtaatggcattagcagtgggatactagatacgtgaagccaaatgataagtgtgcttaacatcatttgcagaatttgtagatgtttagagaggctagggaagaattatatttatattcagagaagtagatctatatttggcctgaattttcaacatttgagatttaaagaaatgttgagcctacaccttaatcatgagagttgtccgtgatctagcatctctgaaggaacgtctacaggctctgtggggaaaaatttctctggcagggtcagggaaagaaaaggcttcaactcctttcagttaatgcccaaggtgcccatagacaattctagaagcacaagagtggaaagaggtcactgggtaatgagtaaaactgttctaaggggcatgtctcattaggtgatgtctaggcagaatgtataaaaagataaaaagtccttgaattatctcatgcttttctggcttttttcttgcctcttttcccttcttcttttcctttcttcttttcctattttttcctttctactataaaaacttcaaaacagcccacttctatctttcctgtccctcaggaaaccaaataactcattggatgtttgagttgaatttgatctaaaccatctcttgatttccagggtgacaatattcttctttctttcttggatattgtggtttactgaagaaaattaatctcaataaacgcccctggatttaaactatttttatcacagtctacttctattcagtttatgttctttccacctgcaactaaaattatgcaaaccttaggcatttgtttttgtgatacaatttatctccgaatacctattttgtatgtttttccccccatttttctattcaattcagtaatccacaatgggatacagtctcctgggtcccacaggtttgtctcaagtattgttttgttcttccaaaaataacatctttaaaaatcatatttacattttgattacttctgtcttgtagaataaaagatttcaggattgtgtccaccgtacaaaaatcagaaatttatttttagtaagagccatctgtcagtcagaatctgacctagctaactgggtggatggccgaggtcattttaatgtagttggctagtaaaaccctctctactctctaaagaggcctaggttggaatggactctccatgattgggataaagattaaaatggagtgtttggagattctgagtgctaaatcaatatttctgcacaatgtatttcaatatatttcaggacttctgtgtagatattatttcagtttcaaagtgcatttatttttttttattttattaacctacttttccaaataaactatttgtttctgaatatttatatatatatttcatttatataatataaatataaatatatatttcattttccccaaaacatatacttaccactcatcttggaacaattttgagaacatttgccagaattttccagaatcccttcttattttatttatttatttgtattttttttttttaccatggtctacctccctccatatattcctttatgtgtcttgccaaacagggaaggagaatgctgttgttcttcacatgatttgagctttagcattggagggagttggcattctatgctgttatatttcctgtgttatatacaatactctgttattgcccaaagaatcattattgattttaaatgaactgtaaatcatcaatcgatctgaaaatagcacagacttagttacaatcatgaaaataacacatctttaaaaaaaactaagatcagttttatgttaattgtattttatttaagaattatagtgtattattaaataagcaaaggaaaaataaaagtagacctgactgtatctagattttgaagaaagatgttggcatttatatccaggtagaagtgtattgctcaatctgatgctgcttctcatctctacttatcactgtaaccagagggccaggtttaagacttaactgccaccagcttaggtgtgggtaactcacttgtgttctctggagcttagatccctaacctgtaaatttggcttgaaacatatgcctgagcacgagcgcgcacgcgcgcgcgcgcgcacacacacacacacacacacacacacgtacttacatataaacaaatatgtatatgctatatatttgtgtgaagatacatatataatttatttttctgcagactggatgtcaaaaaaagcacatatttgaaatattttgaacttttggataacaaatttacatgatgatgtgattctaatatattgggtatgttttctagctgttcttagcttgctgggttcaggtttctaacaggtcacctggcaatgcagtgattagaagaaacttcatggaagagatggggctagtgtcttaaagggagaagatatgaattggtagaacagaggaaattcagttcaaacatagaaaaaggaagccctgcattaaaatttgttacagtacatcttgaggatgagaagagacctatttcaatgaatgaagtggttttcatttggaaataggcagaaaaaaatatagagtgcagaggcctttaggatcagtctgtgttaactattagttttcgggaggcagagccagccattgagtggtttggacaggatggtataatgatgaaattgaagtttgggaatgattattctggcagtgaatggtatacagtcaagatctgggagaccaagattgacagactgaaaatcagtgggaaacagttgtagtgatctaaataggaagtgacaagagcctatatcacaatagtgacaagaaaaatgaaaaagaatgagtatatctgagatagatggcaaatgagtaactgacagtatttgatcatacttccagtcctcccaataccccaaaatatcacatatatttttggccagggagttggagctaatgatgttgtcacagtttgacagcagacatgaaaagtagaagtcacagagaagctgaagaatttagttttcaactaaatttatgattttttatgttgggaaattaaaaatatcctaaaggcactctaaattgaaaggtgacccacgtgaaatatcaggtgagttgatattgattaggaagctgtctctacacaggtggttgttgaaaccgaaaacggaatcagctctcactgaaatgtgtttcccattaggctatctactcctcaggataaacctagtcatttgtactggtttcagatacagtaaaatatcaacttcacctttatttttctctcttttgcctttaagtacaaatgtaaattttttcttctttagttacaagaacaaatttagagtaggttgtcaatgtctattgccaagtaattgcaatattcacccaaagaatcttgtaatattttatgctcattagcaattccatttgatatccaaaatttcaacaaaaggaaaattatacacttgtttatccaagctgaaggcttttgaagatactgcagaattcatagctgctatggaaaataaagcagcataactaactcctggtatttattttctcaaaaaagagatttgattttttttatttcttttttgtgtgactgtaattattatcattattttttacttttggagaggcaagcattttgtgctatgaattgaacgtagagttgtacacagaaaaatatttgttttcatgtttcctttccctaaaatgtctgctagagtacagatgaagattctacctagaatgaagataatcttttttgaaacaattggttaagattaaattgatttggtttaaataagactatatatggagaatctaataaacattgagacaagtagatacaacaatagtttaaagaagaaaaactgaatacatcctattcagtacaaccttagataaaatctcatgaatgaaattacttggcgagtagggctacaaaaaatagggaaatcataggcgcacatgctctagcaactatggctacgcatacactgccgcttcccaaaattttctatcaattttaaacaaaggtagagaataaaattatggatactatcttagcaagttttcttattttttttaaagtaagattgctagtgctgcatgaactatttgttttccccaaacacttgagttgcaaagaattttatttcatggaataatagaatccattaactatgatcctagagaaagagaaagttttcaattagttaatataattatatttgttacaagtcaatcagcaacaactcagtatttgaaaatccatgttttagtttcaactgaaccactacctagtcatgaaattgaggaaacgaatttatcactaaggacctcagttggcactgtaatattcattcagatagattattttaaaaacaaaatcaggtcatacatataaaatgactgtgaagactctaactgctttgtgaatgtgttgctaagatcattctagttttattatttgtctcatggaggattccattatacatattttacttttaagtgagtgataaaatgttaagcttcctaatgatttctgtggtctctagcatagagatttgttacaaaaagggatgccatattatctatgtaatcattttacataatacatggagttgtactggattaatctcaaccatttttaatttaactattactttgtagttgaacttgagcttcctctattcaaagattccagtaatcattcttcttcagcaaacacacacacacacacacacacacacacacacacacacacacacacacacatcttctggattgtatactaaaaatttatatattttggattgaaattaatttgtaaccaacaaagtttattatttagagactgtgattctgcccagattaagatttgtggcgttatgtttaaaaggaagacaataatacctaaattagatggtcagtgttaggattaaatgagataagggtcagaaagtgagtaatataatgcccaacttatagcaggtgttaaattattgtatgcattctaccgtcctccacaagcacacacggcccctcataacacaaaataagcactgaatataaaagcctcagaaagattaagtggtaggaaaagttacttttactctttggtaaccccagacagagagttggtttggggtttagttaggaaagcatcacaggtgagaaacacaagtttgaggcagttttatggcagagtgtggaggtttagtctgagtttgcggcttttctttcctcattcatatctcgtcaattaattttcccctttaaggaccctttcaagcctgagagaagagtacagaataaatcaaaagaaagagtggagagacaaaaatgaatgcagaaagagggatgcaggaaacaaaaacccagcaagtagaagggaatagtgagaataaagaaaacgagaaaaagaaaacaaacaaacatgcacacaaacaaaaaaccaccaagagagggtgatccatacctcacagtgctaattaagttctaagctggtttgacatttttgcctcctggacaccaacaccctccaagcggggcctctttgatttggtctcacatcagtagcgggctttgttatgagatctaggtattaaccccacatgtggaaagataggttaatttgactaaatatattttttaaattctccgcaccattgagtcatctaagtgtcacatctagtatctgccacctaatgttatgcttagcttctcctccttcaagtagagaaatccagataaccaacccctcccctcttcccctctacacacatgtacacacacatgcacacacacaggaaggcatgcatgcacagcacatattaaacacacaaatgaataaatagtagagtccgtggatgatttagagacatgtgaaaagtgaaagttttgggggctcaagtaatttaggagagttttctattaacatgtagtttaatgttgtctttccagttaatgtagttatataatatgtaaattaaagatggtgtctactgcctaagtaattattacaacaaataggaccgattattgaaggtgaactccttccttttctgttctctactcaaaacaatacttttaaaattgcttatttagtattgaagtaggaaaaaaataacgttgatacaataaaagaacttatttctgactggtaggtgatgataggatctgacaagggggtgtacttcagagagattgtcaggattctacacccttgtctgtgcctaggaaaacagcccaacctacctacctttagttttgaatggaggctgcaggatgttactcatcattgcttttagaacaaacacttccctttgaacgatgtcacatcactattaccatggcaacagacgccctataaagatgagttatctatgaattgtgcttctgttcaataaacacatctcttaaattcatcaggaaaaaggtttagtggaggcagttctatatattgacatttcttattctaaacctctgtctgataataaatattcatttcattaaagtgtttaattcaggtgtctttcatattagctatatcacataaatttataacagttttatgaatttaaaacagttgctttattataaaaatgatgtatttacataataaatgagattattcttatgctaaaaagcataaaaagaaaaaagaactctattctcagtgtctaaacatacagtgaacaattaatttataaaaaattaagtttatcaactttataaacaaataattttataaactttataagtatagagtcaagaattagcttaatggaccaaaaaaaacccaaaaaacttgtttcaagttaatgacttttagaggaatgcaattaagtgggtagaaattatagctccatatattttatttattttattttttatttttttgagacagagtcttgctctgtcccccgggctggagtgcagtggtgcgatctcagctcactgcaacctctgcctcccgtgttcaaacgattcttctgcctcatcctccagagtagctgggattacaggcgcccgccaacacgcccggctaattttcgtatttttagtagatacggggtttcaccaggttggccagactagtctcaaactcctgaccttgggtgattcacccacatcgacctcccaaaatgctgggattacaggcgtgagccactgagcctggtttttccaccaaagtagcaccctctgggaatgaggtaatgataacacaccgacagcaaattatttcgtagaatcatctcctcctgtctaaactgcaatctacaaaaatactttacataatagataaacctaagaggaaaatataaagtccaaaagggtaaatttctaaaacgaaattgtaaataaaagaatggaaatgattggatgccagaagaaaggcaatgagaataatttgtcagcaaggagaatgatttgattataggtaccagtgtcatggctttataaagatggttatgatttcaataggtcgcaaaaattacaatgtatatgattatatatcttaaaataatatgtaattttatgtaattatacaaaaaacgttcagcttctattctggacccttgaagaacataatattaatattttatggtgatctattcataaagaagttgatgcacctttgtagttattcttcgtcccaggttgcagaatgcaagctcccactgtcaattacacaaatactattggtttcacagtttgtgagtgtgtgtaatttttaagcaatttcttagaacctataaaatatatatatatttttttttttccttttttttttttttttttttagacagagtcttgctctgtcacccaggctggagtgcagtggtgcgatctcggctcacctccgcctcccgggttcacgccattctcctgcctcagcctcccgagtagctgggactacaggcgcccatcaccgcgcccggctaattttttgtattttcagtagagacagggtttcactgtgttagccagaatggtctcgatcctgacctcgtgatccgcccgcctcggcctcccaaagtgctggtaccacaggcatgagccaccgcgcccggcccccagaacctggtatattaatgaaaattttttttttcaaatctcagaggtaaagactagataagaaattgagtgaccaaaatcatatacttctcctaacctgaaactgccagccagtagtaaatggtttatcaactcattccagcaagtaaaatacatcagttaatactcttgcaacgtaaattggtatattgtagctcatttggtatatctcccaatattcctaattttcattttttagttcttgttaatcagtcctcaccagtcctaatcaacattttatttacattttacttattcgtaacattagaagaaatgtttgggtaatatctgtgcatacaggatatattttccaaggcaatgtagcatactggctctagaaacagatctggagtttaatgccatgtcaatcactatgtgaccttttgcaagttactcactgtcttttatcttcagtttcctgaatacaatgaaaccatctactgcgcagtgtttttgtgacaattgaactcaataatactgtaaagcacttagaacaatttttaggacataataattgttcagtaaatgtattccacctcctcatcatcatcattggaattattgcagttattttcaaccattattcagatcctattgaaaggttgaaggcttgtagaaatatatacggaatgattttcactgtcgctcggagtagcagatttatgaaattaattatccttagctccttgtgctaatactgtattatccctttagtcattttagcctggaattacactcttaaatataaccaagatccagtgggctacatcataaggaaaaagtagaagtggtgttgaggggcgtctcctgtagacaagaacaagtaagctaatttacttgaatttgactttgaatagaggtgaaaacttcaccaagaatttattgtaagtgtcccagtttaatagtgccctcagaagcctgtctaaagcaaacacaaatcttctctggaggaaagcaccttcaatctaaacttcaaagcatgcctatatataaagctcaacttactaggagtaaaacaatcaataataaaaaataatgataacttaaaaacataaagaaaagcaaaaaattgagttagtcaaagcaacagtcacaagactccaaccaagattcctagtgggtgcttcataaaaattgacaagctgaatctaagacctaaatggaagagccagaggctaagaattagaaaaaaaaaaaaaaaaaaaactccagtgaaacaaaaatttaaaaagtagaaaaagaaggagagttttctggatagtaaagtgtttgtgaagaaaaggtaaattaagggcatgtattcattttggatatagatgattttatgttttgtatgtgaatgcatatagagggatatatatgtatgtgtgtgtgtgtattatatatatatatatatatatctgtgcatgtgtatacacaaacatacactcatactcacattaggttggtcacagtggctcatgcctgtaatcccagcactttgggaggccgaggctggcggatcataaggttaagagattgagaccatcctggccaacatggtgaaaccccatctctactaaaaatacagaaattagctgggcgtggtggcacacacctgtaatcccagctactcgggaggttgaggcaggagaatcgcttgaacctgggaggcagaagttgcagtgagctgagatcacgccactgcactccagcccggtgacagagcaagactgtctcaaaaaaaaaaaattgtcataatttaaacatgaaatattttctcaacagcagatacaggagaataatagaccttgattgaataaatagatatcatggaatattatacatactcatggtcgagaaataaaaaaccttccaacagtgacattacttaatgtccataaacatttaaattattaaaagtgtttctcatttactatctcttcaatacaatatattttatttgcactggaaattttaaaaaaatatttttaaggccgggtgcggtggctcacgcctgtaatcccagcactttgggaggccgaggcaggcggatcatgaggtcaggagatggagaccatcctggctaacacggtgaaaccccgtctctactaaaaatacaaaaaattagccgggcatggtggcgggcgcctgtagtctcagctactcggggggctgaggcaggagaatggcatgaacctgggaggcggaacttgcagtgagccaagatcgcgccactgcactccagcctgggcaacagagcaagactccgtctaaaaaaaaatatatatatatatatatatatatatatatatatatatatatatatacatatatatatatttaagcacagagttgtgaatagcatgcattattgcatattgatacacattcattgttacataattttacagttaaataagtgagggtcagatattgccaaaggaagagttcaagagctggtttctaacacaggtcttatttttaaagcttgtttgtgtgtgtgtgtgcgtgtgtgtgtgtgtaatttttttggtttcctagtaatcgggagttttggaaaattatgatctcagtatgttcttaaaaatagtttatagataattccaagaataaaaaaagtttttaaatataataaggaatcttaaccaggtaaatgtatgtcttattttttacaaaaacagttaaaagttaaaaaagaaaaatagaaaaaaattataaaatagggatataaagaaaatatttttgtacagctgtacaacgtgtttgtgttttgagttagatttattacaagagagtctgaaagttaaagaatttaaaagttcataaagttaccgtaagctaaggttagttggatattgaagaaaaatgttttctacacaacgagtataatctaattgtatagtgtttataaagtctatagtagtgcagggtaatgtcctcagccttcacattcacccaccacccactcactgactcacccagagcaacttctagtcatgtaagctccgttcatagtaagtgcactatacaagtgtaccatttcttataatctttaatgccatatttttactgtactatttttatgtttatatatctttagatacacaaataccattgtgttacaatgaactatagtaacatgctgtacaagtttgttacctgggagcaataggctgtaccatatagtctaggtgcgtagtggtgtgtaccatttaggtttggttaagtatgctatatgatgttcacataatgaaattcacctaacaccacatttctcagaatattttcccactgttaagtgacacatgaccgcagtcatgcccaccaaaattcaggacataaaattgttattgccagttagaaaatattatattggaaaagtctgaatgctgtctaaaactaagaattacaaaataaatagcattcaggatctacctcctttaggtgtgagattttgttttaaacttttttgtttatattcatcagatttgcaggataacataaatactcaattatcctgagtcgtttatattcacaaaagagttggtgaatctttttcataaggatgaaaataggaatagacaaaaaagacattatactaaaacaaaaatctctgaaaccgtatcagaaagaaagaaaagaaagaaagaaagaaaaagaagaaatacatgtctgctttgaaagcacacttgttttgacttttggaaggtagaagctttgttaagaactgagttgtcttattgctacaccccatgattagagattaattgtggcatatttcttcttgaccccttgctaaagattcttcagtctgcaagttggagcattacgtctttcctccaacccttacatattcttatttttaaggtatagtttttaaaatatagttattttctgttttctttactcttggttcaaaaagcataatttagaaattgatcgtgctgataagaatacaatggcaaaagataaaaaagcttttattatagcattataataatgtgtgttatgtacgaaaaagagcaagactaggtttttttgttctttctgattttgccaggttaccttacaaatggtagtaattatcctcttttcttaactttaggcttttatgatcttgcaaagatatgacaaaaatgggaaagtaactgctaattgctattttttttttgcaatgttggaaagtacactgtgacaatgtttaaaaaaataaaacagagagtggaaaaaaatcaccatcatcaagcagcctttattaaccacttatttataaggtgatgccacggcagacaggcaggctgggagggaggatgtaagatgcattagtcacctgtgctatgtcctgtgtacttattctatcccaatgaatgtccacagcaattctaagaaatttgaataatgataccaattgagagatgaggaaagtcagctcagaggtatagcaaaatttcttatgtgatacacctaccagtggtaagtggtagaattggatttgacccagatgggtctgatttctgaacacatgctctttccttcatatttcctgtcatgatggaatgcttacttttttgaaagatgcaattcccagataacttttcagaatatagagaaaagataatcccatgaagcttttattttgagacagggtctcgctctgccatccaagctggagtgcagtggtgcgatcttggctcactgcagcctccacctcgacaggttcaggtgatcctcctacctcaccctcctgccatggagcttccttaaataataacagagtgatgaaataatctgtacaaaaaaaacccatgacacaaattacctattaacaaacctgcacacgtaccccaaacttaaaataaaagttaaaaaattaaaaattgatatagaatctgtctatacaatttaatctgtctatacaagttaaatagattttaatcttcataaaaatatgcctttcaaatgtaagattgcatgtttttctttgtatcagttagtagtacattcattacaaggaaaccaaaaatgtacccaacccacagcagtcttttttttttttttttttttttttttttttttttttgagacagagtttcgctgtgtcgcccaggctggagtgcagtggcacgatctcagctcactgcaaactccgcctcccaggttcactctattctcctgcctcagcctcccgagtagctgggactacaggcacccgccaccgcgcccggctaattttttgtatttttagtagagacggggtttcaccgtgttagccaggatggtctcgatctcctgacctcgtgatccgcctgcctcggcctcccaaagtgctgggattacaggcgtgagcaacagcgcccagccaccacagcagtcttaaacaagataaaaatctgctttgctctaagaaatgtagagataatcatgctagggttgttttaaagcaaaaaaataaaaagttatctgagacacaggtgccttccatctcttcttataggttctagagtctggaagaagggattagggtgggattggttctggctgctacagcattaacttcattaggagaaactctgggtggattgggtaagtcaccatcaggctattggccagtcatgaaataacagatatcatagaaaatcagagtgcccatggaagtctgttttcggaactttacgatgataaatgtgacagatctgggagcaagtttaattgccaggacaatctggagagctggaggcatattcttttgggagagccaagagaggtgcttgacagatggtactttgcctcaagcctgaaagaatcgaaaggttcctgtctcattttttcacatctgttcttggctccctaagtattactcttctatgtattcccctcacctagatgccaagtgttttctctaagaaaacattgcatcttttccagctgtactgtaacttcactctgtgacttgaatttaacacaattttattgcatatgaaaatgaagaggtctggagatttctctcttatgcatgaattgccaaaatgacatttctaaacctagaataatagttttctttagagaatgagattcgctaggacccacattctcttcaattaaatcttaatacgtataagtcatgatctcattgaaataagtcattgattcattttttccatattaaaagataacaaaaacggattatgatagactagaatgcaaattctaagttgtttcagtgccaaacaatgattggtacttaattttattaggaatgttatactaatgcccagttgattctgacaagcatgtctggatttatttgtaaataggttagttaatggagacatttaaaagattcctgaaggtacccaagaaataaaaacgctaagaaatgaaatcattgcaaacatatgtctcgtagttgacaaactcttcttttaaaatggcaaagtgcaatgtcctcctaaggaagctatgcttatctcttcctagactgatctacaacttaatgctaatatctttaatttctttaacaaacagtttaggtaagttacatttgagagtcaaaagtgagggcagaggagggacttggtgatcaattttccccacagcaaactgagaaaagaaaatgaacatgagatagttgacattcagaatgttctaaaaaattcagaatatatgattgccataaagtctggggaagagaggcttacgcagcatcctcaagtacagatactgtactaacacaggtaatgagtgaatggtgttcagatcatgggcacttggtacttaaagaagcgcagtgagacggaaataaggaaaagcaggcaagagcccagctccacgtgcttcatttacaatcttgcttagagtcagccctgtttaaaatggaggtgtggagagacagagagagacccaaaccgatctgtaagggacattaaaggttaatagaactgcgggtcaatgttcagagatttttcaacaagtctgagaagtgttaagaaaagaaaaaaagactaatggctaaaaccaaatatcatttctctagatttagcccactcttcagaggtcttgctttgtttcaaatttttgaatccgttaattttaaacatttggatcataccttgaattttttccgtcaaattgtatcaccacatctagtcagacacgcggcttgctcttttctttctttagtcttacgcacgtgaggaatttccactgctacaaaccctccatcccttcaggctttctttctttcctcccttcctcccctcccctcccctcccctcctccctccctccctccctccctcccttcctccctcccttccttccttccttcctcttgctttaatgtgtgtatttattattcaagagttataagtagatattaattatatcagatttatttagctatgtcataaatttcatttattgaaaaaaactgtgtgaaatcaggactctgtaggtatacctggaatgcatagtcattttaaaaccaaactctctattttgttaggactacgctaccacaaaagcttctcacctgctcctcctaccttccttctcttcattcaaccattcactgctgcctaatgaaacgctcttaaaacagaagttttgtttgtttctgttttttgttttgttttgtttgtttttgagacagggtctcactctgttttttgtgctggtgtacagtgccatgattttggctcacttgcagcttcgacctcccaggctcaggtgatcttcccacctcacctgcccaagtagctgggatttcaggcacgtgccaccacgcctggctagttttttgtggagacggggtttctccacgttgcccaggctagcctcaaactcctgggctcaagcaatcctcctccttggcctaccaaactgttgggattacgggtgtgggccaccacgctagggcacaacagaagtttttgagcttttagagacagtagtgttttctcaagggaaatcttattagggacatggaaacagagatttcaatttgaacagctgtgcactggcacagcagaaaagactgaagccacacctatttgaaatcgctaaagttaccacccatttttcagcagtttggggccatttcccaagtctgcattttaattactatcacccaacaacagttccttccttgaataattcttaggttaaaccttttttcacatgtaccctataaatatgtacaaatataatgtatcaatttttaaaagttactgaaaactccttaacatctcactattgccttcatgatcctcagtctcctttgattatattaaaagattatattgaaaatgagtaggaaatcaagtagaaatatataaagagcattgcaaaaagctaatttagtttttaacttgtctaattgaaaaccgaacctttctcttactgctcttttagtagtaataataatgtgtatggttcatgagaaaggctataaaatataactaagttttacattatccttacatcagaactctgtgtaacactgatgcaggagttttctcagccaatttgccaactggggacctccacggccagtgacacacacacccccacctgctaccagggccacagttggccttggaactgtcattggaggtgccctgcccacttggcctgcgtgtgctacagcttgtacccatgttcggcgattcccaagctcttgtcccccatccaagaagaatgaggatatgctgacaattcgaagggtgaagatgggtggagaggaattttattgagcaagggaatagctctcagcagagaaggcacgtgggggtggtctccaacccctgaagtcgggtggtttctttctcagtgtggctgagttcaggacttctatgggctcagaataggggagtgtgctgactggtttgagtatgcaaaaaaggttaaaacaaaagcaccacttaaaggtgggcatgacagtataaaaaacaaattagggaaaggtaggtatatgtaaaatcagtgatgggtagggatcaatcagaagaaagcgcatcaaatgggaagacaggttctcaatccagtccatagatttgacttgtagcttggctttcaggctttaaactgcctttggtttggaggggggatttcactggggacctgcccctacctgcctaggcatttgtctgcctcctgccactatcaacacctcacaagtttcaataatcatttgttgtttttttaactcaacaaatatttattgaacagctactatattttatatatctcagacactgttttaatcactaggaaaaaatatggcagtgaataatataaacctgtctatcctcatgaagcttatattccaaaggaagaaaaaggcaatatacaagataaattagaaaaatgtatactatgctaagtattggtaagttgtaaaataaaaaacaatcacagaatggaaacacaaagtgtaaagactgtgggtttggataaaatggtctaaacatgttttcccgcgacataacttttgagtaaaggctgataaatgtttgttgagtgaaacaggtatgaacaaaaaacagtaagacatttaagtgtagaattcaatttaacattttatttatggagtacctgctatatgtaaggttctgtagtacccaatgggaaaatactaagataaaggtgtatctgcacttaaaatatcgtatatatttgttaatacataattgattaggtaaaaataagttcatatttttagagttctctttaaattatctttaaattcccaaagtaacactggaattttaagtagtttattcaccttactagacctcagtatccactttaaaatgaagattttcaatgagcaataagattctatatctatcatgggaatgtagtactgataaatggcgaagcagataattttttctcactttgtaatggtgactttactgtctaaaatctaagccaattatgtaattataccaatggaaaaatatgctatatgtatttgtagatatttatctataaatatgctttttatttctctcaatcttttaaaaaattatattctttctagagtgcatattatatgaaaaaggcataaagatttttgcaaagcccccccaaaaaaaacaaaacaacaagcaaacaaaaaacccaaagatgagaaattataaggctgttatatgaaaataaagtttccatgtacaactaaatcattctagctacaagaacacttcagtggcattcagagcatagaatttcatcacagaatggaatcttgtattgccccttttatcccacacccgtgtgagctttggagggttgggttctgctcacttctctggtataataacataacaatgctcatgggaagtgtatcatcatgtttttcttctttttaacaaaaaaaaaacaacatgatcccaaagtaagggaaaatcagaaagtaagttttattgcctttaatatattgtatttttttttcttatggggacttttgcaactcagattagggcgttttggaattattatctgagctgcagtgtcaagagactgactccccaaagattaactccccaaagggtacaatggtgactcacatgaaggatgcacacgaaaggctttgtcacttcggtaattggagagcgtttttagagaggatgccaggcacccatcagagcattcctactctcttacaaacccagtgctgttagtgaatcttctatggattcagaagctgagatgaaactaatgtctcatatctgtggatacaaaagaagtaaagaaaatattgatttttgattttgaattagaaattgtggggtcatcctctgcctactttgtgaaacaaaatttctcacaatttccagaaaaaggtaattcatcttctattatgtgtctgcttgtgagaatttctatataagcctgcagaaagtgatacctccctgaaactctgtatccttgatctaaagatatgaggatgcaaaaatggttgtgactgttggaaaaataagagaagcctattgtcttgttttattttctggattccaagatggtaaaactgctctgattttctataattaagaaacgcaatgtctctagaaagatggtgattggaacgtgagtaaaaacaaacaaacaaacaaaacttattttgcgagttttcatccttgtgcacacaatggtgcactgccaaatggaaatgtttgctaagaccaaatacatataaaaggttgagagaagaggggggcaggaggagagagagggggagagagagagagagagacagagagagagagaaagcatgagtaactaatacgatttccacaatgtaaaaatagaatttgacaagccaacattcacttggcaaatactgtgcccttcctcatgttcatcttgctcataaaaatgtctttgggaaactattttattgaggttaggcatcacaaatcaatccacgttttaaacatttggagtttcatcttagttccttggttcttccttggagttgttattctaaacatcaatttgtaaatcttttcatatcttcttaagcaggtgtcaaaccaactcctttggcagaattctaaaagcaacttgtacgcaactctaagacagatgaatgtatacaaaattcaggcttcatctctgcacagagataagtgtgaactaaggttcatgcttctttcatcttgctttggtttctcagttgctttatctgtttttaaataaactgtgttgtgtatattgaagctatacaacatgatgttatatgatatgcatatacagtaaagtgtatattataggggagcaaattaaaatatccatcatcttaaacattttttccttttgtggcaaaagcagctaaaatctactcatttaacaaaaatcctgaatgcaataaaatattattaaatattttctgaatttttatttgaagtagtctacaaatatttactaggtctttatttcttctgagtaaacaacaccaaacaagatgagatttgtgatgtaatgaatacttgagtaatctaagcgcaatttaaggataagtctataatccaggcagacatatctaaataataacccttggaaataaagtagtaaaaggaagcacacgctttctaacttactttccttgacatgaactcagtttgagatcagtattgaacatgacattttctttttatttatatacctccgtttatccacaagtattaagtcaaaattgattttagcaacagaataaagctctgtaggttctgttcaatgatgtcaaatctatccctgacaagtgtcccatttttgctcttcctgaatagcatggcttcaaaaaaatctagaaaatgaaaaattctatagcgcagaaggttaatagtggtgaatctctaaaataagtagattgttttggagtcatgtttgtgtcttgaatcactttaaaaattttgaaaacaaaatttgatagattttgaaaaaggttatgtttgcatttctgttgttaaggtgatgtttcctggagtgatctaaaaagaacctatgaggaggtgaaataagagaactagaaaacagaagacagcatgtttctaatcccagaaattaggtttctgggacaggtaaggaaaataaagagcccaggtgtacaaaatcaataaagagcaagaattattaaaggtagttaagagagcctcactttctcatctagcatctcaagccacccactgtctctgggtgtgttcttggtaaaaacagacacttaaaagtttattactaagaaaaaggaaagagaataagataaaaatacagtcttttgaaaaaaatctgcccaattttattgacaaaattcaccatgcatttcaatatagaatgaggaaacattaaattaggtattatttgcaaaagaaaaatgctttgtatgagggagaaaataaccatacatattgagtacagtgtaccctgcttgagtgataggtgcactcatatctcagatgtcaccactatacagttcatccatgtaaccaaaaaccatttgtatccccaaatctattgaagtaaataaaaaatttaaaaaataaaaatgcaggccggaaacagtggctcacgcctgtaatgccagtacttttgggaggccgaggcgggcggatcacaaggtcaggagatcgagaccatcctggctaacacggtgaaacgctgtctgtactaaaaatacaaaaaattagctgggcatggtggcgggcacctgtagtcccagctactcaggaggctgaggcaggagaatggcatgaatccgggaggcggagtttgtagtgagcagagatcgcaccactgcactccagcctgggccacagagcgagactctatgtctcaaaaaaaataaataaataaaaataaataaataaataaaaataaaaatgctttgtatgtagtaaaatactaaaagttatgaaaatattgaataataatattttaagaagtgaaaaataaaagtttccctgaaagcataaagaatattatctttaaaattctgttacaaaatgtttacttataatttttttcaatgaaatgaagtagcattgataccctgcttacagaacagcatgagacttgaatctgaaaggcaaataaccaacagttaggagggtatagtactgtgtgatatatgtatgactgctatagattcatttatactgactgaaacacatgttctaattaacctgagtgggggtcttaaaggattcctggtcaactgttatactgcaatgcatttttctcactttatatttaagtataccccctttaaaagatggaatgctttaaaatacatttactacataggcaatttgattaatatttgtttttattttcccttcacaaataattcgatgagctagcttatgaaggcaatgcatctgcacatttaggaatatgttccaaatctagtctatgtttccatgggcatttaccaactgcatataacactcacagcaaaagctaaacaagattagtgattcccaactaccagaggataaaatcaatttatcatccattctagcagaagccatggagttttataagtgattaaattgaaggaggcgctttgggcaatgtagaaatagagcatttcttgataaaatgatgagtgaggttgtcaaatctgtgataagcctgtgatgccggctaggcaggtcagctcctctgggaccctagttacaatggcattttcttatgtttgacatgtatctggatccaagggagagaacagatttcccaaaacaaccctttattgttttctcatttccatgtcgagtaagtaaagcatacattacatatttgtgtgttttcttcgaattaaggtttgttctagctgaccacagaatagagacaataaaaattcatgatgtgggggagagttaactggattatgtcaggggaattgtttgtgtctagcccttgcctctgataattagttaccctctgaccttaggtgaatcactttcatctcctcgttttcagtttcctcccctgcaaaataatgaaggcaagcagaatcaaatggaaagttcttgccacctctaacaggtcatttttttttttttttttttttgccttcgtaaagcactacagtataagcattaaatttacttttgtatagtgagtattttcaggacgagaatagcatagggataaatgtatgcttggttttttgaggttgaatagtaaccttaaattttgttgttgttgttatttctatttgcattctaagaatatgcttgtgcagaagtgtagacgatggtgaagaaatgagaaagggtaaggcatgagaataaagacataggagactaaacaaggtaggcttatgggtacaagtggtaaggccaaatcaccttcttcaaaggtaggcctcaaaattcaccttgccagaatttcaaaagaaggtcaaaaaaagaggaaaatgagcagcaaagatctactcagccaaattgtgagtactggattaggacggattgtggagtgaggctccttcctacttcttatatttgctgggtctaaatagaagccccagatgtgccttgattgaggatggcaaaaaagtgtgaatgctctgttgaatgggacctcaccacagctcttccctgccctgatatgtgtctccaagtgtatttgtaacccatgcgacgtgaagaaaacatacagccttcttgggtgatgatcaagtctcctaagcctaaatggtctctagatgtggctctgagttcaggcggtgatgactttctcaaaagcccacaatacgcgtggacatgtgctgatgtccatgtggaaacatgctaaaggaaaggaaagttagaaacataagaagccctccatttacttcgtcaattccttgagtttataaaattgatcttttcagatacattcaccgatttagcaaatgatgataaatacattgaatttaatcctgtctggtttatggctattaaaaacaatgaattttaatggagaacaattgaaactaaaataaaaattacaatgaactagaataaaatagcacaaattaattctgccagtcagaagtgaaacattgtaagatatcccttgtgatcttctagaagggttttgctttccgaggctctggcaaactggttggaagctattgccttcctgattttcacttacttcatcccctaaaagccttcttttttttcccatatcaagatcaaagacgaaatccatgtctaccaggctgtttgtagattttatcacttatttcatggggattgaagaactattagatgatatttgagaataacagccaaatgagcatattagccattcaggtataacaaaaatggaagtcagcagtctatctttaattttgtcacatcctgtagacttaaatcatccaactgcagagcatctgttaatgtgttctcagttcttgagttatagttaacctaatgccactggccctactaagggggaaattcagaaacttcccattggaattgtggagtgggcattaacctcgagggaataccaaggtccacagtacatgtaatctcctttccacttcttaatgaccctgttttattgtgttcattttacaattgtgaaaactgaggctcagagtgaacaacgtgtcagtctctgctcttcttgtacatgcacctacttaccacttctacttattgaatctggtctcaggacttagtactttatctcctctgtttctaaatttgggttaaagttgtgtctattgattaaaaatcttaaacactgaaaaagtatgaatgcacttaaatttcccatttctgaaaaacatttactagttttctgattaaaacattgtttatctatctatatctgtggtttgtataatcatttttatcaagaattgaaggtaatgtattttcaaattagaaatgtatactttaccgtttactatttattaataaataagtcatattttaatatgcttcttccttccagtaaacaacacttctctttttttggagagttcaatgattttagccaacttcaggcttcttagttcctgagtctacagtgtacttcacccaaacttgtcttcataagtaaatccctcataatccatattcattctatactttctcttctccaacaaaattcttacctttctagtgttcttctatccgtcagaattaaaagaagaggtcttgtcaaattgattcttattgaatattttttgatgtgatttctcaagttctccctaaatgatttttttatttattctaacatgtatctatgattacttacttttaagtaatcatacatatgatttccatatataaacatatatatacattatatgtatgtaatttaatatataatatatttaagtaatcatatatatggtttatatataaacacatatatacaattatatatgtttattcaaacatatataaacatatattctaacatatacataaacatagaataaacatatatataattgattacttacttactaaagtactgtactggagttgaaataaagaaaaagatacatggaactcacagttagtaagagaagttaaaggtacaaagtaataaatggcatgtagtctgtgtagataaagcattaattgaattcagaagcaggaaatacatctggagatgatcttggagagcctatcaatgcaactggcattcacactgcttctaaaagaagaaggatttggaaatttaaagatgggaaaggatatctgaggaggaattatagcatgagtctgcctagaccacatcctcatttcccttcaggaactgtaatgaagaatttgggagcctccttggccatcttcaattacttcacagagagaaacatcaaaatttcctccaccataagcctgccctaatttatttttgttttgttctacagagcactccatttttagcagaaataactatagattgcaatgcttgaaaccaggttgtattttgtgaaaaatacttgttttaagataaaacaatttaattcacattacttaaaattctataagcttttccccccaaactcagagaattggatcaaattggactttagaaattttcattttcaattccgtttacaatcagtaataaaattaagcattttagattgactttttctttgatttgtttatatacactgtgaacgaaataataaaacaaagttgtataggaagaaagttgcaaaaaaaaaaaaaatcctgtcggttcagagttcatttagataaaggccctttgagtcatgttccttactttctggagaggagaactaatttttactccagtagatggttcatatatcaatttaaagagggaaaagtaacacagaaacacatttccaaaagcatgggtgctgaaaagacttagactaattttctctcaagagcactaatgtgttaatctagccaaacacagtcatagtgtaagatcaagaagtatgatctatggtgtcacatttttaaaagtacacatagcattgaagagaaatcttacctgtttcaaagcaagtcctctacattcagccttccatataatttcctgttggctgtgacttcttcatactgcatcttaaatagattatctgtactctgccaatgatctgtctattgacatgaattatgttccattctgacttgtatatatacaagctgcaatttgaaatcacttttagtctaatttatttagctgaatatatatatttatttagacagagttttgctctcttgcccaggctggagtgcagtggcgccatcttggctcactgcaatctccacatcctgggttcaagcgattctcctgcttcagcctcctgagtagctgggataacaggcatgccaccacacctggctgatttttgtatttttagtacagaccgggtttcactaatctataaaccaaatctataattccactaatctataaaccaaatccccaagccagcaccacactgtctttattattgtaatttggtagtaagttttaaattggaaactgtgagtttcacaacttttttgccccaacattttgactattttgtgtcatttgcattctatatgaattttaggattagcttcttttttttatccctccccttcctccccccacaccccgaaggccctagtgtgtgatcttcccctccctgtgcccatatattatcattgttcaactcctacttatgagtgagaacatgcggtgtttggttacctgttcctgtgttagtttgctgagaatgatcgtttccaggattagctttctaattctgcaagaatagccactggtgttgtattgaagctgtatatcaatttgaggagtattgctgttttaacactgtaactcttacaatccataaacactgaatattctttcatttctttgggtctttaaaaatttcttttagcaacattttgcagtttttagagtacaagtcttacacttttgtgtgtatgtgtgtgtaatttattcctaaatattttcttttttatatcattgtaagtaaaaatttttattaattttattttcagattgtttattgctagtgtttttttatattgaagttgtatcttgccatcttgctgaactcatttattaatttgatctttttgtgtgaattccttagaattcctaaatatcagattatgtcatctgagaataggtgttaccaaaacagattatgtcatctgagaataggtgttaccaaaacagattatgtcatctgagaataggtgttaccaacacaggggttcgggctaggtcctgcatcttgcagcacagaaagccaattactgagatgatgattattgccaaggaagaaggctttaatcaggtgctacagtcgaggagatgggagttcagtctcaaaccatctgcctgatagactaaaaattaggagtttgtatagcagggaagaaatgtaactatatatgagaaaacagaaacttagttggggggaggtaaagaagtaatcctgataaatgaggggcctggagtctcattgtctggttgctataatccggtgagtttcagttcttttctactttttgggaggcctgaagatatttttctgaggcaggaactcagataaaacaaatgtaagtttcaagctttaagaccaacagggtcaatttctatgtttatccaaagacgtgtctgtgagagtgttgggttggtttcaaagggatggctttgtttcttccttctaatttcggtacctttgatttaattttctagactattttatctggccagaaccaccaatacagtgtagaatagaagtgggctaaacagatatttatgtgttgttcctaatcttcaaagaatgcatttcatttttcaccattaattattgtgttaactatgagttgttcattgttggcctttgttagggtgaggcaatttgcctctattcttagtttgttgactatacttatcatgaaagggtgccagattttgccaaaatttttttcaatctattgagatggtcttgaggaatttttttcttaattctattgatataatatactatattcattgattttcatattctaaactaatcttgcatacttgataaatcttatttggtcctggtgtataaatttttgtatatatttttggatgatgcagtctgctagtatttttgttgaggatttttacatacatattaataagaaatattgatttatagttttttctgtgatgccttcacatacttttggtatgaaggtatataggactcagacatgaactgggaagtgttcccttctattctatattttggaagtgtttgcgaaggattactgttaattctttaaacatttggtagaattcaccagtgaatctactttggcttgaagtttctgttgtggaaattttttttttattactaatccaatctctttatgtgttttacatatatgctaattttacctttcttcttgaggcagttttgttatttgtgtcttcctaggaatttgcccattttccccagtttatctcacttgtaggcatagaattgtttatattattcctttgtaagcttttttatttgtaattaaaatcctggtagtaatatctagtaatattgctgttaatttctccttttcaaccgtaagtaattagagtattctttctttttctctttgtcaaagtagtgtgttggatagtggccttgaaaaatatatgcccacccagaacctgtgactgtgaagcatttgataaaagagtgtttgcagatataattaaaggattatgaatgagattatcctgtgttatcaaggtacatcctaaatctaatgacaagtgtcattataagagaaaggcagagggtgatttgaaacagacaaaagagaagacttagacaagggtagaagggaaggccatgttaacctgaagcagagattagagttattcatcaacaagccatggaatgcctggggctaccagaagctgaaacaaacaaggaggtatttgtttgtgtacccattaaccaacctctctttattcctctctttgccctatccttccgagcctctgatgaccaccaatctactcctaactacatgaagtgaatatttttagcattatatatgagtgagaacatgtgctatttgtctttatgtgcctggcctattttatttaccataatgtctatttccatccaagtggctgcaaataacaggatttcgttatttttatggctaaataatattccattgtgtgtgtatatatatgaatatatatatatatatatatatatatatatatatatgtcatattttctttatccattcatctgttggtgtacatttaggttgattctatattttggctattgtgaatagtgccgcaatgaacacaggagttcaggtatctctttgatatactgatttcctttattttggttttagaaccattagtgagatttctggatcatactgttgttccattattagttttttgagaaatgtgcatactgttttccatactgtctctattaatttacctccccatcagcagtgttcaagtgttgcccttctcttcatcctcaccaacatttattattttctgtctttttgataatagtcattttaagtggagtgagatgatatttcattgtgatttttgttgttgttgttttgaaacagagcccctctctttcatccaggctggagtgcaatggcgcaatctaggcttactgcaacctctccctcccaggttcaagcaattctcatgtctcagcctcccaaatagctgaggcatgctgcaagcgtgcaccaacatgctggctaatttttgtattttttgtagaaatgaggttttgtcatgttggccaggctggtcttgaagtcctgacctcaagtgatctgcctgcctcagcctaccaaagtgctgggattacaggcaagagccgcctcaaactgccatcattgtgattttgatttgcaattctttgatgataagtgaggttgagtattattttcatatacttgttagctatttgtatgtcttcttttgagaaatttctagtcagatcttttgctcattttaaaatcggagtttttttattgagttgagttccttatttattctggttatttatcttttgtcagatggatatttgcaaatgttttctcccattctgtaagtcgtaatttaattttattgattatttcctttgcagtaaagaagcttttttatttgatccaataacatgtaatttttttgtttgtttctttttgcttttgttatctgtgcttttgaggtcttactaaaaaaatctttgccaagatcaaacttgtccaacccgcagcctatgggccacatgcagctcaggatggctttgaatatggcccagtacaaatttgtaaactttcttaaaacattatgaaatttattggcaatttttgtttagctcatcagctatcttaagtgttagtgtattcaatgtgtggcccaaggtaattcttccaatgtggcctagccaaaagattgtatacctctggattagatcaatgtcctgaaacatttattcagtgttttcttctagtagtttcagagttttaggtcttacatgtaaggtcttacacttaagtctttaatccattatatttgatttttgtatatggtgagagaatgggtctagtttctttcttctgcacatggttatccaattttcccatcaccacttattgaagagactgtactttacctaatgtgtgttcttggtgcctttgtcaaaaatgagttggctataaatgcatggagttatttctgggttctctattctgttcccttggccagtgtgtttgtttttatgccagtactatgttgttttgattactgtcaggttccaacctgagctggggtctgaggggacaggtggcaggtggctaaaagaacactcaagggaccataggcagttgggaaatggtgttattctcttcccctcctatagagtcagctgtgcagttatatttctcacagacaacagtggctcaaagccagatacgagctcacacaaacaggttacattaaatggctacaaatgtgattacatagtgcgcggaattgtgcgcctgcactacaaacccactgtgtcatgctgtaccagatgtctgcctcagccttctcctgaccaaagcacagccactttccttacgctccaccctctaggctaagggagttctcctagcagggagacatgcccacagggcagaaacctggacacagaggccacagcagcaatacagggagcaacaactcactactagtattcctgctatgctgcccatgattattagggtccagcataggccagagcccagagacacccaccatgtctatggggggtcatcagtaaggctgtcagctgccttgatttcctgggaaactccttgcaaagctgctatgttttgttgattgtcagggatgaaggtacaacattgcattcccaaaacagcacagatgccaccttgggcagcaatcaatatgtaggcctatcaggttctgcactaccactttcctggtttgatcaacatcatctgtcaacagaaggaggacaacttgggtgtaattcaagtctcaagtgttatgctctggaagggccataacttgcatttctacagttacgacacctgctccagggatggttaatgctaagaggtagagccaccagggggctcatcacacttgcaaaaaccaggaacgtagcaccttccagttatgtgggcatctaaggaatgtggaaataactgtggcaagcacataaggccacccccaggtagagcggccaatcctgtttgctggcaaatatgaccatactgtgtctccacagtcccataaactcccagggggcacaaagtcctctggggcccagccttgatgtggtcacctattccatcacacctttggtgtggtgataacatattatatgtgttcagactatggcagacaaccaccccacggtgacattaccccagtgttgctctacacatcatgatacctgtgttaggggcaccttgtgttctcccactaacgagccccatccatcacagacattacaggtcagccaggaagcaagcatgccatgggttttgtggcatcccctatccaaagctgcccatgttgcattctaaacgtcagccatggaactcctagtgtccatccatgtccagttttccacagaagctggatgtatgtgccagggcaagacatcccctgctgctgcttgaagggtggtgcagatccaacggttggacacattggtcaactcatcgtaggtgtgggaccattccacaatgctgttggagcatgtcaacctatggtctaaatgacaaagtaggcacaggtactaacaggggtaaatcatgcccttcaggcaaaatacaggccaagctttcatctctagataacaatgcaactgcaaaggacttctgccctgggtgatggtaccacaacttttcagcaccccatggttcctttgggtctatatcttgccagagttactggggagctcataataggccacacaggaaatacagatgttccctggagacttccttccctggccattcccctatgaatggtcaatcatagaggccatatattaagtacccaatgagtgacatgtaaatcatactataggctctccctgcaagggactatgatagccaaccatacgtcatggtggacttggagggtctgtggccaaagccaggttttttgttcccctgcctttacagacattggggcaggcaacaacagattaccattgtccccatacctggttggaggaagtcatctttggtgtgcatctgtaagtggatggggtcagtggcacagtgtagcagtgcctctactggggcctggctgccttttcatggccgctcattcaagctttggagcaccaggtccaaccttgaactctagccccacaaagaggtggagtaacatgcaaatgtaacttatttttcaggagtcccttatatcactcaataataccagtagtttgtgggttatatggaacctccactttatgtccatccattgtgcccactgttgtacgtgctatccaggaaaatgtgttcccctatcacattcaacagtcaggggatgactgtatagggcacacaagtgttgcagggcctgaattgtatgttgttggttggccatcctgcaagggtaggcaaacagcagactggtggccgtgtctacagctgtcagcacatgcatatgcccctgcaacctcagcagtgacctgatgtagtctatttgccatctagtcaagagcatccaccctactgtcacttgttgtgtaacattgggcagctgtctctgtctggggtatgtctgtgtccacgctgggcatttctggcagacctcccagatatcttacatagacaaagatagaccatagcacttattgacctattccattagtttactcccgacgtggcccaatttctgctgcagccatagagctacatctcgtgtaggtgctgactccaaccaccggacctggccaaggcatttgcctcatcattgcccagggcagtgaaaggcacatgtcctgacacatgataaatagttacaacctttcgatggcccatttcccataggtctggccacatggcctggccccaaatgggcctgtgaccaactagctaattctgtaactttcaggtagttaaccacaaggttagggcttaataaactgcccagctaccagtgaagattaccataggtgtctcctccttagtgatcaccatccacagtgccctgagttcaacctattgactactttgtccaggtattaaaccatatggtatcagtactaggctggaccatgacagcagtccaggcagcagtagcaccctggctggacccatcctgtctaccatgcctcatcaggaatgggaggtgcctctcttgaaatggtaatggctcagtgtttaggggcgcctcaggctgacccatggccttatcttgcatcaggactacaggtcccaagacttcttataattctgctgataaggggcttgtactcagggtactctgctgttctaagtaggagccccactttgctaaggtggatatctctgccatcccagtctggggttcattacccatgaacatacttgctccccaactattgggtaagttgtccacacaatgactgtagcccttcctgtcacactctcacaagcctgaagggtggcatatacagttgttaattccttctctatccatgaatagcagagctcacctccattccaaagttgggaccaaaagcctacttgtgttctacagtgctctctgcactgccataggccccagccaaaaccttctgtggtcacatgcacatcaagttcaaatgggtgccccaggtcaattacttgtagcacctgcacttgctgtatggcccatttggctgccagaaaagccatctcagcctcattgtcccaatcccaagtaattcctgtttttgtcaactgatacaatggttttgttttctgagccaaatggagcacaaatgctttccaatatcccaagaggctcacaaaagtctctagttgcctcattattgtggtctggggatatgcctgaattttattaatgatggcctctggtatggcgttcgtcttacccaaccagataactcccaaaactttggcagacaatccaggcctttggaccttgttttcattcacagccaaactgcatgctgccaaatgttgctgtaggaggggtgccgctatttctaaatctgcaagagaatcagaggttaacataatatcatccatataatggaaaaggtggaccccctttatgacatatggtgggtttatgcacacagccctgcagcaacaccgtgaaagtctattgtcgccctttccatgtgaagacaaactgttcctggctctctggtgtgatgtcaattgggaagaatgtatgggccaagtccatcacacagtggtactgtcccaattccatcatcaagtgatccatcaaatccgtgatagacagcacagctgcatgtgaagggggtgttactttatttagttctcgaacatccaccatcatcttccaagttccgtcaggctttctgactggccataccagagaattgtagggtttgtgcattccatgcactatctgcacctcctctaacatcttactagtctcagttatcgccatatggccacctggaaagtggtattgatgggtggaagtaacctgtcggggttgtggcaggacctggggccagtgatacgtatgtccacccgataatggctcaaccacatgtatttggagtctgaattctctgaccgtggcttgtaaaaccaagctgtgaaaaatatctaccctggaatgtattcaagtatggaggagatatacacagtttataagcatgcagccaagtgcctgaggccaaggtgcaaagatgcaggcttcactcccactgactggcctctgtctatgtatgcaaccttgcctggaaacttatccgggttcccatagatgaggctacaatctgtgccaatgtctaccagcagcagcacctgctgtacattggtgggagaccagtggactgccaattccacatgtggcctcctgttgtctggtgtccccccaagctgggcaccttgaccagtttcctaatcaaacacaaaacgctctataccttcacccatctgcaagtagtccttgagctggagcatctgggtgggacatggtcaagcagcatcatcccgcccgctgttgggcattttctggaattggtgattcagggacaattgcctccacaaagttaacagcacttcattgggttgcctctcagttttctctcggtcaaccccagccaaaatcaaaccaatccacatatgtgtatgagtcaccactggggcccttttgtcccatgagatggccccctgcagaaggagtaccttccccctttttatggcatagactcctctgcttccccgagggctgccatggcagtagtcacctcatgtatgcagcaccctgcacacagattgacagtggccagggagccaaaggcactcaggggtgcagagcacaacacaaggtccctcatgtgggaggtaaggtgttcatcatctggccctcgggtattcggatcaaacatagcctgctgcatacccatctcctgaattacctgcaccacatctgtttatgactgccatttactcacagtttctggtatttctctggcatagtcccacaccatttgcatggcctccatcagccattcaattatggtgtggttgccttgcccctgtgctaaccacttgctcacctgcaattgctgatggagggagggatgagtcataatggaggccaacttttccatctcagaggaggagcagacaatactgttggctccctcatcccaaaggcgaagcatctaggtgggtaggatttcccccaagcgctgccagcactgtttactttattcccacaactccgttggggtataggcagtgtatgacttgtgctccatcatggtaggaggtctctgagcccacccctggggcctcaatgacttcctggtgtattttctgatgagccactgggggagcccacaacagaggttcttcctcctcggtgtcagatcgggcaggggtctctgactggggtggcaggcccaagcctacactaatagcagcctctaattctcactccaacctgtgtacgtcggccttcaggctctctgcttgtgcctggaggtcccttacctgtgctgcatcctgcagggactgagcatgcacttcccatagcacagtcaaaaatgcccatccaattctgctgggaaaggcacactccttctcagtgctctgtgcttccaggtgcttcagtgccttatccatgcacacaggggacctgtccaccaccacccatgtctccaccagggcccatcttagcagcatggctgtcactgggtaccataacccatattggggccacacggctgacctaggatcatcaggggccaagggctcactcacctcggaatcctgctgactacaccaattgtcaagttccagttcccagactaagctggggtctgaggggagctggtgaacaggtggcaggcagctgaaaaacactcaagggaccacaggcagttgggacatggctttattctctccccctcctacagagtcagcagtgcagttatatttctcatagacaacagtagttcaaggccagatatgaactcaaacaggttacattaaatggctacataaatgtgattatatagtgcatgggattgtgtgcctgcactccaaacctgctgtgtcgtgctgtactggatgtctgccttggcctactcatgactaaagcacagccatattcattacaattactagggctttgtagtatactttgaggtcaggtagtgtgatgtttccagctttgccaattgtgctcatggttgctttggctattcagtattgtttgtggtcccatgtacattttagggttgctttttctatttctgtgaagaatgtaattggtattttgatagggactgcattccatccttgatcattttagatattttcatcattttaacaatattaattcttgcaatccacagatatgggatatctttccattttagggggtttgttcttcaatttcttttgtcagtataattttatttgtagagatccttcacttttttgtttatatttattcccaggtattttttttttcttgtagctattgtaaatggggttgctttcttgatttctttttcagattgtttgctgttggtgtacataaatgctactgagttttgtatttaatttttgtataataaaactgtactaattttgtttatcagctgtactagttttggggtggtctttaggtttttcttttttctttgtttttgagagggagtctcgctctgtcacccagcctggagtgcagtggcctgatctcggctcactgcaagctccacctcccgggttcacaccattctcctgcctcagcctcctgagtagctgggaccacaggtgcccatcaccatgcccagctaatttttgtattttttttagtagagacagggtttcaccatgttagccaggaaggtcttgatctcctgacctcgtgatccaccctcctcagcctcccaaagtgctgggattacaggcatgtgccactgcacccagccaggtttttcttaatataagattgtgccatctgtgaacaggagtattttgatttcttcattcccagtttggatgatctttatttctttctcaaacctaattgctctggctagtacttacctagtagtatgttgaataaaagtagtgaaagcggttaaccttgttgttccagatctcaaaggaaagggtttcaatttttctccatttagtatgacaatagctatgggtttgtcacgtaaggctttattgttttgaagtatgttccttctataccaagattgttgagagcttttatcctgaaagggtgtattatatcaaatacttttttagcatctatggaaataaacatttttttaaaaattctgttaatatgatgtatcacatttacagatttaaatatgttgaaccatctttgcatcactgggatgaatctcatttgatcatgatgaatgatctttttaatatgttattgaattatgtttgctagtattttgttgagaattttgcattttattcattatgaatattgacctgcactttccttttttgtgttgtccttgcatggatttggtatcagcataattctggcctcataaaatgagtttggaagtatttcatcctcttaaatattttttgaagagtttgagtagaattgttattggttcttctttaaaaatttggtagagttcagcagttctcattaagtcctgggtttttatatgggaggctttttattactgcttcaactgccttattcaatattggtctgttcagatgttctatttcctcatatttcaatcttggtaagttgtatgtacctatgaattttttctttgaatttttttgttgaaggttttctgatttgttggaatatagttgttataatatgctataatcatcctttgtattttgtgatgtcattaaatacaaagctgtaatgtctcctttttcattttttattttatttatttaggtcttcttttttttcttccttagtctacctaaagctttgtcaattttgattatctgtttttaaaaatcaacttttcattttgttgatcttttgtatgtttttagtctcgatttcatttatttattctctgaactttatgatttcttgcctcatactaattttgggtttggtttattcttgcctttccagtttctctacatgtatcattaggcagcttatttgaagctttaccacttttttttatgtagatgttcattgctataaattttccctttagtactgcttttgctgtatcccataggttttggtatgttgtttttacattttctcttgtttcttttttttttcaaattgtcctaactttttcattggcccattggttatttaagagcatgttgcttaattttcatatattcgtagagtttccaaggtttttcttattattgatttatgattttttccattgtggtcggaaaagatatttaatacttgactgttttaaatttgttgagacattgagacatgttttgtggcctaatatattatctaccctacaaagtattccatgtactgatgggaagaatgtgtattatgcagccgttggataaaatcttctttaaaagtcatttaggtccatttgctctataattttgtttaactccaatatttgttcattaattttctgtctggatgatctgtccattactggtagggggttattgatgtcttgtactattattttattgtggtgtatatgtccatttagatctactaatatttgtttaaatatgaggcactgttgtgttgattacctatatatttacaattgttatatcctcttgctgaattgacccttttataattacatagtgatcttctttgtgtctttttacagttttttacttgaagtctatttttatctgatataagtatagctattcctgctttttgtttgtttgtctccatttacttggaaacttttgccatttattcacttttatcctatttgtgtctttataggtgaagtgagtttcttgttagaagtatatagttatataattggatcttttaaaaaatatattcatctaccctctatcttttaattggagaattttccatttacattcaatgttactttttataggtaaggacttactactgccatttggttatttgttttctgatgttttgtaactcctcttggcatttcttccttcttaccatcttccgtttgggtttagtaatttttctctggtagtatgttttgattccttgctttttattttgtgtgtctcttataccatgaagcttataaaaaatcttatagctatataaagctcttttaaacaaacaacaattaactttgataacaaagaaaagatacagaaacaaagaaaactataaaacgatctttgaacttcatccccccagcatattgacctttttgttgtctcagtttggatctttttatatctcttaacaagttctcatagttattatttttaaaaatttgtgttttagtcttcatactatagatatgagtggttttcacattgcaatgacagtgttagagtattctgaatttgtctgtgtacttacttttatctgtgagtctatacattaagatgttgtttaactgcatattagtgtctttttcttttaaactgaaaaattcattttattatttcttttaagaaagggtctggtcttggtgaatttcctcagcttccgttttctgggaaaagctcctcattccttcaggtttgaaggatacttttactgagtatagtatgttttgtttagcaagttttttacttcagtactttttatatatcctttttttaacttcagtactttttatatatcattccattccacctggcctggttttcactgagaatcactgagatttcactgagaaatctgttttcagattgatcagagctcctttttatattatttggttattttctctttccactttaggattctctctttgccttgatatttcactgtttgactattatatgacctgggatagtatcatttgggttgtatttacttagtgatacttgacctttctgtacctggatatatctatttttctctgggtttgcaaagttttctttatttctgtgaatactctttcttctccttgctttctctcaaccccctcttgaaggaaaatgactcttacatttgctctttaaaggctattctctagatctcataggcgttctttgtttctttccattatttttctcctgtgactctattttcaagtagcttgtcttttagttcactgattctttcctctggttgatcagtcctgctgctgagactctctgatgcatttttcatctaattcaatgtattctttagttccaggatttctgtttgatatttttaatgactttaatctatttgttgaatttctgtaataaatttctgaattgcttttctgtgttttctgggagctcatcaaagagttttgttttttttttcttccagtaactcaactcataccatctcattagggtcaatcactagtttctttctttgtacatttgaggtggccacggttgtgttgtttcttatatatgtacatctatattcttgcattgaataattggttatttattgtagtctttgccttctggcttggttagatcttcctggattatatctgcttagaggtgtactgtatagtttacttgttgaattctcttaactttagattgtggccttcttattagcattacatgtcacctcaatcctaggtttgccagggctcttgcaaaagcttggggtgctgcttttctttaatgggatgggtttcccaaatggaatatcccagctatgtgaaaaggctgtctatgggttcatgccaagaggatccatggagtatgcctctcattgtatggtgctgctgaactgcctttctgttttagtatttctgtagagacagcctctaaatttttcacactatggttgcaagcccctctttgattcttggttctagctgtactctactttctttttttcctcctacaggctttcaaaatgcttcccaacacatcttgcattaagacaagaattaacttactgcagaggaatccaagataatagagaagctggctgcctactctgatctcatttttccagtgagacacatatgtgtgaggggaacttttctgcatagtgcttggcatcatgcatacagaaatgtgtttatcttagtgtctgttcacaatttatcatttgtttgtggccctatggattttcacagcctaagttttgagttttgggatattactggtgatagtcttggtgccaaacagttgtttcagttttaattttgtgaaggagagtgatgccaaattgttgctgctccatcattttggtgatatcacccacttttgttgctcttcctattaataaggaatcttaagagcacgctagaatattgaggaacaaagacaatgttaactgctaggcaatatagatttattggatgcccaataactaaataccttgaccccaatgggaatttgtagttcttattgtcagaaaaccactggtcctatggaaaactaagtatgagctgattccctccaaatcatgaggtgtgaggtgggggcaatcgtagctggctcattgtccaagaaatccagagtgaaatcctatgatcacttttagacaattctgtttattgacatatcattaatcattatagattcctatctcaatatgtcagtaaaattgctgtactgggactatataaactattattcaaatgtaagtatataatatactaatgacagcttgaatcaccttctacgatagctgaagtagatcatcataatcttaacaccacattttttttctatgcattgatctatacatgacaactctcatttccactgcaatttcaacatgagagaaaaagtaatgagacagagtagctgtgttctggttagaggcgcagacaaagcagtttcaagagactctttactatcatgggtagcaattaaatgtgcaatggtcaatatggtcagtaatgggggaaaaaagcacatggtgccagattgagccaaccattgtgtacaaccattgtaagaaagagaaatttatctatgtttttctgattcatgcattggtacacacatttacagaccagaatataactctagaaattggcagctattttaatgcttccaatggtctgtttttgttaaatgaaaaaggtaatgcaagaatctattttagttatttaaaataaattttcctcatatggaagttgaatgttttacagcaggatggtctgggaatgggcattttgcggcagtattgaattttcatatgttatagttatgtagcaagtgagttcatcatgtcaggagggagtataagttcatctccttattagtctatgtctgtaatctatacgactattaaagctaatatttctcttgactctgcaactaacccctgaagagaaaaagtcatctggccaaatcccaaaacactcctgaatgcattagggtagattatgaacatgtagatgaaatacaaggtttatgaatctcccctctgttgcctgaaccccctttcccttgccacgcttctttgcttttctgacagtattttattggctataaatgaaattcaaacagtgccccaaaacgaaactccttcgcaaaatctttcttgcagtgaaaataactgtatgcacagtaatttaatcctcttcttcaaaaattgatacatattacagtagtcctcccttatccacggtttcattctcagagttttagttacccatggccaactgcagttcaaatatattaaatggaaaattccagtaaaaacaattcataagttttaaatcctatgctgctctaagcacggtgatgaactctggtgtcatcttgctctgtcccatacagaccataaatcatccctttgttcagtgtatccacactgtacaggccacctgcctgttttcacttggtaagcatcttggttatcagatcaaaggaacgtagtatatatagggttctctactatccatggtttcagatccactgggggtcttggtatgtatcccccacagataacagttgactactgcattaaaattaatccactattaggtaataaaaacttggtgaagaggatcatgagatttaattgtcaggagactcccctgaagaagtgacatttcagctgaaacttgaatgacacttaggtattgatgttggagaagagtaatctagcacaataaaatataaagtgggaaggtggaggtaagtttagcatcagaaaatgtctgatgtggcttgaatgtggaatggacagtgaatgggataagaaggttgacatagcacagatcatggagagactcagggacttgtttggatttaattctgaaagtaactggaagccatcgggagatataggcagttgagtgatataatttaatttgtattttaaaagatcactttggcaggtttgtaaagaaaggattgtctgatgggcattaatggaagcagagaccactccaggaactctggaattagttcaattgatagcacaaaacaacagagaggtggttagcagccatgcagatggagagaactggcctgagttaggatattttggagacatacaaaatgattttgatactatttagcagctgcataatagcccattatatgaatgcgccatgacttatttaaacattggaagaggcgctttcaaatttaagcaatcaagtgtattctgagatctactattaagattcctgcttcccaaattgtcttcatttacatttacccagtaactatctatttaaaacgcataaggtggtaccctggctgtactaaagaataataaatagttccattcacccttgctttttaaactatgacccatttcagttcagttttaatttttgagtaagaattagtataatatatgaaaagcattctgtatgcagttccaatatatattcaagttaccatagaattgaacgttatcatttcatgggatttttgtttttagttttgagtagaacaggcttgaaaaaaatataagaatacctgtaggaatcagatgatatttgataattgaacagctctttggttttaattcaaaattaaactccgaagaataagaataacttaaataaaccaataaagtttggctatgcaattcagagctcaacttaaaaagttacgcatccagtaaatttttcagtaggctgttcatttttatgctaattattaagtttcattctattcattaaaatgttaaactttatcctgagtcacctaaatcttccatgagctctgcatgtagaaaataatttggcagatgcttatttggaggaaattgcttacttcttaatacaacttttttttgagagaggaaaatattagcaaaaaatttttatgtccctaaaaattcaaacattttgatcatgagtaggagcataaacagagtgtatcatatacagttggaataaaaccttagatgcatgcaactcaaatggaatgaatgattccaactcatatgcttgttaggattcaatcaactctcagtcattcactgagttgagttacaagtagaagagagtgggtaatgttaaagacacactgcacaattcttgtttataatatggctttaaaatctagttgggaagacaagaccacatgttggtgcttttgtgatttttgcatgctgttccttctgcatggaatgactttctttaacttcgtggccacacagttgctaattatctttcaatctgtcagtatcacatctgtgaaggttttctttctacattaaacagtttataataatcgttgttatgcttttttggattcacatgtctgcatctctaaacgagcgtgtgttccttcaggaaaatgactatgtcatgtccggagtgcttggtgtaatgtcttatacagtgttggaccatcattaatattgagtattgataatataaggcagtttgctgtgaattctaaatgtctagatctatcgagaagtgtttagggaaatttgtatctctcaagagaacaagatcaccagggcctctaatcctggtattagaattacaatcagggcaaatcctgaaccatttgaggcttgagaagagggaacagatgagggaggaaggatgggttggggaagtcttcaagagtttttcaactctactaatctttggttctacatttcaaagtttgaattttaaaatagctctattacctatataaccattactttgtggtctaaaagtaaaaccataaaatcagcttagcacaacagaatgtactggactgaggcattcacattcagtcaatttttcacagtataactcagaaagaggttaaaaagttctctttgctttttgagaacccattttgtagttcattgttgcagattgtctgatgttgactttcagaagtgaactgaaatgtatgagaaatctggaaatatggtaaagacaaggaatcaaagccaagaagcaaacagacacgcaggggaggatatttaccgcatcgtctcactgagcatacctggaaaactgagaagctggcttttgaatagtgcatatataatcagttctttggtctgtaaattcagtaatcatgaaaccccatgaattagtatcaacatagcagtacatgtcttcattaatattttgtatcattacctctgtagcctctctgaggaattcagggaattttatgggggaaaaaaaaccttaaaacttgaagcaactaaaatttatataaaaatcatacagaatgaatgaataaagtatattaaatatacaagctcttttcttagagacttagaatataaaatgaatacgaacccactttccccaataattagccttgatacacaagtaagcataagcacaatattttttcttgccaatttctacaatgacccaaaacctttaatgaataaaaaagatatatcctaactaattaaataattatagttgacaataactttattaggcaaaaaaatctactaattttcattgtctttttaaatattacagtattcgggcattgttatatatacattataaaatatatatctagatatctagatatattcatatatatatatatatatatatatcttgagataatatgaatgtaacatttcaaattaagatatacacctctgaagagaaaaatgacactcatcaccatggggaaagatagtaatagtagttaatcaacaaatgtgtgctgaattaaattgaatgaatgcaggatcctctaagtggttggtgaaactgttctggactctaagttcatttcctaagctagatactctatagatgacatatactgaacaatttctataatgcaactgcttcttcctaggtcgtctttttacagaatggaggaaatggccttttaattccacaatccactctggtagctataattatattgtttctttttataatgaagtagaaagatatagtacattacaaaaagaataaatttataatctaacaaactatgaactcttaagcaaccaactcttaactggtggaatctggaaagcgcttcttaaataaaaaagaaattctatcctggatgtctccagaaatgagttgtgttactctagcgccctcctacattaatgtaaaaagtagacaatgctgagctccgcagtttttgtgcagtttccagctttcaaagtaccagatagaactctgactccaacactttccatccttatattccccaaaatgtatatggcattttaattatccttcaaaaatcttgacttttctgacccttcatctcttcttagtagaggaacaagagttcaggaacaagtgtggagatgggggtggggtcaaagggaaagaaatgcaaaccagactcttacccaatgattacttcttaaataatatggtctgtaacagaggttgccaagcctttcctatatagaaccaaagagtaaatattttaagctctttaggatataaagtctctgtcacaactactcaactctgctaatgtatcataagagcagacacacacaatacataaatgaatgaatgtggctgtgtttccataaaactttacttactaaacaggtggtagtctgaatttggtctgcaggatatagtttgctgaccatggtttatagcataatctttgagtatagcatacaaaatatcattcagccgatttttttgtaccagaaatttccaaaatcaactgaataatttacttttttttcccttaaattactctacagtaatctctgtggaagaaggtgaactgcatttacaattgcttgaaatagtgagaaaagttacaaaaagaaactacaaatacaaaacaggcaatatctgataaaataaatacactctgtcactatgttaaacaccagaatttttgtatttctatagagaacaccccaactatcagacctttttgaagcattattcgcatttacattcaacaaatatttaacctaatccttataatcatccaccatttttcaaactttggaaatccagatttagaaagataaagcagacctcttaaataggaagtggcaaatctaagatctgaaccttgatcatctgcttccaaatcctgggctggttaagaaaaatattagatttaaaaaaatctaaaatacattcaaaggctttaattccgcctagtgtttttcagtgccagataattttgtaacaggcaattctcagtaattgtaaaacacacaaatgatgactttcactgtttttagtaataagagtaaatcaatgcaattctcagtcattttgcttaatggagcacattgaaaaacaaaagagctatactccctgtttttttctaatattttctgatgaatttcaatagctagactctcaccatactttaaagatcgtcattcttccttaaaagcaaaaggcaatttaatgagatacttgcagtagataaagttgccgtatttgatgtttccatgttttattttctgggagatgacacagaacaatgttgtctgagattgtgaatttccatacagagggatcattgaagcacccgtcgttcataaaacactctgtcatgctggagacaaaactatcaaattttattaaaacttagttatctcaagtcaagctttacatttccaaatagaaatagtgaactgcaatgtgtcagaactctaaatttcattaccacagcaggtgtcattatttggcacataggactagggtttgtgataactacatcatacaactccaaaggaaatagcagaaatgttctttgaaagcactcttctatgtctaagataataccatttttgagcagtccagcctaagaatgaaaaaatatatatagaaatactgaggtaaaggccatgatgattttcatattacccacaattaaagtttgaaattccaggaaagcatttttagatattatagtatcaggaaaatataaggaaagaaaattagctcaagatttccaatctgactttgtgctagcaaataatgttatgcaaaataatatctattattaatatataataatatctattatgttttaaaaaataaaataatatctattataattataatcccataattttttcttatctctggtaaaatatctgctctttatgttatctcaagtcaaattatacagtttagaaatgagtgagagatacttggaatcatctttcctcattcataggcatctcaaggaagaaatcataatagaatgatatctattattttattttgtagtgtttatttttattttataaaatttttccataatttattggggtaccggtagtatttgcttacatgagtaagttctttagtggtggtttgtgggatcctggcgcacccatcacctgagcagtatatactgcaccatctgtgttgtcctttatcccttgctcccttcccacgctttcccccaagtccccaaagtccattggttcattcttatgcttttttgtcctcatagcttagatagaatagccagatataaatttagatggctaaacatttatatatcatcagtaaaatttcggtccaattctcatttctaaaaattttggtactagagagcactctacttttatgattaaaaattttaagaatcttcctttaagacaaaatatgactccttttaatttttctccctggatccaatatccccttattgtataaaagagtgtccatttccttctcatggacaacctttaaaatatttaaataaaactaattttaaccgccaccaaccctcaatcatatcatgtccaaaataacctttccaacctccttaatctatttttttttacaataaggtttattatttccttttatcagtgcagttttggatgtgcaccatttaaaaaataaggtctttctttaaaaatgctcataaagtaaatagaataatacaaatatagtgtcaggaaggcaaattgtttctaatacgtcttttgacctaaatggtgaatgcctattgttaaagcttcagattattaaagtttcaacagcaaccctgtcgaactattggctaattccgataattttcaattaaatcaccaacattatttgtttttaatttgagttattatccagccaccagtctaattgatttcatatttgtgcaactgattttctaatagaaatatagtactttgttgttttctttttctattacatttaattttccttgttcctgtgcctttattcaagttgctgataaaaactctaatctgaaaagtccgagcaaaactctgtggcacattcccagtaagctaaattccagatgggcatcaagcattaatcaatatcccagggcatactattaaacctgttaaaactctaccaaactttttgccattctgctcacaagagtatcatgcgagtttgtcaaatgcctagttgaaacatagactcactatgtcgatggcccatatgaggcccataaagaaaattcagagctcttaaaaagttgctatgaatctgtaatcccataatttttccttatctctggtaaaatatctgctctttatcttacctcaagtcgtaccagagagtttagaaatgggtgagagacatcggggatcatcattcctcattcataggagtctcagggtagaaatcataatgaccatatttcatttttttttctatgtctgtgcccttgtgtgatagtagcatagttgcttgacagcatattgaagagtcttcattactcactgccattttctttcatgtcctagaagtgaaaaaatgttgtttggttccagttgaccacgattgtatctgatcttttcttctgttttatttgtttgtttcctaacagtttatgtttctcaacataaaatactatcgtcgtcatgccagactgctctctaggatcaccttgttttctcaccacaatgccttagaagggagcagagagctcagggtgtcactagtcagcttatatctcatctcatgttatttgaacaataggactctttaggagatataagaacattataaatacaaggtgcaaaatgtatgtaattatgacacctttttaaagtaaaccatagcaaatcacatgaaatagtgctttcttgatacaatattattatcgtttcttctacaaacattatttcagttaaggagagtgtgcaagggctctcctggctacctgagcaagcatttgaaagattcattatatttcctagggttaaaaactattttcctggagtttctaaaaatgagagcctgccataaaattgtgaagtttcatgggaaaagcaaagtaacttttaaacaactgaaatttttaactattttctagaataaaaagtatagaaggtcagtggatcacagctattgttttagctgaaaaaaaaacggaataagttgatcatggttaggtagattataattttattattacttggtaaaattgaattgtttgggccctggtaatcctcggctatttgtgtgtatagattaaagctcctggttctcacttaaccaaactgaaaagcactaattgtcagagaaagaaatgaagtttttttctagtgacttgttttcgaaacaacgccacttacatattttcatgttgtcacatttacatctgagaattattggtggaaaacacaaatggcataactattaaaaatgggtttctaatcataattcaacatgactttgcatcaaatagaaataccaaattgagaaaaggaaatgagtgtttgactaaataaatgtaatgaaatggtagtaaaagagtcaaaaattattctttgcattttctgtcttttcagtttatctatctatctatctatctatctatctatctatctatctatctctctatctatcatctatctatcatcttgatgtattgattcattgattgtggtaggcatgagcttattatgtaaaataagatatgtgcttcagtgacactgtttttgccaagaggtgttgctttgaggccttccatagcagcttcctgggcatctgggcattgatgggcttgcgaatgagctgagttggcagctgcggcactactggttgtagtcttgctagtatgctttcaactgtatccccttgggatatcagctcccttacctcatcagtgcagctctcacccatgataatgtttgtcataaatgtgacacaaatccagtccccatgctgtatctgcttatgttagccaatggagccacacagtggattagaataacgcacaaggacactggaggaagttgttcataagagacaaagagagcatatacagacagtggacatgaaacatttaattgagtgaagcttttttttctgatttgaaaataaatatatgttagggtaaaaaaaccaagcctgtaaaggaaaacagaaaaattggagttaataaagggacccacagcttcactactcaaagaaaactatcgctaaaatttgggttgcatgtaactctttctaatgtgcatatatgtgtatgaacaacatatttgatgatgtgcagtactttatttaaacttttgcctggtacattaggccattcttgcattgctataggaaattcctaagatcgagtaatttataaggaaatgtttaatttgcacacagttcttcatgctttacaggaagtgtggtgctgatatctgctaggcttctagggaggactcaggaagtttacatttatggtggaaggtgaaggaagggcagatgtgtcacatggcagaagcaggagcaagagtgagagtgaggacgtgccacacacatttcaatgactagatcttgtgagaactcactgtcacaaggacagcaccaaggggatggtgctcaaccattcctgagaaatcctcccccatgatccagtgacctccctccaggccccacctccaacactgaggattacaattcaacatgagatttgagtggggatgtacattcaaactgtgtcacctactattgtctgtttcgttcattccaattgtttgatctgataaataattctatagaagacagtgtaggctgaattgttcaaacattttgccatatttcaagttaagttcccagaagttgggtttattaaaatttaaatattttaagactcattacatatatacacaaactacatgataaaagagttatgtcagtttacgttgtgaccatgatacagtggatttaaaactttttattacatttctttttctttagtagagatgaagttttactatattgcccaggctggtctcaaattcctaggctcagtcagttctcccgcctcggcctcccaaagtgctgggattacaggccaccctgcctagccatgatatgatagtcttataataaaaaatccctctcacattttttttagaaaaaaaaatccctcctcttctttacaaaatatgtaatgatttgcctttattttacttgtccaatttctaacacagtccctattaagttagaaagctccacaattggaatcacataataaataatattaactaaatggcttaaaataacacaaggaaccccaagaagagagcttagattttatgtaagtattcagtagtcacctacttgtattccactaaattgtgaactccaaaaacagtgttttttatttaaagataaatttttattcaatacctgttttgtattaggcattttctcattttttgagaatgcaaaggaaagcaagatagaggatttcagctactatgcatgagacagcaaggcaaggggaccagttgaatatcaggctcaatgtcatatgtctggaatttatctttacacagatggtatttgtaagggtatatatagaccaaaaataaggtgagcttggaaattgatgatttcacattaattttctgcatgtcacatttgaggaatggattttactttaagaataaataatctcttgacagcctatgcatcagaatccatgtaggaaatagtgaattagtcatagttcaaagttgatcatctatttatttggatgttaatattaaatcataaaaatacaatattcgacaagtggataatgttattgctgggatgcttgaacaaaatgttcaattattttaaatgttatcaaatcatttaaaattgaaatttggaagttttatttccacaggagtaaaactgaatcatttaatgtgacaatgtccaggacagagtttcttaatcaaaaccctcgttagagaaatttaactccttatattacattttacggcttttgttttaattttatctaccactatagtcaatgataaaatgtgaataaatagaaagaaaaatattgtcattttattgtcttctttctattgatataattaccagagtcttctcaaagagggcattaaaaactctcttagggcactgaaagtcctttttactcggtttgaggtttcttaaaaggagtaaatgaaaaagtagggtagtggcttagagaaatccaccctggagaagacatgaacagaaaaataattacttataaatgggacaagttgatgtaaaatttgtaaagatgggttggagagttttggcaaaaatgtgagctctggaggaagcctgttgggttcaattcctgttctgtgcactgttctttcttttatattgttagttttctcaactgcaaagcagtgtaacacagtcgctatgattgctatgaaggttaaatgaaataagacgtgaagaccatttagcatacagtccaacaaatacaattgagatttataggctcagaagttaccattagtaatattcaagcacctggaaatctcacacttaatattaagaacaaataatgaaataggcctaaagactaagatgagttataattgtattatacttagtgcaataaattagacaaaccaggaatagagagattgttttactcttcaaagccttagaaagctatggctgtcacagaagctgttgaaattagtgaggatattatatgtcagtgggtaggagaggaaatgaaataagactggccacatagtcatcaatggtgtttagagtagccacattgtttcataagaacattcttgtcaacatatgagaactggagggtgaagattaaaaaaagagagagagacagtgatatgcaggatgagctcagttacaccgaatgctgactttatcacactgcagttacagaaaaggaagaaaaggccttagttaaaatataaataatatatcaagaaagcggaagcaaggttcagtgaaataaaacacaaaaatctaagaaaagattaaagggaagtatcttgatattgtgtatttttgaaagggctgggacaaaatgcattttggtgtacactgtaaagaaagataatgctaaaatcatagactaaataaatacatatgaaagtaaatttacacagaaaattagaagtatattttttgtttgttttcttatgcattttttatatggaccagcacagtctatagcatgtggtcccacttatgagaaacttcgtgtttatttgttcaatataaatgttttcaatttttttgtatgttaacaaagaaaaaatatatgaaagtaaaaggaagaaaagaaattactcaacataaattgggagatgattttttgtctctctgtgaagcagataaaatggtcagtatataacttcagtctctgtgtccagagcaggggttcctaacatgaggtcaatactcttgagattaaaatatttggtgtatgagatgatactctagggtgataattcagagctttcatctgattctcaagaacattgatgatccctttccttaaagctcagaaacaagcgatcgggagaaagataagtaaatgtgactaatgcatacatgaggcatgccatttgtatttatggattagcttttagtggtaatggtttagaggaaagcagtgctaagctcacatgggcaggaaagcaggcagcatactgaactggctaatattaaaatgtagggccgggtgcggtggctcatgtctgtaatcccagcactttgggagtctgaggcgggcagttcacgagatcaagagattgagaccatcctggccaacatggtgaaaccccgtctctactaaaaatacaaaaactagctgggcatagtagcacgtgcctgtaatcccagctactcaggaggctgaggcaggagaatttcttgaacccaggaggcagaggttgcagtgagccgagatcgtgccactgcactctagcctggtgacagaatgagactccgtctcaaaacaacaacaacaacaacaacaacaacaacaaatcagatacaaaggcatttctctgcaaaaggggaaattcctcttgtaaaacaaaaggaaactttataatgtactaaaaaatatggcaaagtgacagataaagaaagttgtcttccaaaataagcaatggggaaaggactccctattcaataaatggtgctgggataactggctagccatatgcagaaaattgaaactagaccctttcatttccccttattaaaaaatcaactcaagatggattaaagatgtaaatgtaaaatctaatactataaaagccctggaagataacctaggagataccattctggacataggacctggcaaagatttcatgatggtgacatcaaaagcaatgacagcaaaaacaaaaatggacaaattggacctaattaaactaaagatcttttattcaggggaaaaaaaaagagcaaagtaaacagacaatctacagaatgggagaaaatagttacaaactgtgcatccaacagcagtctaatatccgtaatctataaggggcttaaacaagtttacaggcaaaaaacaacctcattaaaaagtgggcaaaagacatgaacagaattttccaaagaaggcatacacgtggccaaaaggcaaatgaaaaatgctgaacatcactaatcattaaagaaatgcaaatcaaaactacaatgagataccatctcacatcagtcagaatggctattattaaaaagtcaaaaaataacagatgctggtgaggttgtagagaaaagggaatgcttatacactgctagtgggaatgcaaattagttcagctactgtagaaagtagtttgacggtttctcaaaaatttcaaaacagaattaccgttccatccagcaattccattattgcatgtatacccaaaggaatataagtcattctaccataaaggcacacgcacacatatgtgcgtcacaccactattcacactagcaaagacatggaatcaacctaaatgcccatcagcagtggactggataaagaaaatgtggtacacattttatacaccgtggaatactgtgcattcacaaaaaggaatgatcatgtcctttggagcaacaagctagaggccattgtcctaagcgaattgacacaggaacacaaaaccaaataccacatgttctcacttgtcagtgggagctaaacattgagtacatatgagcacaaaaaagggaatgacagagactgggggctacttgaggatggagggagggaggagcataaggatttaaaaactacctatttaggactatgcttattacctgattgacaaaataatctatacaccaaacccctgcgaacaaacaatttacatatgtaacaaacctgtacatgttcccctgaacctaaaataaaagttaaaaaataaagctgtcttccaaaggaaacctatggaagttctatacaaaggcaaagcatatatgaaatatatggtcttctaaatattcatgttaagataatcagtaaatgcctggaagacatagattggcttagaatgttataaaaatgctaataatttatagcttttgttttgttttgtattgaggcggagtctcgctcagttgcccaggctggagtgcaatggcatgatcaaggctgactgcaacctccgcctcccaggttcaagtgattctcctgcctcagcctcccaagtagcgggattacaggcacacacccccacgcccagctaatttttgtatttttagtagagacaggttttcaccatgttggccaggctggtttcgaactcctgacctcagatgatccacccgcttcagcctcccaaagtgctgggattagaggcatgagccaccatgccggccctatagcttgtttaaacaacataaacttcttgagcacatgggggaaagtacgtatgaagaagcagaaagagcactatttagttactgaagtgaaaaataatgaaatatcttggaatcaacttgaacaagatagggggaggtatgttgagaaagtattggcagtttccattaaaaaaagaaaaataaaaattacaatcttggcgataaagagctggaactagggaaaaatatttttaaaatttaaagaagtaatacaatatttacaattcaaaaaagtgaatatttacaatgaggagagaaatgaaaataaattatactttgattccttcttaacatgacaacaaaatctcaagattttcaaatgagaaaataggtaatttaggctttttttgcatggttcttcagaatttatgattgtagtattctacagaatatgctctcaaaatacagggatttcaataaattccatattgcatgattattataaaaatatggaaaagtgtgttgatgggggatgctaaagttctctgcttataattttatgcagcttattattagatttatccacagactagcttcaggctctgaacatttctaacttttttttctttccttcccactttcttctgaaacttggagtgttattgtataggacacaattttatgtgatatgactctcagaatatgacatctagcctcacaaccttatgtcacaacatggggtctgttggcacaacattctgtaagcgtatatttggaactcatttctatatcaaaatagctaacaatagcttaattctatatggaagtaactgcaaacaatttaacttcctcttactaaccgaaactaaatgtacccccacttaacattttgttactcagactctagaaatattatcagacactccaccaccacttgacacaaggaaaaggtcatagagggaattaagagcagaattggccaggcgtggtggatcaggcctgtaatcccagcactttgggaggccgaggcgggcggatcacaaggtcaggagttcgagaccagcctgaccaatgtgctgaaaccccatctctactaaaaaataaaaataaataaaaataaaaataaattagacaagtatggtggtgtgtgcctgtaatcccagctactcaggaggctgagggaggagaattgcttgaacccgggaggcagaggttgcagtgagcagagatcgcaccactgcactccagcttaggcgactgagggagagggagaccctgtctcaaaaaaaaaaaaaaaaaaaaaaaaaaaagctgaatcatacagccctctgaatcagttgcacttttctagaaattttgcaaaaattttatgaaaaacaaatgaccaagtgaacacctagtttcatacccaggactttaaaggtggtctatgcaagtgggaaatttgaagctcaaacattgtatatgcccacataaatctacctataggctaatgtctatttgtggataagggaatttagaaagactatccaaaaagttaaccatattatagaaaagatgaagataaagcaaccaagggaaaaacactggaaatataaacattatgagatgtaaagaaactttattttaacattagtcaatatgtccacttgtgtattgctgaagggagaactagagtcttaaagaaaaagtgattgttcctgatagaacaataatttattgcaaagtacacagtcttataaacactaccctttgctggaacatgataagatttgtgttcatggttcttcatattcactcttgctccagagtcaatcttgaaataaaaataagataattccagttcattttcagagtcctctcagtccatctgtgtcatttccctgtccctgaccccatctctggatcccattgctgttatgattccaagtggatgggagaccatcttcttggctttatgttgggcaagtttgcatgtaatattcagttttgtttgctctctctctactctgtttcaacccaagattgcaagctgtatttcttaacaattatttattaattatagataaaatactagatgttattggcaataacataagagtaacataaatattaaagttaagttagaaaagcattgaattaaaaatagtctatgtaaaattccaatcttgttaggaaaatcaggcctaaaacaaagttctacaaatgagtcctctgtcattttagatggtataagttaatttataatggaagtttgcattttatcagaggataatcaaatgactgacttgctgcatttgaaagccttctgatactaaaacagtctgtataggagaaaaatgggggaaagaaggacttcctggtgagagtaaaaatatagaattcaagcctacaaataaaattgaacttgatttttttctgtggatactttctcgtattctgggttaattttctttataatattttgaaaggaagtaaaatatgcagagtgccaaagacagcaacagaaacctcccatactcctgaggctttaggaacacctgtcatgaaagtgggtttggctgacgtaggaataacagtgatacaatatgagtgccttttatttttgacagtctctgcgtttatcaattgcaaatgtacggtgtatacagccagcaatttgtcaaagagtgttgtagaaatatgtctgacccacataaaaagaccctatgcgtagaaaagttttgtttatctgaactgtatgctcagtaatctaacggggaaataagaacaacaggtttctaatctttcttggccactgagaaaaggggcttcatatgttgtaaaatgcagttacatgctatctaaagtaataataaagattgttttcagtcctactcttaacttcctacaatttagacattaccagtagaattcttttctaaagttcctacgaagtcaatacctcctgtctgtctattgcatgctttacactcaggactagagtctaaatccaagctgagcaatttattgccattatgattttaggcaattagaattaaggttttcttccatagctcataaacaaaaatagtatcacttaatgattaggcataaaattgctgagatgtaatataagagaaatattttgcatgcatcctaaaattctatagttaatgtacacacacgctcatacacaattaggcgtgccatgtccatcttttctaataaaatgtagttttaatttttaaaaatgatacaatgtactttacctaacatgtatattttatatatatattatatatatatgatatatatcatatataatatattatattatatcatatataatatattatattatatcatatatcatatatatgatattatatcatatatcatatatatgatattatatcatatatattatatcatatatcatatatatgatattatatcatatatattatatattatattatataatgtatattatatatgatattatatcatatatattatatattatataatgcatattatatatgatattatataatgtatattatatatgatataatatatgatatatatattatatatgatataatatatgatatatatattatatacatggtcatggtaggttttcacgacaggcatgacactcaaatctcttaaaataatttttacttctttttaagtaatcaatcaacatttgtttatttaaactttaaactttctaattcgtattttttaaattaattgtaattgacaattgtataaatttatgggttgcaatgtgatttttttcaacttttgttttagatacaagggctacatattcatgtttgttacaagagtatatcgtgtgatgctgaggtttggggtacaattgaacctttcatccaggtagtgagtatggtacccaaaggatacttttctaaccctttccccctcccttgctgtccccacttgtagttcccattgtctattgttcccgtatttatgtccaaaaagtatgtgttaaaaaacggttcatctcacattgactgtattccctactttatgatcattcagtgtagatggatggagtttccttgatggtggcatttaattatgcttacaaagaaatgtgatgaaaattcaggttaaaagagaaaatatatgaaaggaattttcttcatcaggaacttcagcaaggtaagtattgtgctgcaacagcatgcaatcatccaatatccacgtttattttctcctttctccctcattctacaataatgagaaaaaagcagacacatgtgattcctaatccaatttaaagttttgccacctgatggtagattgttatttttgaaccacatttagcaaaggacagcaaattgcactcagaattacacaatattcactggaatctgtatctttcattctaagtcgtttttctttctgcaattgttcacttgttagaagcaatatctgccactacttatatacatagaagagagcagctgagagtaagcattagttccacatcattaatatgagtattaataataataaaggaaaccctttccaaatggggatttatgtttgagaattcagtattttagtccaaaggaagaaaaacaggaaagtttttgggcaggcttttctctacatttttaatgatgcattgggggagggtgaggcaataagagacacagagaagcaggtggaagggaagtaaggagggatgagaaaagcagagtactgactgttgactgctcactgctgcctcccccatgttccccccccaccaccatttttaaagactcatcatttgtagctttatggaaaagaaactaatgcatctagagcagaaaaaaataaataatgtacttgtatcacttgtttattgctgtgtgataaaacactccaagacatctctagtcacgttgcgtgaagggtcaaggacacacagggtcacattcattagacgctgtgattgtgaaaacgtaccacagataatatatttccccaaaatattaataaatgcaaaagagaatcatcaatatttttaatttgagaaaactctgtatttgcaaatagttcaaaagcatattttaatcaaataattatactagaacttaaccattaaaataatcccaaatatgaaattagctgtttttcaatagtgaatcttgtgtaaggtagaaagacatttatatttgaacggttaaaattattaccacaagtcccctaatgtttcataacctaaggcatggatttggggagaaaatcaacaatttatagtgctaggcaagccaacaatgatacagtagtaagttttgatagataagaaattttgttggattctgaaatatacatgacaatatctgtatcctatcaactttatgaatgtgtcctatttggagggagaaaaggtatttaggagataaatctgacacagaattactgtctattattataaatgttaaattaaaaaaagttttcaaaataagtatctgagaaaaatgaaattaatgcctattttaaaacattaaaatacctacattttaatctcctaaacatataatttctttctttattctggcaacatccttatttacttactaagtttgtatcaatgttaaagccttcaattaaaaaaaagtaaaattgtaaaaagagcctgtcatcatgcgagtcacagtctagtagagtcaggaaagtaaattagtaaaatatgtcacgtcagatggtgaacgccaaggagacaacacaagaaagggaggtgggaagctcttctggtggggaggccttgcgattttaagttgggtggtatgggaagatgtcactgagtagatggtatttaaataaaggactaaacaactgaaaaactaagccttattgttccctgggacagtgagcatttcaggcagagttggaagagcaaatgcaagtaagtgcctgaggtaggcattcattggccaggtttgagctataacaggccagtaagacttgggttgagttacgtgggggatattagcagcagatgacactggggagagagcaggcatagaggtaggtagattgaatgaaactacaatggctaggtaagtctttataagaattttggctgtcatgtgattgatgtgagacgctatggaagggatttgaacacaggaataacataatctgatttacatttgaaaaggattattctagtactatattgaaaatagatggtgagtcagaaaagaaaggaagaaatatccaagccagttaggaggctattagagtaatcatatgagagaccatggtagcctatgccacagtaatcgcaacaaaggtgatgagaagtaatctggttttggaaatatttacaaggtttggaaggaagagctaataggattatccagtatcttggatatgggctatattaatcaactttaatttatgtggccatgacaaacaacctcaagtctttccccaaatgtcagtaatttacaacaatgagcattgatttcttgctcaagttacataaagcagctgtgggtctggctctgctcacctgaaggtcagcctggagctgcttgacttgtgctcatgtttaccatgcatcctagaatccaggctgtaggagcagtttctatcacataaatgctctattcatggcacagggaggggtgccatagccacagtgggcaatcttcttaaaagtcctgtggagttaaggcataagtcacacctggttacattctgctgccccaagcaatgtggccaagcccatgtggctgggtggggacaaacacttctcctacgggaggtctctcaggtctctttatctgacagagaagggagcaagcatttggcaagcacaacacaatcttcaacattgcagacaacagaaatcaaggcttttctcctaacaaactagaaaaatgaagtcactgtccaccgagatgggaaagacaacaggtagaataagtttaaaagcagacaaaaaattgatgataatatgaaactgtgatgtgatattggaattattttaaacattatcataaaaatttattataaaatgtagaaaatctaagttatcaaaagtctgatcagttgtacaagtgacatgaaataaggtactaggtcattttcatttgaagtgaaataaccacccaattcagaacaattaacagggggtaatgaaaatacctgtattcatacacgtagcccattttaaagtcatataattattattcacagatcatcagctacatttaagggatggtgatattcaagctgtcttgtatttcacatctctaagtgtcataaatatttccctttactatagaaaaagcaaaccagtatcaaatcgacacagaatgattatcaacgtatatatcccttgtgtagatgtagtattctgcaacccctgtgtaagtcctttttcacaacgctatatcatgcttcttacagcacttaagctgctggtacatgggtttctgaagaatgaggaagggttaatcagcttttggcagagatcagcaaaatttgcaagcattttagcctctccatcaagactcataaaatattttggaaactacaggacaaaaaaccaacccatccaagcagaaaattaaaaagcaatctgccagttcaatggaattcaacctttgctaggctgcaaatgatggtaaaatggttaaatattcattcatgattacccagagacataaagctacggtagaaacatgaaaaaaaaaatacatagactatgggcaggtgggaaagaaaacaggactaaattgtgcatcttatggagcagtgctgtttgttttcttttaacctgatttctatcaagatgctgaagaactgtagatttagataagatgaggaagaagagggggatcatctctccaactcctggtttaaaagggacactcttttttctttttgcattgaatttttgcctaaaatttccttttattatagacgtgttctctttttcttgcttgagagtaaaatattccacaaagtcaccaatcatgaaagtcaagaaatgtttgttgtattgactgttaatttcctaaaagaaaaacaaaacaacagcaatagttgaataagggaagactgagtttattaagcctgtcatggtaaagaagagcacacctggacaaaggagtgccttgaaaagggaagtcagaggagggtgtttacacaggtgcagcttctgggctgagtgatttttaaggcgtcttgcaagacagagcactggataaggccaggcagagtttagaacttaatagctttggattggtgagcacagtgtggcaagagtgttaaagtgattacatgagcaaggtcttaatcttgacagctaagctgtttacttggttcatggccttatattccagaagcaagcagttaaattatctttattggattcagtattgtttaatatagggtcagagaatggtgtccgtttcaatgttctgttgagagtttacctatcttgtgaagttttgggagaaaacttcaaccaagtttagagatatctgctccatgtcccaaacttcccagataagggagattactctggtatcattctctgccagacatcacatcaagaaataacagaagctgaaactggaattacattataatccataaaaggctgataacagaaagaagtattacaatgaccctgtcttcttcagaagatccaataaaaaggctatgcaagactgcagaagttactacctctaatttcttggcttccatacatatcattttatttcttttctggcctatgagtcccaaaatgtggcatagatattgactccaaagagaggaagtgattaaaatctacccccattggttagaagctggccattaccaatactcctggtatagcataaaaatgcctcaaacaatacggcatgcagtactgctctttgagggctagtgccaattaagggaacttgcatacttctgtttcttttatttttaacttactgttagaaaaatgttaactaaatttttgaggggaaatgttgtcattacagaatgcgtgtttcattatgcatatcctattggtgaataatttgcaaatcctcatttgacctaaggagtgtttgattgtcaagctttatatccccaaattgccatcaagcagataacttgtctctatcatttttatttttgatagcaatttttctgactctaagaaacctataaagcataattgttctaaaatatctccactattaatccttttagtctcattttttcagaacatactgaaacagaaatagtctgtcacctctgcctccacctgcttttcttcttcctccttgtacttcagagctaaggaatgaatacagaatttattctctcaggagagtgaaacaattgatccagtaattgccatgtcaagggttttggtgagagaagtattctaaaatcacaatataatgcaagtctcataaaggatttcctaaacagtatgttgctctccctactgaataaaatatacctcatcctacatttcctccttgaggtctaataaggagagacctatctggtctatggatttaacactctaagataatttactttggacaaagatctttggagaagcttcattatattttgaagtcattaacatgactcaagaaagtccccaattaaatgaagatgagtcatatgacagtaggcaactgtagatagtctctgcccctacattttgcctctgtagaaatattctttacattcatgggcttccataggcctgatgttttcctatttttgttgttattctgcttcattactgcaaatgtcagacctttaagagtgaggttattaaacagcaaaacacagagcaataggcatttgtaaaagatatatatccagggaagatgctgctctcccactgccagccatacaagctgaggcttccttctcatcactgaagaagacaaggagacaagaagcacattatgtcataaaggcaataggaatcttgcaagtaaccttttcaccagaaaacctctcatttgccctgccttgcatgtactgttcttgaatgatttattgccaaaatattcttgaatttcccatattgttaatttaatgttcttagtaacaaaaactaaccgtgggattgatataacagaaaattccagtcacctcagggcagaaattattattttaatctagccatgaaaataaacattttttttcaggaaactcaagtccttaaaaatgaggtgaagtgtgtctaccacaaagtgtcggcaagccagggaaagtcaggcagggtgttcaaggaaattaaacacatccagcttcttttttctactgtcttcttgtttagttcttctaaaaatcagttttgatggggagctctggcaaatgtttgtgttccgttagtttaatgtgatagaggaaaaaacattctggctggcagctaggctataaggggagtgctgagatttgaaacagaaaccacaatttataaaacgactgcaataagacttgtaaaacacataaattatagcaaaccacacaagaatcacagatgatctaagaatatactctttaacaccagctcatttagatctacatgttccaaggtaagaacacaaataaactaatctggcagaaaccatctagacttgtgttctaaagacaactgttccagtaaatcctctttatttgaaaattcagaccaatccctgctaaggccatcttatcaggtaattttggcccctaaactctaaaggtatccttccctgactctctcctttagagacccccccttacttcctgtgatatgcattctccctgtcaagcattttaataagtctgactttaactgtaatggtgttggttgctcttagctggaaggctttaacttaaaataccaggaagattagagagataactataagtaaaaatcatctaggttatgataaataagctgttgaattacatgacttgtttctaggatttttctctaaacatgtattaagtcaaactttctccaatttggagtgaagttaatgatatcttttaaagcttctctatagaagcagagagtagaatggtgattaccaaaggctgggaagaggggatgggagttggggagatgttggtcaaaggatacaaaatttcagtcaaataagaagaataaattcaagaaatgtattgtaccacatgatgactatagttaataataatgtagtattcttgaaaatggttgagtagattttaaatgttcttgccacaaaaaatgataaaactatgtcagataatgcaatgttaattacccaaatgcaaccattgcactatacatatacatatataaacatcatattgcacttaataaattttttttatttaaataagtaaataattttttaagaaaaactctccaggtgattctaatgttcaaccaaatatgagaaagtataagttaaaatattaacacctttcaataaaacattttttaaattacatgatgaattacatatataaaatggataggtccatggtgagtgactttgacatacataaacctcagtcaaggtataccccatacccaagaacattccctcattcccctttccattcagccccctcccataagtaaggattgtttttctagcaccatagattagttttgcctgttcttgaccttcatgtgagtgaaatcacacaccagagcggttgttaaagatgactgacatgagatccaaaaatgtcaacctagaatgaaagggcttcagctttgagaagctcttcagatacatttcactgtaataccctaattttccacttgagatcaacaagatcacacagctagttgatggcatagttgtgaacaaattcattgtttcctaaaccctctttactgatattccttctgtcattcatcaacatgttgataagtagcaactaaactataaacttcaaaatatatctaaaacctcaatttttactgcttctcctttagttcaggcctgatgaactacttaactaaactttccagacaaacttccagactggtctctgtctttagattcttacttatttattcattcattaaaaaaccactccttgggaattcatagtctaatgaacctcattttgcagtccactcctgactttattacacagatctgattatgaagtcttcattggttttaattatcagggttacaaatatgtgggctgctgactaaaggcaatccacagagctgatttttccttctcataaaattagtttaaaaattaaattacttgctaataattaaaactgggacaattctgagtgataatttagtaccctgagttttcttgaaacataagaatgtctaataacacagagttctcacttttcttctgtaatcactggaaactgaggagtgaatatgttctttagtttattacagctgcaacaagtgactcactgtgtttctgacaatgtggccacatgcagccacacttcatttatctgtcaccttcttacctatttaggcattttacattttcaccctagttttctgagatgaagtctaaattctttgtccaggcaagtgaggcctttgcctttaacagcacactttccgctacatcttactgaattatatccagcctaaaacagttgttcttccctgagtaacaaaatatgaatgataacactattttgattggaaatctaacaattttgcttttcttctcttttttcccccatagaaataaggaatagttgtattttcccttacttcttgggatggcatcctcacccccatgaggaaagataactaggatctcagttgattaggctttaaagttaataggaaattagagtctatatttaaagaacaagaaaagcagggcctttatcacaagaagcagagtgccttgaaggagttgatattaagcaggttgtgtttcttttgcctgctgagccgggctctagtagaccaatagtgaaaatgtggttcttgctaaggaagattgcaaaccagtctcagagacggataagtcactagatagtgttgacagtataggaatcatcacagggtactcttgtagcataggagggagtagtatatactagaggacctgccatctggactagaggaagttatttctaagtgtctgaaacttaggcctgaagagctagtacatatatgagtaagcaaagcaaaaaggtgtttaggcaggggaaatctcaaagataaatggatagctcaccaattcaaggtatctttggggtagtttaccatagtcacagagaagctcaggtaggagggagtatggaaagtcaatgattaggggatttggagaaaaattgagtggaacagaggtagaggatgaaatcattagcccttgcattttattcagtgtaattttccttctttcctgagggagtgggagttatcaaaatattttttggagaagtgtaggatgacagaattgtaatatcagctaccgtgaactgttcgaagttctctttgtaacacaaaaaaacaaaaactgatttattcatagtttattttttaaaaatactttaaattctgggatacatgtgcagaacgtgcaggtttgttacataggtatacacttgtcacggtggttggctgcacccatcaacccatcatctacattaggtatttctcctaatgctatacctcccctagaccctcaccccccaacatgccctactgtgtgatgttcccctccgtctgtccatgtgttcttattgtccaactcccacttatgagtgagaacacgcggtgtttggttttctgttcctgtgttagtttgctgagaatgatggttgccagcttcatccatgtccctgtgatcattaaaaagtcaggaaacaacagatgctggaaaggatgtggagaaataggaatgcttttacactgctgggagtgtaaattagttcagccattgtggaaagacagtgtggcaattcctcaaggacctagaaccagaaataccatttgacccagcaatcccattactgggtatatacccaaaggattataaatcattctactataaagacacatgcacatgtacggttattgcagcactatttacaatattcagaggttttatggtaatattggtaaacaaatatagcaaatagattttaaaaatgaaaacaatggatcatgatatattccacctcatatgatcagaattcatttagaaatgggcttcagggggcttgtggcattcagagaaggctttatataagaaatggaacatcctcctaaaggaaacatgggtgttgaactacagtgagattgggggtaaaacatttcaagttgaaaagtttgaggccatggtatgtgtatttgtgtgtgtagcttagagggaagactgatgttgggagattctgaaatgtgactgatagctaataattttgaaattgacttggtagaaaatttctgactcttcttaagcaggagagtggcctaatgaaaataatgtttggattattgcgtgtggcattcaagttttctagaatgcaaagattggtattagcaagagctgttggatggatagcaagatacactaccaaataaataatttagaaaatttgaaggtacaaaacaccagtgtaaacaatgtttccagagttgaaacctgaagctcaggtctccaaatcactttccctgtaggaggagtgaggaaatcagttttccttgtaatagagctgcctccccttctattctttctacttggtaccatctaagttatacttggtctcagaaattatcataacaggttgtattactccattctcacactgctgtaagggcacacccaatagtgggtcatttataaaggaaagagatgtaatggactcacagttccacatgaggggaggcctcacaatcatggtagaaggtgaaggaggagcaaaagcacatcttacatggtggcagcaagcagaagtgctgagtgtaagtctcttataaaaccatcagacctcgtaagaactcactcactatcacaagaacagcggcactggggtaactgcacccgtgattcaattacctcccactgggtccctcccatgattatgggaactacaattcaagatgaaatttgggtggagacacagccaaaccatatgagatcattctaacagtaataggtatctctgttgatgtatccacctgaagaagagagggagacaggcaggggagtcgtttaggtcgtaagcacttagtgtgacttttcagccacggtgtaagttcgagtgtgtccaaaggtctgaaagcccaaatttcacaggtgtacagaatgtgtaggtttaccaggacttattctactcccaatggcatctttgttttgcataagagtctggtattcttataattcttttcttttctattattttgagactttaattaagccatagagtgtaactgtaaattcatgtgacctgaaactgtaatttttattatgtttcttcttaatttacacattggaagccattttgttttttaatttttattttttgattttattttattgtggtaagaacccttaagatctatcctcttaaatgtttaaatatataatgcagtagtgctgactacaggcacaatgttactccagacctccctgattttgcacaactgaaatttcatgcctgtttatttataacttaccatccctcttccctcagctcctggaaaccaccattatggtctttgatttggctattttaggtacctcctcccagagaaatcatgcaggatttgtctttctgtgactggcttatttcatttagtataatatcctcaagattcatccacattgcatattgcagaattttctttattttaaatccggatagtattccactgtctgtgtgcgctcatccattaatgaacacttaggttgttttcataccttgggtattgggaatgttgctgtgataaacgtggaagtgctaatatctcttcaagatcctggttttaattattttggataaatgctcacggtggaattactttatcatggttttttttttttaaaggaaccttaatacggtttccgtagcagctgcaccattttgcattcctaccaataccatgcatgggctccatatcctcacagacacttgctgcctactgcatttttttcaacttttattttaagttcaggggtacatgtgtaggtttgttacacaggtaaacttttgtcatgggggtttgtcatacagattatttcatcactcaggtattaaacctggtactcattagttattttccctgactctccctcctcccaccctccactctcttttgaaaggccccagtgtgtgttatttccctctatgtgtccacgtgttttcatcatttcactcccattcataagtgagaacatgtggtatttggttttccatttctgtgttaatttgctaaggataatggccaacgtctccatccacatccctgaaaagggtatgattttgttcttttttatggatgcatagtattccttggtgtatgtgtaccacattttctttatctggtctatcgcagatgggcatttaggttgattccaggtctttgcttttgtgaatagtgctgcaaagaatatacacttttgactcaacaatcccattactgggtatatacccaaaggaacataaatcattccattattaagacacatgtcttttgcttttttcataatcaccatcctgagagaaatgaggtggtgtctcattgtggttttgatgtgcatttccctgatgactagtgacgctaagcaatcttcataggcctttgggcccttgtgtgtcttctttggatgaaagtctggtcaagtccatagctcatttttgttgatgttattataaagttctgttatcattgttgtttttgttagtgagttggagtttcttatatattttggaaattaatcccttatcagatataagatttggaaatattttcccattctctaggttttttttttttttttcgttttgttaattgtttcctttgctgtacagaagctttttagtgtgatatattcccagttgtctatctttggttatgttgtctgtgctttaggtgtcagagtcatgaaattattgccaagacgaatgtcataaaagttttcccatatgttttcatctaggagttttctagtttcaggtcttaatttgggactttaattcattttgaattgatttttgtatgtgtagtataagagtccaatttcctttttttttttttgcatgtggatgttcagttttgtcaacaacatttgttaaagagactatctttacccaatttcctatctttggtatcaagccattttaacaagaattttaacactatacattttctgagagatgcatatgcttaggatgaacagtttaaattactaaattgatagcacatgccagattaagttctgttatgtctttactgtaattctttgatatttttaatatttcaagtacagatacattctaattttgatttaattctgccagagcaaaatgtatcttatttgtttatattgaatcaatattaaggaaatatttacacaaaaatatgatcatatattttaaatatctgtactgtaaggaaaatgcttttatatcttaaaagttattgaaaaccatgggtattattaggaaacattagtcattattttgattaatagtttaggctaagtcacttgaacccctgatggtgcctgtcagattgtggaatacacatatatctatttgcagcctctctgtcataagggctatgacaaaaattattatttaaaaactattttgagtttcacagaaggaggctataatttctataaattcatgtttatgtgactttgaagtagattcaaacaaatgttattaatatcaatttatcctgttaatctagggacacagcacactgatatttcccaagaaagagtaaaagattgaaaggacatcaataggtaaaaccatcatttgctgaaaactctttgccctgagaagcagaagcctgtcaaagtccaacacaaccatatatcaacctccctgtcaaggacatcacacctgcagtagaatcaacactgtaacaggttgaggatgaccttagtgttgtgctattgatttagtctccatgttgttattagtctgatattctaaggttcaatgaatttgatccacataaagtaagtatcaaaaagaaaagcgtggaacctaaaaagctccagtcaaaagcaatcacttccaggttttcaaacataaaaattaaagggattaaacttggattgattaaacttaggggaacgggactagtagatttgataattgtgttatttgaagatcaactgaatttttgcacaaaccttcatggccaatagaaatgagttgtgcccccatgtacctaagggtcaccgatctgcaacctacaagtagggtgacctgatttgcctgagactcttccggtgaccaaactcaactcatcattgacattaaaaggagagcttttaaaatatagatcctatgggcagcaattcagagttacagagtctaaccttatagcagtgaggtccattaatctgttttttttttttttttttttttttttttataaagtacccgagatggttttgataatatgggtgcttgggaaactctcctccgaaaaacatagagttcctgatttggaaatcttgctgcttaaataaaatatgtgtatatgtgcacacatgtgtggtgtctatttttccctttcctttttccaaaatgccaacaattatttccccctgtgtattatgactatagcttgtgcaattacaatgtttgtatgtatcacagttgattctaattaagtattaagacgttttatatactagaccaagaacttatttaagaacttattcctctctttttctgtttgcaatgatcagcatagagcctgtatatagaaggtattccataaataagctaattaataagacaagacacttggaaccattcagatttttaaacctgttccacaggacattgaagagaaatattcaggggatgcttcatgaatgaagtgacacctgaagagaatctggaatacactaaggcccagacagggaggagaggtttataagcaggagggaaaaaataagaataataccatgttgacaggcatgattgcgggaaaatttgtagatggtggaaagtgtgatttggtaacgtaaatattttagattcttcaccaaggggcaataagatggcagtagagtcttagtaaggcacatgtgatcataatgaatatgtttggagtcaagagaagctggtataaggaaattctggtggatgtttacaccatatagtacgaacgtcctgctcagagtcaaatgatttcagtttcaaaatgtgccatgttggtgtgctgcacccaccaactcgtcatttaacattaggtatatctcctaatgctgtcccttccccctccctccaccccacaacaggccccagtgtgtgatgttccccttcctgtgtccatgtgttcttattgttcaattcccacctatgagtgagaacatgtggtgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaacgtaccctaaaacttaaagtataattaaaaaaaagaataagaggccaaaagacactaaaaaaatgaatgaaagaaacccatgccttatctcttgttatataagtagtgttatttattttctggtctatgtatgatttataccgcaggaccacatttgtacagagtccagctcctgagcaagcttttgtggtgggcagcatatgaccataaacaaagcttatttttctccttcttcccatctcttttcttccctcttttccttctccttccatttctccccaccttttcagagaacgagactgcattgattagttctgagttattcagctcatatgatgtaatcattttaatgtatgtgatgagtaagatacaatctcctcaatttcaactacagattgctgacataatgaaaaaaatatatttatatatgtcactggaaatagataaaaaatgcaactgatataagctgggctcatgaagggtcctataatactctgtggaattcacaccattctaacagccatgaagaaatactgaagtattttaagcaaagttgcaactattattatatattcattatagctttatcatgcctaaatactattgtataaagttttcttcccacacgtcagaaacaataagattctgaaaaatattataataaagttattcttctgacaaatgaatcctagagaaaattccccacctgcaacagttccttcctcagttttctctgactcaatacaatttcattcttttcgttttgcagctcaaaaatcttggtgctatcattgtctcttctcagtttctctcttagacctaacgcattaacttcacactactttcaaaatatattctgggttcgatcacttctaaccaaccaaatttaagctaccattggatttttctcacctggattattacggcacacctttaaattcctgtttttgctcctacccacaatatggtagccagaaagatcctgttaatttaagtcagattacagcacttccctcctctaacgactttccttctttctttcctccccctaacgactttccttctctcttagagttaaaatcaaatgcacttattgtaatgtatgagacccctcttggtttgtgcccccattatctccctgccttcatctgttttgactcttcccctctgctctctcctttagtcacatggtccccttgctttatgaacatcctggcattctcccgacattgtacatacatgcaatgcactcagcctgaaaagtctttcctcagataaatgcatgtctgactccctaattcccttcactcccttcctatcttcattccaaaggccactttccagtaaaggcttactttgccgcactgtctaaaattttaccccttctctccaaaactttttcatattcccaattgtactatgttattaatttggtgcaaagtatttgtggtttttgataataattgtgaatattactttctctctactggagagaaagctctttgagacatgtattttagtctcttctgttcactgttatatcccctgatatgtcagtatctgatacataataggtactcagtaaacatttgtcaaatacatgaatatatgaaattatgacaatatttgaaataattctaattatatttgaaatgctagaacatatatttatgtctattcttgaatcataacatagaagaagtctatagaaaactccattcttttatttcttatataatctatatattggattgttcttttgagctctgagaatatcaaattaaaagtactgaagtaaatactaattagtttctatcggtacctttatttgttctgaatgtttctcacttgatgtttagtgttagatatataccaagacaaaattaaataaaatagataagtgtttttcctataattcatcctaattattcacatttaaaatttagaagggactttattagatgcactttttatctatttttagataggaaaggccaatttgcattctcttcaaggaaataattggtattcataaaagttggactaacaatttcatttacatttgaaagaaaattaaaattaatccaatgtaggatattatacaaagattactatgcaaatatatttttaaaagttgctatatcacatagtgaacatttcaatggaacattctaaaaatgttgaggttttgtttcttaaaaaaaaaatacattcatacgtaagtgtgagctcttctcacttccataatagaagtgagaattatgctgtctgcgtactcatgaccggcatagttttccacaagtgctggctttaataggtgaatataaaatgatgtgattttttcttttttactgacatgaacattattattgtgcctttggttgaaataaatacttgaaatgtttgaacacacacacagccccatataaaacagttaaaaagttgttcttttgggcattccatttgttggtcagatatctgtattaacaccgattcatatccctcaagctgatgagaatgcagtgtaactaacgttgaatctaaggccaaaaagtatctacaaacaactggagccttgctggaaccatttgaggccgccttctgacctcctgtctcggcatatagctctgccagtgctttaacttgaactagtgagatctgaagcccctaaaaaaatactcatttttatagcttctaacgacagtatttgtcttttgtgtggaaatcatttttcagcctcaaacccttagattgggttcatgtggatttcaaaataagttgtcttaaaaatattttgctccataataattaaaacccatatcaacacatttttggtaactatttttttgcaatccttcatattaagagaattgtaatactttttttaaaaaattatatgcttagccatttgtatgtctttcctctacaaattcctcaaaagtcccacatatttttttctgaaatctcctctattctctcttagtttgttgtgttatattgtacatggagatgaaggatggtataatgtttaaaagatttttggctttctgaggagtgtttgtttgacttatttgcttttctgcagagcagtggacacagctcacaggctggccgtgctaccagctcttgctattattcactgtaaactcggtgtgcagggtaccgaccacagacagctgcccaggcaggtggtgtgcactgcacagagtctccgaggtaaggcagcgtaagagccagcaagacctttttaacaaaataggcgttagccagggtgaaaatggggaaattgcacatatatagcacttgagtgtccataagttgcatttcacctccttttttctcactgaacctcataatcatcctgagatctacttacgtattatttgtcccattttccaaataaagaaaatggggtaaagagaggttaacttatttgccaaataagagatagtggatgaaatcttgatcctcttactacaggtttcttactcttccctcagcagctcagcctcctctattgctcagcaggcattgtggagtgaatggcacagacctctccattcataagtccctctttcccattttctttctccttcaaagagcactggtacagtcacctgaaaagctaaagatgcagtgtgacaactgctacatcagcaattccagacccaccttcccacaccatctcacccctaccttgaaaagaaacctttgctttagattaacattaattaagtcatgcattagactaacataagactttatctattatctatctaatctaatcttttattctatccatctatctaccatctattatgtatcatctatttactgaattatatatctaatcttctatctcatctatttatcgatttatccatctatatgtaatctactctgtatcatctgtctgtctatctatctatctatctatctatctatctatctatctatctatgcgatatctatcacttttcaacacctaattcacaaaaaagaagccatgagggagattgtagactgtaggagaggtacacttatatatgtaaacatttagagaacaataaaagactacaaaacaatattatgtttaatgaaattaccatccaaaaaacgtgtttgggtgagcaagtggtaccacatctgagggaaagttgattgtgtggtagaaaaacagagcctttggcatcagaaggactgagtacaaaccttggctctgccaattaatattgggtgacctggaagaacatgtctaacttctccaacatacacattttttttcttgtaaaagtgatggttatagactcttctaacagaagtgttacaaagattaagtgattaatgtctgtaaagctgaagctcagtgcctagcatacaatccactctcaaaaaagagagcaggtttccacacctgtaattcttaataaacttcattaaatagcaatgtctaattattttgttacatagcaatattttatcagcaacgtttattggattccaacaaatattctttcaacaaatacacaaagaaatggaatatttcatggttatacttttttctattgtataatgtcagtctttttttttctcaagtagtaattaaaacttgctttgaaaaatactagtgtaacctaaaactactgtattccttaaaagtacttagaataaggagagggcagcaaaacaccacaggaagtataggggattgcatcccagacagacatggtcttggcttctggatctgcctcttggtagctgtgtgactttggatgaattgcttaatctcaccttgttttaagtgagataaaatggggaaaataatatttacctcacagttctgataggaggggtaataacataacgcatgtaaatcatgcagaacagcgtattatgataggtgcctaataactgttaattccccttcttctctttgttttactttcttctacttttctgtccctaatattctgatcataacacctccaggaacaaaagaagaaagacagaaatactaggacagttaagaagatccagtgagaaaaactcatatagagaagacaagattattgaaaattctaatcatttcactgaaactgatgtttccttgaaacaaacattacccataagaatggctgccatggtttatttaggaaacaaagtgtaatatttacaggggcagagaggacagcataagaatgaaaagagttagtgaaatctgacctttggtgagctggcactatttagtaaatctcccttgccttggtgaaagggattggcttccagtacagttaattccacatggaagagaaatataggagctttagccctgagggatattgctctataagcccaggttcttttcagattattctggttgattaaacacacagagaaataacccttttaaagttgtacatatattaagaattggagtaggcatataagcatcaccttacaaccgacaaaacagatttccaagcaacatacaatttaaattaatgcagttgtacgtaataatgattattttccaaatgatctatttgattggtatacatgctttctgactcttctcccaacagtgccatcagctgtaagggaaggattgtggactaaactcactcccgatatttagattatgaaggcaaagaaactatggagaggataagacaggaatttttaaaaggagaggactaagaagacaggggcagtatgtactatattgttaccctcccaggctggaggtgtggaaaactattataaaccgctaatgatcatttttttggtgttcgttattagaaccaatggaaggaaacatagcaggtgaacctcactgtattctctaaggtctttccagaaaagttgtgcctttataattaattctattgtctattagagtatacagttaagtgcatataccaaacttctttggtaaaatgtatagaattaaagactttcagggctgataagaggcccagtaagtcatacaggttagaattctcagaaagttaaaagccttatgagaaatttccattggctcaaatcagatgagaataaaacttgatcctacgtgtcttaatattcagtctaggagacttgccagtacccagtgcttctttattgactgattaaccattttctaactcactaattaggcaaaccagaatatttgtatgctccctgtgtgtgattgtctaggttgcaaattgagctaatttaattttgttgtttacaattgatacatttatttttgatatcctttggtagccttttgttagaggtgagagttatagttttatttcctgatcacactatcatctcatgttaaaatgagggtaaaaacacaacaatcaaattctacaacattttcaaacacttattagcaatgaaacagaaaatgtaatacaatctaccctgtaagtttaattaagtctcaacctttgtgttttttagtactgtgacaaactccgggcatgacagtttcacttagacagacatgacagttttctgttagcaggacctggttaccttgtagctggaatcaggccaaagcatcttctggaagaggttgctcataggacttgtggacattcatagcctgaggcaccggggtgaagagtggaagtgacactctaggtgctgggacatgttgtgcacatgacagaggccccacgtggtatcttagcaagtccacatgttttatgtcactcatgaaacatttcagtaatgagaaatcattgcccctctgcatgatgataatgaaaattttgaaggttattaggaatcagcatagctgatggattataagaacgacatctggcatgtactttttttttaaccactttatttgggtatgattgacatataaaaactttacatatttaatgtatccaactcaacaaagttggagataagtatggacccttgaagccatcaccacaatctgtcataaccctatccatcaacttcaaaagtttccttcttcctttttatttatttattattattatgatttttttgggggggaaataagaacatttaatataagaggtacattcttagcaaatttttaagcacacagcaccgtattgttaactcaaggtggatactgtatctctaagacttattcatcttggaaaaccaaactttgtattctttaactaacactatcttctcccatatctctcctgatcccacccctggcaactaccattccactctctgcttctattaactacttcagattcatcacctaagtggtaccatgtagtatttgttccgtgtctggcttatttcacttagcacaatgtctacaagattcatctctgttgcctgagtgtgggattttgattggcatctcaaatcctgacaatttctgcagtatgtttattgtacgagtttttcaaagatttgccaactgtcccataaaactaatatgcatttaaaataaagtttttaaaaatataacaaacaacaaagtttgagttgggcaggaggaatatattttgagatctactgcacagcaggatgactatagtcaataataacatattgagtatttcaaaataactaagagagtaggtttcaaatacctgaccatcatttcacattgtgtgatatgtatatatacatacacacacacacacatatatatcacattgtaccccataaatgtatataatttatcaattaaaataatattaatttggccaggtgtggtggctcatgcctgtaatcccagcaccttgagaggccgaggtgggcagctcacgaattcaagagatagagactatcctggctaacgtggtgaaacctcgtctgtactaaaaatataaaaattaactgggtgtgttggcgtgtggctgtagtcccagctactcgggaggctgaggcaggagaatcacttgaacccgggagtgcggaggatgcagggagccgagatcacgccactgcactccagcctggcaacagagcaacactctgtctcaaataaataaataaataaaataaaaataaaaagaaacagaaaaatcgaattattttatttcctatgaataaggcatttataaattattgtggaaagtgcctgtataacagaatattttttgaatatcataagtttgatatttatttcaatcatattttggatagatttcagcccattgctaatcatccattctccttgttttatgcaatgtcaaagaccacttcattttgctttggataaataagttttatttgatgaatgctgttgtcatttaaattacatacaaaaaaaatgacacaattacattaaatacatggaaattaaatgcccgtctccttcctacacacccacacacatttacatatctatacctttgtcatgtcatctcttcccacaaattataattttagccattttttctgtatttaaaatgaataattatctttcaccagttaaaacacttttatttgcttgcagaaacgtaatcattttctaataaaatagtagcagacactgcagtaaattctagccagaatttggttattatattaatctcacttcccatcactgaattcctttgcagggtaattagattgctatctgattctatcttgagtccaccaagtcaaggtgcaggcaggtggaaagtgtgttaaataagtgtcctgcttgatgggttctttttaatgccgatgagtttgtgccagtacaaataaaattatataaattactgtcaatcattagaggtttaaaaaagccaggttatttattatgatggtgtatatacatatatgtttatatacatatatatgtgtgtatatatgtatgtgtatatgtgtgtgtatacacgtgtgtgtatatataaatatgtgtgttatatgtgtatatatatgtgtgtatgtgtgtgtgtatatatatatatttggctaagagtttcttataagcatttcatacatggctaattatttctccagctttactatgcacagctatcaacctaagccctactctagctgatcatccctaaattcccttcagaatcctgccatattagagtaggagaaagagatgatacttttgtgtcaagtgagtagagtgagaatatgtcagttttcatatttatagagtgacgtttgacatctttaaagagaagttcctgaccttccctttgtctttttctaaccaagaaaatgtcagccacttccattgcctatctccagccgcatctagtacttctctctattccaaagcttcaacatactcttctgtcattatctgatcatctattggtcttcctctttcatttcaattcaagggaccttgacttatttctcatggttgtcttatcagaacagttcctgatgaaattaatttactgaatgctggaacaattccagccttcattacataaggaattcagtgaaaccttccttaagctcacaactctagtgtcaattatatattataaacacacaatcacaaacatttttaaaaacatgtctgcattataatgtcaaaggtagaaagaaattgcccatcatcgtccaggttgtcttgaccatccttaagagtgccttctacatttcccttccatattttctttaatgatagaaaattgtgtagaagacaatagaagaggaactaccccctctaggtcaataagacttttcaaccacccccaaaggtaatatctaaattgtacaaccagaatttacctgactggccagcatatataaaaggggccattacaaaagtatggcacacaggtcagaatagagatattcttctgaaacaaattacaataaggtcgggtacagtggctcacacctgtaatcccaacactttggaaagccagtgcaggtgaatcacttgagcccaggagttccagaccagcctaggcaacataatgagaccctgtctctccattttttagaaaaaaaaattagcagggcgtggtggcacacacctatagtcctacctacttgggaggctgaggcgggagcgtcgcttgacctagggagttccatgctgaagtgagcagtgattgaaccactgcactcagactgggtgacagagccaaaccttgtctcaaaacaaaaaatgaagaaactccacaaaatcacaatgacctcctcctccacagtcaatgatactagtggtgaaaatgatatgaaattccggcaacttttaaaaataaaatttattcctacaaatttttgttgtcgttgtttattgtttttgagacagtttctggctatgttgcccaggtcataatacagtgatgcaatcatggctcactgcagcatcaacctccccgggctcaagtgatcctctcacttcagcctcctgagtagctggaaccacagtcacacaccaccatattcagctattttttatatttttttagagatggggtttcacaatgttgcccaggctggtctcaaattcctgggctcaagcaatcctcctgccttggcctcccaaactgctgggattacagcatgagccgctgcacccggcccaaaaacatttttgaatctccttaacttgtttctaaatcaccactcttatttccactgaccacttaaacagatgacttgaattagttataaaactgctctggctgtttaatagatttgatataaaatacttttacattataatagatttgttttagatatgagtttttctttttgggaaaatgatattaaaataaattttacttatatttttaaaaaaatttctcattttattgatagggtatgttttaaaaataagattctagtcttccattaattaaaacttgtgctaaaaaattaaaaaggttagcctttcaattttaaataccaaatatagaaaacatacatgttaatttacagaatgtgtacttgataaaccaaacttaaattgagcaaggaacaacatgacgcattttaaggcaaatacataataaatgctaaaatgttgtagcaatattctggctttaaagaaatattgattaaatttattaagactgggctttgtctcaacacttaatggcaactatgatttaaaattaattaaattatgtttaacgctactgtgcatgtccttgaaacctcagtcaaattatatggtcattagctttcatttttatgataatgaaacaaaaaatacagtttccaaaatatatttttcactaaatctatggctaaaattgaatttaaatttctaggtttttttatttaatcaaaaaggaattttacaattcaatcaattgattgaaactaaaacttcaaattagggaggatttaattcaagcctgctattgtatttattattatttaaatataacatgcagacgcctaaactacacagcagacactctattaggttttgtatatatagaatcacacacacatactcccctagtttgtgagaaagtgctctaatattacagacacagattaaagtttagagaaatcaacttgtccaaggttacatagctagttgcacacacagaattttaaatcattcttatgtgactctaaaagaaaatacggaagtgaactgattaactttgcagttaagtttgcaggaataccctgggcaacacagaccctctgtcacagccaaatgttttgtttcgttgttgttccttaaatatgaccaatgctgtcaattctgcaactatattcttgcatttcctcatggctggaaggtctcatttttttttctgtcctttagatattaatcatcctttaaggctaactgagagccacatattcaaagaagacttccaaaccattacactattgaactatcccagcttttacctttctcgtttgggaacttagagactcaacttatggtattattaatactgcctatcctcagaccccagagacaaaacatgctgtctactttctcagtatcctccagagagcatgttatagaaattgacacatagaaatgatctagtcaatatttatttactaccagttgctggtacctggaaacattcttagtagtcttggttttcctggagtcctaatatagtatagtacagccagagacctgtttggttcacagaatttaagtaaacttcttgatcttacggtgtctgctagcatcatgagaacaggcaatgcaatatcttaagaccagttaaaaggaattagttttgagaaaagcttatagaggttacaccactttgcccttcacagaatctttcatttcagccacaaacccacattatcaattccctttataagctgtggatgacttgtcaggaaagatagtaacagtcaaccaataaatggaacattgtctccctaattcattcagagatgtttgcccatggagatactacctggtgatcttgccttacaacatcttgggcccagagatattgctgagattcttgtatttcccctctcatgtccagcattaatgtataagtcaaatacccatattctgtaaattctacacatctaccagtaggcaaggctggagatccaagttcttattatttaatcaactaatcagaaaggaagttctggctgatatttagaagttctgttaacatttcatagaagtaaatgtacaatttcccagaagaaaagtatcttgggaacacagagaccatctacatggacaaaagtaggggctaataatgatatgttacctcttgatattttagagaggcaacattgcttagtgcataagagtcaagacctgtggttgaagtcctgttcaactctgtactctcaatattaccttaggcaaataattaatttctctacacctttatttccttatctgtatctatatctctgtcggttgagttacagagagggtagctatgaccattaaactagatattttctggcacagagtaagtacttaatatacaaattttatatatgtttcatatatcatatataattatatattagagttgtatattatataacaaatatacattatataatgtagtttgcaaataaatattatataatgcaacatgtaatattatatagtatatataatatataaatgtagcatattatttaaaaattaaaaatatgtataaacatatatttagaatagcttacttcaattttatttgaggaactcattttttggctgtccacaacataaggagtaatggattattggtagattttcacagtctgattgtcttttattagatttagatcttctttctttccttctcatttctaactttattcagtttatagtacttagtagtttacaaaatatgtttacatatatcattgaatttgatactcctaagaaccccataagcaaagtatgatctcttattatacatattctatagataagaaactgagcatctagaagttaagtgactgctcaagatcacgtggctaggagtttacccaaagcctaaacttaggtcttctgatttctaatctagtgtttctcctactataatatttcagtctgctttttcctttcactctaaggcttattattttcactaaattcaaattgccttttctgctttgttaaatactagagttagacatttgtaaagttaaacacacacacacatacacacacacacacacgacattaagggcaagatatatacttccaaggtttctgagaggtacagcttatacaaggaaaatcttttgtaagaaattgtatagatctacttattcatgtgctgagtacacattttcaattttgactattggtataatttagagaaattcaattaaaaagaaaaaaataagtactcctctttaggcatttattctgttcacctgaaagtatattcatagccattttttttttgttaatgttaaataacagatccctttccagggatcctttccagggatccgttaagtgcagtccatgttagagttaatgaaatagtaccacagtttcagagataataaatatatgggggtaaggaactcacattgctacgcttttttattctgtttgaagtgatttgctttttgaaaaattgaaaatcagtggaaagctagtgaataagactgattagatgcagaaaaccacttgtgttctacaggtaaattagaaagtttgttgctacaaaaaacatcccttcgaaatgtaggcatacacaatgatttttaaagttgttagaagaagtctgcacatgagctgttcattttctatttagaataaacgatgtgagtggttttgactcctttctcccagtggcccatgccatacttcaaatatgaaaggaaataaaactgcaagctttaaggaaaagataaactctcatgcctgctatatttgcagagtaatcaaggattatggtatatttatcccatttcctcactcctcccttcttgttatttcagtcttcctcatcaaaacacttacttttcactgaatcctccaaattagcttctcatgcatattcaccggcagatcacacagtgactctgtaatggctgcagcctctttgcaattgaggcacagtgggccagacccccaccaggcaggttgcctgttgctggtgtaggctctgggaggtgaacatcagctttgttattccagctgggtgctgcagtccttgaactagcagctttagtcttccttaagatagcatcgtcgttttaatgagagtgaatgcatagcaataaatgctatccaagtcacaactggaattctcctaaggggagatgacctttcatatttttaatgaagatttatctttcaatttccatgaagcaagtggctaggtattttgttatttcatacgaaaataaaaggcatctcatagtaattttttctttgaaaattatttctcaaatttttagacttttagtggaagcgcttttatcttggaagattccactaaaaaagtagaatatttaccactttgggaggctgaggcgggcggatcacgaggtcaggctgaccagcatggtgaaaccccgtctctactaaaattacaaaacaaattagctgggcgtggtggcaggcgcctgtagtcccagctactggggaggctgaggcaggagaattgcttgaacccgggaggcggaggttgcagtgggccgagatcgcaccactgcactccagcctgggcgacagagcaagactccgtctcaaaaataaaaataaaaataaaaattaaaattaaaattaaaaaaaaggaaaagtagactatttacaagatttacaagtaacctagttggattataacccttcctcctgcaaatttatttttctatgatcctagaaaggtcttcatagtataaggattcttttggacttttgtgttggagataacagctaaaagaaaaatatccatcctctgacacacatacatacctcattgtatttatttacttatttattttttattttttaatgaacttatggcttctactttcatagcaactgactagaactacacaggaaactatagacagcaaccttagttatttcctggtttaagtgatgggatgtaatcatactgtatagttgtgaatagataataaaattgcatgacaaaaatgaaattgagaacagacttctgccacccttctgtaataaacagtataggaacaacactagacactagaatgataagaatgtgtcaggaatagcccaatacaggaattcattttttgtctgccttggcatactgcattctttatcaacaaaagttatttttaaaatgtcacataataataatatatgttgtccctttttttaatcttaaaggatcacatgttaaataaaaggaacaattagtagactatatgaataccttcaaagcaattttctaaaacaataaatgtagtcagatttgaaaatcaatcaatttaattatatttgaaattatgatagtaaaaatctatatagtcttaattattagattatagtttacctatcttcattgcatttgatgaaaaactttaaagtagaattatactttgatataatttagttttacttaaatttgttgttgcactaaattatcaagctatattttctttcctggttattctaagtagtgtcaagcacatatcagaaaacccactaaattggtactttaacttttaaaaacagtcttattagtgccatgtggtttaaaacttagcttaattcaaacagatataattttaacttaaaactttttttgggggacggagtctcgctcagtctcccaggctggagtgcagtggcgcgatctcggctcactgcaagctccgcctcccgggttcaggccattctcctgcctcagcctcctgagtagctgggactacaggcgcccgccaccacgcctggctaatattttgtatttttagtagagacggggtttcactgtgttagccaggatggtgtctcgaaaaacattttttatatattaaagtgtttttcaaatttgacaatgtagaaaactataatattttatttcaagaaatgtgtataccttaatccaattagcacctagattctgacctatgttggcacatagtatgatcagccagggcaccagcatcttgattacagaggtgattggatagatccacccatgtcaagcagacccaaatgttttcttttgacttcgggctttccaaaagatacagtagagataacagaaggattgatgaaaggctgaaaccacactatgaacagcatacgtaatctactattaaaagttcctaattagggtagcaacaaaaactttagtcagatctggataaggcagtatctctggctgtgttcttgtctgtttctcctcatcctttttctgttattctcttaatttcctgcagagaggtagacattttagtccacctattttgttaatacaaaggagcagtttctttatattgtcgttaatttactgatcgtataggattatcaacctctttcattgcttaatgttcaaattttaaaaacactttttcataaactatgcttgcttctattgctctaacaatatttgttcctatgttctactctaaattatgcaggtttaaaatctttctcttattttgctgcattcttgtgaagtctgcatacagattcttgattcaaaaaatcatggtttctgtacctcttcctcaggagaggttttacagattctactgatttttggtagacagaaaccaacttttaaccagtgtactacttggaaaaactctttccaaatactgtagaggaaagatgttgggctttgaagccaaacagacttgtgtttgaaacctggttcccatgtttccagctgtatgacaatagcaatttacttcctaaacttaatggagtaatatcgtattaatatttatcccaaggtgtgactgtttggattaaatgagattatctatgggtgtcccaaagtcacgcaaatcacaagttcccatcttgttttttctctgtggttacttctttttattttttttatttttaattatttatttatttatttactttttgagaaggagtctcgctctgtcgcccaggctggagtgcagtggcgcaatcttggctcaccgcaagggctgcctcccgggttcacgccattctcctgcctcagcctcccaagtagctgggactacaggcgcccaccaccacgcccggctaattttttgtatttttagtacagacggggtttcaccgcgttagccaggatggtctcgatctcctcctgacttcgtgatccgccctcctcggcctcccaaagtgttgggattacaggcgtgagccgccgcgcccggcctctctgtggttacttctaatgttggaagtcatcacagtgaaattctttgtgctatcttcaccatgggaatctttctgtttattccatgcccaattacatatatttcacatttcaaactttatcttgagtgaaaagaaagaaggactagctcctgatatattcctcatggatattctcataaaaatttgagtgtttcttttccagtaaagtaagttaatcctttccaacgctctgattattagctcagcacctctatggtattatagttctttttgaaaaatactgcaataattttcattttcataaattcagtggaaactgagttgctccaggtagggtagcccaaagctgactgacaacttcaaagctcacagacaagggcaaaaagcatgtgtgctgctccttgtgaataatactacaggaaaaaaaggcaaaattcctattcaggtaggtagatggtcaaaagagtttcctacaagacagtgtcacgtgcaattttatctacattgttataacttccctacctgacaagacagtgtcaagatttgttaatgagatggcctcacaagtgtatatttaaatattttatgaaaagccattgtagctttctatggatctgacagtagttaaatgcatgagctcccaaggcctatttcaggggctacgtgtatatatctttttccttccaaagacagatgaaggtgtgcaagtcactctactgatttgcaaggacaagaaatgtgctttttctctaattcattctgatattagctattggagttctctttgccctatttcagcactgtttgtacataaatacaccttattactacagaaaaaaattccatgatgaaacctgaagtgctttaatgcactggtctgtagacacagcccatttttttttttctctttacctttgattatcaaggagtaatttgctcaccagcaaacactggataatgtaatatataactttctctaacagaacagaatacagtgagtaggcatttttgaacggtctgttttgatattttggtcccactattctaaattttggggatgcttgtgcggaggtaatgcttaatctggtatcaaataattgctatctgcatctgtgctcattaaatatcattttttaatccagaattttttcctgtactaaggacaaaatgaatattaggccttagacatttttatgtgacatctaaaaattgaagcaggtatatctctaagtaaactaataatggttgatgattttcataataaatgtgcacatttaacattttcctcttcaaattctaaaggttggaaagtgaaggtgaaatcctatatgaaattgtctatatatgctataggttataaatccagattatcattttagattctgtatgttgacatgacatgtaagaactgatgttgtatgaagagtaataataatgatattagaacaaaatgtaatttcctatcagcaatgattagtatttaataataaaatatattaataattaaacattttgaatatagccaaaactttgaaataagaaatgaaacacttaggtaataaatgagaatttagtcacaaaatactgaagtaatattttagctaacttattagcatttagccaaataataagaaaatacttaggttccacttacctaaaaataaatctagtgatgtttccagatgtttagaaaatcattttctttaattaagagatagatacatttctgtgttgtaataaagaatgcaaggagatattttcttataaacctgaaaaagatgtcttctgaatattctggaatctgttttgactcatcggctctattagactttttagttaagtgtctgtttttaagaagatataattcatggtgtactcaaaataatactgttggcagactgtatatgagctgtggaaaggattgcaaactgtaatgggaagtattataataggggatctccactctgctcagatacagggaacatttgataaaatatttcttgaatgaatgattattttacataattattatctagtataatgctatgttttcagataaaaatattttatgtgaaaatatttttatcagaggtcaactttaacgccaccaaaaaattgaataaacatttttgttttgctttcatttcaggtactagaaaattaccttgcatatcattaatagtttataggacttttatttgggaggtagttttcaaaaagttatgatttttgtctagctctgagctctataccagcctctccatcccatgcaattttcatatgtcaacctattaattttgaaacaaaacaaagatgcattgaaatatttctaaatgtccattctacatcgagttctgcaggcgatagtgttgttgcataggcatttaaacatttaaaaacttttcttttctttctttttttttttttttgagacgcagtctcaatctgtggcccaggctggaatgcagtggcatgacctcggctcactgcaacctccgactcccaggttcaagtgattctcccatctcaggttcccgagtagctgggattacaggcgcccgccaccacacccagctaattttttgtatttttagtagagacagggtttcaccgttttggccatcccgacctcagatgatccccccacctcggcctcccgaagtgccgggattacaggtgtgagccaccgcacctggccaaaaatcttttcaataaaacgtgagttctgtgggttgcttggaaaaatatattctagggttctttgaatttaaagacactaagtactctattgcagtcttgaatattaaaactcaaattcacattcacattttaaggtttatgaaaagtcaaaaagtccagaggattatttagtctagacctcttaacctagagctgccaaaacgtatttgagcagaaaatctgttttctctatatttctgttgtcttttttttttttttttttttgtaatccctaaaaacatccaaggaaaggacattgaaaatccctgggaaagaaagcaatgcctcctgagtttgaagactgggtctcctatcttttttctttacagtctcagacttagggatgtctttctttggataaactatttacttccttcattttctttacttgatctttcataatgggttacattgctattaaccaaaactatgaaacatgaataaagctgagaaaaccatcagtcaagtaacaggaaagtgcgcatatttgcccatactatggacatcccaatgttcccagcgggcaggggacaaggaggacatgaacatattctccaaagccaggggagtttcaataacatttttaaagtaatatgttgccattatggttgtcaaaactataatggcactatgttagataaaacagtatgaaaagcaatatcataaaaaagtagataaaggatggcatgattttatgtgttgaattccccaagatatagtacatttgtttttttccttgtgaccttggacaaaagtaacgatattctataaaaatgtggtttgtataactggagttagtgtcaggggtaaaatgaaagttggaacaagcagaaaaagaactatgtatggaaaagaaagaaaggattgtttaacaaactggtgatatgggtttctgtgaaacttgtgtagataagctggaaaaagatgaatgatggaggagcacccaacaaatattaatatataatgtcaacttaggggtaaatatcaagtgttatgcgtctctttgggtccttcgatttctccatttcgtacagtgctttagaaaaagacacacagatgtgctctcctaagttttttgtttggttggtcctttttattttttgagacagagtctcgctctgtctccaggctggagtgcagtggcacaatctcggctcactgcagcctctgcctcccaggttcaagtgattctcctgcctcagcctcccaagtagctgggactaccagtgcacgccaccatgcctagctaagttttgtatttttagtagagacagggtttcaccacgttggccaggatggtcttgatctcctgacctcgtgatctgcctgcctcgaccttccaaagtgctagcattacaggtgggagccactgcgcctggccttttgttgtttttggttttggtgattggacaaagaactctggagagctggagggatgacagaaacattgcctgacagaattatgacccaaagcacaactcaagcatatcaagcgctctgagaaattttaaaatatcatattgaatagtgtttaaatgtgctgtcctacatttgattggaaaaggacacctgcataaagacctaagaatgatttagcggcagtgcacacaaagaggagtcagttatttttacttatcaagcttgcaacagcacagtgtgaggattttgcgttcctgagcctttagtgtcaaattttttgtgtgtaaatccaggctctgacattagctatgtgttcttggtcagtttcctaagtaagtgtttgtcaattaaatcttttcttcatagggtttttcttattttgttaaataggattgttaagtggattaaatgagataggtgtaaaaaaatgcatgttatattatctggcacataaaaaatgtggtttatttcaataacattagatgttattatgttgtcttaattgtttgtatctggaaactttgtttctggatacgccatttaacaagaaatagaggctcactggaacatgctaagaggaaggaagagatacctgtcctatgaggcgtgcttgacaggattcgagtctggagataaagaccatgtctaaatgtcattccaatcctgggattccatgattttagagtatttctccttaatcccttcacttctctgttctttaaaacaaaacaaaacaaaacaaaaataacacgcatttttcttcatagaattctgtgatgagttgtattggtttttgttttgttttattaccatacacacacgttcacgcacacatagagcaaaattatctaacaattccatttttgacataaagttaaattgttttaagtcaggcatgcaatattaattaataccaactggttcatacatacaaaacaattaggccaggtgtggtggctcaagcctataatcccagcactttgggaggctgaggtgggtgaataatgaggtcaagagatcaagaccattctggccaacatggtgagactccgtctctactaaaaatgcaacaattagctgggagttctcgtgcgtgcctgtagtcctagctactcgggaggctgaggcaggagaattgcttgaacctgggaggcggaggttgctgtgagccaagatcgcaccactgcactccagcctggtgacagagcgagactccatctcaaaaaacaaacaaacaaacaagcaaacccaaaaatacaacacagtttcttataaaatgtatgtgaaaacagaatctaattttgtctctctttttctttcttactttcttcttcattttttgaaaggagtgggaacagtagataatgacctactgattgacacaattgctagacttttatccccactaccagaggtggctacccgtgggctccaaatcctattctgaagcatcaggttgccaagcaagtttgcacactgcctttctttcttcctttttccccctcttgtttcccctcatacatttttgtgtcagagattgataagttttgacaaaaggctagtggcttacattaaaaagttagaaccccaaaagccttagcctatacaataactgttcatttaagctctagtgatacatttacaccctggtatgtcagaagaacttttttttctgtcgcccagggtggagtgcagtggtgtgatctcagctcactgcaacctctgcctcctgggttcaagcaattctcctgcctcagcctcctgagtagctgagattacaggcgtgcaccaccacgcccggctaatttttgtattcttagtagagacagggtttcatcatattggccaggctggtctcaaactcttgaccttgtgatccacccgcctcagcctcccaaagtgctgggattacaggcttgagccaccatgcccagcctagaggaattttttaaaaagctaacactttttagtaaatatttacttgtaattaattgtaattattggggaatagatttttaaaaattaaatacttagggctgatccaatcattacatttgtatatttaagtacatcccatttaaacttgtctattactatattaaagttattaaagcaagtgaaacaggagtggtgacttttctttgagggaattttaatactggtggaaaaggccagattgccaacttttaaaactgaaatatgttgtcagtgggaacaaagtttgaaagaaatgtaacacaattttattaccaatgtctctaaggcgataaaatctttctaaacttggtagaaaaatataagaatgcaacttcctagcagccacatggcagttaattttggcaatctgttttgggccattgtaacccacaaatatcaataataactgaaatggcttaaatcttgtctaccgaaaggcttacgaaaaaggaaaagaaaggagagagggagtgaatatgggaggaggtgaagatacaccttaatggtgattcaaggctgcagcatattctgtgtacaaataaataggcttcaacacctgctgatgtgctggcatctggcctgaaagcaaccaacatctgtttgtaattttcagtgggagcccatgacagtgaagaactgtatactgtcactgaatatatggccttgttaacatactaaaaggatccagaagtgagatcatgaatggataatttgggacatgtgactcccatgtgatacggtgataagatttgttgggttttctttaaaggttgccattagagttttatcctgaaccattatttaatagactttaaacgttggaaagtgctttctagaggaaagcttattttaaaagagaattttcccaaccagcttacatcttccacacttttaggggatatgtgttttattggggtagatatggacattgtacaacagctcaaatttatgtaacccccagtgcccttgggagagcccatggagaagaacccagagtgtgagcaggagtcacagtggggttggctttgagcctcaaggcaggtcagaggggtacttcaggagtcctcctcccctgtctctaaaaacgctggagttcttgtgcttcttgattatggctccaattgtgatattttaggcagtaactcaccgttttgtcacctttcctctgatacaagtgctgatcaagttggtaaactcccaggtcagaaaattggggaagactttcctacatttctgttgagggaaatgaggaactgaggccttagaatttctctttaccatttcctcataatcaggaaagttctagagatgattttgtaaaatagtacattcatatctatctcgatggatcatgaccatttttctagtttcacggattcagtgaatgaattctctgttgtaattatttttaggtgtaacactatatgtagatgattgataaaatgcctaactcctaagagtggtgagggctccaccataataactacacatgatacatcattacaatcaggctttcattcagaatttctaaatttaagaaatattacctattatttgataatcttatcacctgccatcattcatttttgcaaatttgaaattttgtatctaacttagattgctgaattagattagcctaatataataaattcttattacattatttttatttaatatttaaagtgaagactatggaaggaatttagtaatgcttttgctagttaaaaacagtatttagttaataaagataaaaacaaaaatattgttctgcacaggggtaaagaggtaggtatctgtgacttctcttttattggcagttaagtttttgcctaagtgctgagactagatttagagcttccttctacagagatttgcctacgtttacaaacatacacattcctttaaaaatatgtgctgcatttcctcaaaaatctaatttttattttttaagaagttcaaaatttaaagcacttctactgtgactgtagaacaaaatagtggtaataattatcaagaatccaacatgtagatttaaacaagctatcacagttttcatctaattagacttttaaattttttttgtttcgtgattaattttaaaatacgtattcagggaatcaagaaaattttcaacttaaaaaaagtggatttctctgtgaataacatacaaaaaaagcttagtataaaaataaaactcttgaatatctacataaaggccataaacaagatcaatatttgtaaagcaatttcctttgctcattaaaaatgcacaaatttaaacacattaatatttaatttcatttttaattataaagaatacaagtaaaaatcaagcatgttcatttttgatggcttttgaaaagtgaagagtttgaaaaaaagaaagtgaaaaaaagtgaagagtttgaaaagtcagtcattttgttttcattttttgactcaggattgcttgggagagataaggacatgtgtatagatacagagacctgggtatggtaagtagtgggagtagaaacccaggtcaaagttgttgcagcatagaagtcatcatccaactagtctccatagacaatcattttaattttctatgcctggttattaattattctaataaaattagttatttgttcctaatttctttaatactgactacttttcacagttttaaagtatcgctaagttatttttgcccattaaataatatttctaagttataatatattttccaagtaccagaaagtaaacccaacaacgtgaaattaaactgtgtaatcttaattgagtgagatggtagttttgcctggagccactagtaaatctgtacttctccaagtgttaattagtgagtctgtattcaattttgctcagagaacatttgaagcactcaatatttaatttcttattatacaatgtctgttgctagaatcttgtacctgcgtcttagacacatgcatgttgttcatcctcagctccagaaaaacacaaccttaactaacatacataagaatattatatgctgtttatttttcaaatgaggtagttaattgttttaagttagattgtgctattttgaaaagaagggattccgtaagaggttacagtacattcagagtacttaaaatttatttctactatattttcttgaataattactataagttggcattttctatgtgctgtcttttataaatatctcccaaacttcattttatctctgctttataaatgagaaaattaaagattcaaagaagtgaatctgttcaacatcatctaacctgtaagttctaagctccaggatatgaacttcaaaacttatactccttaccacatgttatgcacttataactgtgggtttgttactcgctgtagacagttagtaaatgtgaattaagtcagattttttttaaatccctgctccattaactcccctttcaattatttctattttcaatagtatgcttcctattattttccagatgaaaaagtcctttaaatattttttaacaatgtaaaacagatgggcaattccttgagacttgggtctccaaaattgtagctgacgtattttactttgtgtttatttatttgtctactaaatatgtttttgctgggaaaaaaggtctgtccatagtgatataaaatcactctccctagatgatttcattacatatttgatccaacagagaaatttcgggtcttgatacatttcacttgggaaggtacatagccaatatctgattccctctcaattttttttgttgttgttaaatattttctaaacaagtatttttttaattaagtctcaaacagctacttctcaaaattccattcctttctgagctctatagaggaaagatatgataggatctataaacctaaataagcaaacagccattagaaatcttaaagatggattgtattgatgataatatagacacctatacaccacgctccattgactaatgagaatgttataataggaagtgcctcagacctctttgtgtgccaaaatgccagcccactgagaagttaacgttatggtcaatagtgtttgcaaccctccagaaagctccgtaaattgaacagactgttaaccttcacttaagctttcacatcagtctaacgggtgctctgtttgctgctgactgcccgctagagactcactcattgaaagatatgtagttcatcattcatcatttcacaaatttggttccaggaaaagactaaaaattaccctaggcacaagctgtttaatttccaccccctcacatgaatctaacaaacaaccaaaaatacaaacgacattgagtagaaaataagatgtaagttttggtgcctcagtgtcatataatgtaaaggtatttatgtgaaaataacagcttgccttgaagtttcttagtgtacataatattgcagagaataacccctttcacttttaacccacgttctcttaaacctctttctgatcctatttcctgactcttacttgctgcttgtagaagctcatgattctacaattttagatccaaccaaggcagcaagctcaaaattcacccccaaacacactctttcccctcacctaaccaattatatttcctatgcttaaggcatgtattttcagtaagcagttaaaaagacagcatgacttttttattaaaccctaaataatcatatatagcttttctggtttattaatgtatagaataattctgcagtggtagaaatttaacaggggaattttatccataactatcaatttcatactttacctagataaccagaattatgtgacttgtttgttgaaagtaacatgcgttgtatgacttgtttgttttttattgaagtttgcatctcaaatgataatttaaagtttttgttagtgaaagtagggcagtgaccacacctttatataactattattaccttgattaattgctacattgtaaaagaaaatattttctacaattacagaatcctcagaacaactctgaaaacaaatgaggtattatccccaattaaaaaaaaaaaaaagattcaagagatttagtaagtacttcggcaagatctaaatatatggaagcaaattagaaacaaaccacatttttctgagctcaaagcccaaactattttctgcctatttcattatttcttctttcctggcccacactcctgtaagtgtatgtttcgtcttaatatatgatgtttgctttattaagtgcttgtaatgaagaatgcttgtcaattgagatcatatttaggaaatgttagaattgctgatttgttttgtgataaatattattaaaatgtaagctcaaggtaagctggatattttgtacgttttcatcaaagctttatccccattacctaggtcagtctgtgcctggaaaatagcagtgggtagttaataaatgctgaataaatgggatgtttagatacatttggccaagcgacactctcacctcaaatttgtgtgaaaaatcaccccaagaaataaaaggcaattagagacaattgaaaaattaattcagctgatagaaccacttgtcaaatattacataattcagaacaatatgactgaatcatgatgaaggctaaaattctgggtcttaagcaactttaaacctttcaaggaaaggctgattgacaaacacaccttctgtgtttaatcaatgccacaaaacatacggacccaagaattggtggaaatctagactcatcttcagaatggtaaattattcttgagttataaggcctccattgcctaagtgactaaaatgtatgtttccagaaagatttagcattttcctacaggttattatatgcaagaaatgcctttctccaacaggtgatagaaaggtcagaatcagccatctcctaagatactttattttattttgttatattgcaataatatgcaatgcttcagtgttataccaatgaaataaaatgataaattataatagcagtagctgagctttccaagattatacaaattaggtttagaattgaaattttatgaaaacaataatattttaactgcggatagaatattgaaagtgacctatgctgagagaaaaaggagaaaatttaggttacaaaaatatcagatgcattaatccaacataattttgtaaaatggttatcaaaggtcaacactcaatgtaatgtattataataaacaagaaaatgatggccatttttagcaaaaaaaaaaaggattatttgaataatccaattttattttacttagagacatttttcatataaaattagaatgaaatttatgttttaagctactttaatcatacatttttgttgttgaacaggatgctaaggtacagaggaaatcatgcttccaagttgattgccaaataatagtagcattgtctaaactcaactagaaattttgtcaatgcttttttttcttattgcccaaaatgatgcagtgagaattgataagataaggatattctgaccacgaggagtttacaatctagaaatgtggtcatatgcataaatagctgtaatacaataatgactatggcaacagtgaagaacaaaagagtgatctggcaataagaaaaaataagatttctgttccctctaaagaagccctttctagaactctagtgaaagttaatgggtaatcaatctaccatcacaagttaatgggtaatcaatctaccatcacagaaaaagtctagtctggagtgggtgacttcaagaaaaggtttccccatagcaaaatcaagtgtaactttccaaaggctttgagattatattttcacatctgtttttgtcgtttgcatgcatatagaatcacacatttatctctttctgttactgtgctatattacacaaaaacaactggttgggttttctcaagaggatattttggggtgacctgagttaaaatagaggttatatcatcatttaaattcactttgggcagccttagaagacaccccaaagacataggctatcatcctagagaatgctataactgctgataataagggacgtgccatagatattaagatgctaccgggagggaaaataaacagtgatttataacgcaagccctgatttgaaagtcacaaggtcagacacttggaattgcaggtgttgatttgtgatcaagaggtttttcacatggacaactctagaaagccttatgcagagtgagtaacagcacaaaggtactactagaatattggcaaaaattaacccaagcaatgcagagaccagatcactctgaatgtgtttctattttcatagatttcacctagtatatttaggttaaagaataaggcacaatgaaccttccctatctctaaaaaggaaaagaaattttttttgctttcattatcacttttctaaatactgagcagctcgttagtatcctcactctgatctataaatataaatataatattaatatatttatgatattaagtataaatattaaatatagccgtattaatatatctataatatttaatatataatactcattaatagataacgaggcaacactatggcattttgttccctatgttttaatatcttggagatggttatcttgtagtatgttgcagaaatgcgttatccccatgagagcctttggaatgtgatgacaaccatagtgtgggagccgacagagtcactgcttaggtgggaaatgtctaatagaaagaaaagaaaacttagaacatagctttgaggatcttgtattgaaggatggagaagacagcaatctgagaaagtgaccaaaaatatccaggagaaatactgggaggagtgtagggtcctggaagtgaaggaaagagaacgtctcatgaaagaaagggaagcgaggcacagtggatggaggcagctgttggaaacaccacttgaattacttgattgtagttcaatcagttttcaaaccccagtgagggaaaacctgagatgtctgtgggttgaggagggaatgaagttgagcatgagaatctgaagggagaaggaaggcaacgacggctcacagattcctcatcaccaaaggaggggaggtggatcagggaaggtttgggcttagctttttaacacaccattgcagctatttttaagacaaatgtaagaaactcagaacaagagatcgcttataaaataattgaaaaaatacatagtttaaatcagttcttataaaacattgaggtgacaagattaatataggtcttgttacatttttatttttccattgttaagtgtaatgcaatttatataaatatcagtttcctttagcattacttttgcatgaccttagctctatgctttattcatatatgctatttcatataaatgatataaccctttgaaattcaatttagaaaaataccctaaagatattgtgagccatatttatacacagttgtataacactctccttgtactagagctggttttacataacgatttgggattgagttccttttttatgaatgcatttttgaatgccacttctcttgtaggcaagtgtatgggtattgtatatttgtccctgatgtagattataaatctagatttataaggcatcattaggcctagcagcccaagttttcatatctatttcttcaagacaaaatatttcaacattactaataaatcatgaaaagtactaacataaggagactgaaataatttgttaaatgttatttttcaaagtaaaacaatttcactcctaggctttagagtcaggaaaacaaacaaacaaacaacaaacattgtttaaaattatgggttcttccatgttacactgatactaccatatgacaccccgagcttcagttttcttatctgtataatgtggacaatcatcattgcaccgaaagaattcagtcaatgctaatagagtgcctagcgcataggaaaactgtcagaagggtacctttagctgcaagtaatggaaaccccacttaagtctagcttaaacaactaggaaatttatttgctgacataatttggaacatgagctggggaaacagtcatgattgatttaaggagtccactttcctttccacagtggtgcattcctttatttgcttgttgtctttggggtaccccttttatgttggctagttacagaaatctacattcacatcctcgcactacatcattcatcagaagagagtgcattatttccataagctctcttgttgtagtaaggaagctttttcttccagaagccggccctgcccctacatttcccctgtgtctcagtggcctgaccgtgctcacttctgaagcaatcctaatggctaggagaaagccaagggcctattggccaatgttcttaaaccaattattgcaaaggttatgggattatccttagggtcacttttggggttgtaggctgggtcagattcttatgtatcactgtatgaagaagggaatgatactcaaaaatattagagttaaattttgaataatagtagggcactgatgaggcatcaaagtgacacctatatttaacctgtttggggccctattccttcacaccaaagaaggaaaccaaagcataagtcccatctgagccaattcagttcatgcgttgaatcacaatatgttggtggtcctaaaattattggcccaaagttgagtatcttggtgttttgttttgttttgttttgttttgttttgttttgttttttcggagtcccactctatcgccagactggagtgcagtggcacgatctcggctcactgcaacctctgactccctggttcaagccattttcctgcctcagtctcccgagtagctgggattacaggcacatgccaccacacctggctaatttttgtatttttagtagagaccaggtttcaccatgttgtccaggagggtttcgatctcctgacctcgtgatccacccacctccgcctcccaaagtgctgggattacaggtgtgagctaccgcacccggcctaaacctgagtatctttgctctctatcattcccattttcagcacccgagccttaaataaggtaatggaataaaatgaaaaacttgtgcaaatgctttacaacatagttaggtaagtttatctgaaaagataaactaatttcctatatatgactttgttacattattctcctatgagtgtcaagttattttaagaattcagagttacctattaaaaataaaattgacgagttatcaaaataggcctagaaatttagaacatggctaaaactcatctgtacgaaagaaggaaggaaggaaggaaagaaagaagaaagaaagaaaaagaaagaaggaaagaaagaaaggaaagaaagaaagggaaagaaggggagggaaggaaggaaggagggagggagggaaggaatgagagagagagagaaagaagagagaaaaacaaagaattggggtggtcgtgtgcacctatagtcccagctactcaggaggctgaagtaggaggattacttgtgcttgagaggtggaggttgcagtgaaccatgatgatgccactgaactccagcctgggtgacaaagtgaggccctgtctcaaaaaaacaacaacaacaaaacaaaacaaacaaaagaaaacaaagcaaaattacaagctgtaatttcacacctgtggtatattttattttgcttaaacaatatgctttaataaatatatattgaaatgacagaaaaataatattttaaaatgtatctgggtctacacattaagatttagtttgcagtattccaaacatcatttaatggaattaaataaaatttccaaatttataaactaaagaagtgctgctttcttatgaattcccactctaaattcattaatttaagatacatgtggcctttctttgtaactttaatatttaaggaaaattcagaatacttagcctcatccttaatcaaagtgtaataaattacaaaccccaccaaaatctctacctactgaaaacttctaaaggtaggagagagtatagagcctacagctgactccctacaatattctacatagcaaagtgaattaatattaggcttaacataaagcatctgttttctaccattgacatttacacacacatacacacacactcccccacacatatagagtttgttagggttcaccaaaggtaattaaccatcagatgtatattaatcacacacacataaacatgcacacatatgtattaactaacacacacacatttacaacaaaatagtagacagaaaaccattataagtgcagtttggtaactttaaggacctttgatgagaaatttcaaagttggtgacagttcatatgaggaagggtttttcctctgacaatcagatgagctaattaatcagcatttgacccggctggatcttagccagcctaactgttaatgagtgtgcactgttttgccagcaagagcacagtctcttcaaaaaataattgtcagggtcatttttgctatgaacaaaatcttattttgaaatgtgctagacttttttaaagcaacaataagaatgacacgatcattcttaaatatttcttattaaatattatggtaccaccaaacatgagcattgttttatttttttttttttaacaaactcattgctcttcatttatagttttacattttaaagtcatatgatgagaactatttcttccagtttgctttctgctgccaccagacttgataccacaaaaggtgtctgggtgcatgcctgtgatgatattgccaggccgttcctttcttggggcctgtgtatacatgggcctgcctttttattagcacctattataatatatggccattaattattagctgtacatattttctactagactgtcagctccttggaggtacaaaacttatttttctcatttgtacagcctctccgatatcttttatcaacttcatgtaatcctgatagctcagtgaggaactgaggagtggggtcccctaagaaggacataagtctaatttttaaagactaggtgtagggctgcagcttggctctcagctgtgtatgattccaaacaccgaagtatctccacgtcatcaccttttaatcacattttagtgtgatttataagcacatatttggaataccaccacaaacacacacatacaaatgtcattgttatttatatgcacgtatgatggtaatatatatgtctgcaagtttgtgtgtgtttgattaatatacatctggtgattaattttctttttcatttttttttgagacggaattttgccctaatcagccaggctagagtgcaatgtcatgatctcagctcactgcaacctccacctcccatgttcaagcgattctcctgcctcagcctcctgagtagcctccggattacaggtgcacgccaccatgcctggctaatttttatgtttagtagagatgggggtttcaccatgttggccaggctagtcttgaactcctgacctcaggtgatctgcccacctcagcctcctaaagtgctgggattacaggtgtgagccactgcgcccggcctgatgattaattttcaaacaaaccgtgtgtgtatgtgtgtgtgtgtgtgtgtgtgtgtgtaaatgtcaatggtattagaaaatagatgctttacattaagcctgctatggattcacgttgccatatagaatattgtagggagtcagctgtaggctctatactctctcccaccttcagaagttttcagtaggtagagattttggtgtggtttgtaatttattacactttgattaaggatgaggttaagtattctgaattttcttcaactttaaagtacaaagcccacatatatcttaaattaatgaatttagagtgggaattcataagagagcagcacttcttctttagtttataaatttggaaattgtaattaattccattacatgatctttggaatactgaaaactaaatcttcatgtgtagactgagatacaactttttaaaatatttttctgtcatttcaaaatatatttattaaattaaaatacagtctttaaacaaaacaaaatataccacaggtgtgaaattacagcttattatatgtatttttttttttttaaatttactctgtcaatcaggctgaggtgcagtggcattatcactgctcattgcagtctcgacctccccaagctcaggtgatcttcgtaccttagcctcctgagtagctgggactacgagtgtatgccaccacacctggctattttttaaaaatgttggtagaggtaggattttgccctgttgcccaggctggtttccaacttgtgggctcaagctatcggccggcctgtgcctcccaaaatgctggggttacaggtgtgagccactgtgcctggcccacatatgaaattttgaaccaacaatcttctgagctctttttatagaaattgatgtaagatcacaattatttagtgatctgatatattttagctgctgtctataatatttggaaaggatctgcaatattaaactgctttacatttcagttataaaaaaaaagttaaaatttcatgtcactataattattacaggtcacctcattcactgtctttccttttccttagcatccttagatagccacagaacatttccttaaacatttcttgttacttatttcacatactcacaagttcccccattccatttctagaaagcttttggaatgttttataaaacagtatgagcattattgctgtaagaatgctattgaaagtggagtgtaggtaggcttactatacaaagtggagtgtaggtaggcttactataaaaaacaaggtatactaaaacactcactgctataaaaaacaagcctcaaagacacatgcacatgtacgtttattgcagcactattcacaatagcaaagacttggaaccaacccaaatgcccatcagtaatagactggataaagaaaatgtggcacgtgtacaccatggaatactatgcagccataaaaaaggatgagttcatgtcctttgcagggacatggaagaagctgcaaactatcattctcagcaaactaacacaggaacagaaaactaaacactgcatgttctcactcataactgggagttgaacagtgagaacacatggacacagggaggggaacatcacacattggggcctgttggggtttgggggataggggagggatagtattaggagaaatacctaatgcagatgatggattgatgagtgcagcaaaccaccatggcacgtgtatacttatgtaacaaacctgcacgttctgcacatgtatcccagaatgtagagtataaaaaaaaaagcccccaaatatataatggaatgttgcaatgtaagtttatgtgttattcaagtgagattaaaaatgtgtgttcctggtttgcagaaggcaccctccacatgatagaggaagcagagttttcctttggttcctctgcatccacatagtataccaggaagagaaagaatagaatagagcacaaaagagattttcatgagcttttgtagaaaaagcctgagcccctttcactcacattactttggccagaactcagtcttctgactctgtctacggaggaatgaattttagctgtgtgccaggaggaaagaagaacaggttcatattagctttccggcttcgttgtcttctcacattttgttcccaccacattgacttttctgtttgttcgtttgttttgttttgtttccagaaggcactacagggtcatgccacaagttgtttcttctacaaggaatgcggaatgcttcccactttatgcaggttacccagctgacttctatttttcatttaaaactcaattcaaatatttagttatcaggaatgtctgctctaatatgatacatattattattcataacacacaatttcaacatcagtgagaatttttttgatgaatgtttatctcccgaagtagactgcaagtttttaatgacaatgatcatgcctgtccaccctccattattacacagctcctatcaaagtcaatagaatatgaaattatgtttttaattaatgaaagaaaactccaccctccaactcttaatgacagtacaggttgagcatacctaatccaaaaatctgaaattcaaaatgcttccaaatccaaaactatttgagtgccaccatgacatcacaagtggaaaattccacactggaccttgtgtgataggccgaagttaaaacacagatgcacaacacaccatttattcagcatccccaaagacaaagagattctctcagcctccctgagctgtgatatgtttctgtgcatgcccaggtttccccatgcaatcacgcccacaaatggtatcacacagcatggtaggcagagactgaaagcttgccattcttgattgttgctgttctttaacagctgatacaggtattctggtgatgctactgtgttagtcagttatcctggacacattgttttttcttatattaatggtatgttagatttttttactgttaagttctgacatgtgactaagcataagaaaatgcttgcttattggtagcatataaattcagagtcaggaatgatagtgagagaaaacaaccacagagaaaacagtccacaggtgtggctgagatagtgatgcctctgctttctgatggtgcaatgtatacaagctttgtttcatgcacaaattatttaaagtgttacataaaattaccttcaggctgtgtgtatatggtatatataaagcataaatgatttctatgtttatacttgaattcaatccccaagatatttaattatgtatatacaaatattccaaaatctgaaacactttttgtcccaagcatttcggatgagggatactcagcctgtactcccatacaatgaggccttaaccacagaagaaaacaataggttcttcaaagaaattggttgtgacatttaaagggtcaaaatgggtggtaaatgtggaataataattgagaaatgtaaaataattgagaaaatagccaagaatacctgagtatgaaaatagatgtgaaattttagcagtctatcaataaaatcttgatcaaacaccacttattcagctgccatatatgagtgtcaatgaggagactgtagagcagttagcatgatttttacattcagtttattaggtagaagaaaccctgcatccattgtcaacattcattctgaatgcaatgtcactatctattttattggcttctttttcccaatgcaatatttgtgatgaagtgttccccaagttatgcttttatcttctttgtgtccatctaattctttgtgggtgatgtccactactctgacagcatcacctatcataaaatgctctggatctataattccagtcctgcctgagtcctgtttctgcattttctttgctgatctttactcaaagatgctctgaattcctctgaaacttaacctgcctcaaattaaatttaggataagacttctccttttcaatatccttctcctccagtattctctgtgttaattcagagtatcaccatccatcagttatcaaagccaaaagagtcatttttcatttcctctgacccatttgccatgaccaagagaagaaagagcttcagctcctgagcctaggatgtctgtttttgccaattatgccaatccaaatccggctgtcatgaaacctggatggaaaaaacaaagccagtgccagctctgttcagtaggatggaaaatctctgtggcttggtagcctcccaggttcctacagagaaggttcattctgagatgaggatctctgtggcatatggtcttcaggaggagaatatctatgagaaaagagtctccctaaaccagaaaaatgagaaatgcaaagaagatctggacaaggcagtggtggaagtgtcccctttagatatttggttagtgctggcattactgcctgtggaccagatggtcccaaagttactacacactgcactgtatgcctgcctgctttcctgcctgctccagagtctactgagaagctgtattatttgtggatgtatgtgacacagtctctgcactgtagttataagccatgtgtcgctccaattcctaagaatccagtcattccagagattactcctcatacatgaaaatcctccagattcctactttctgataaagaaatattattgtgaacagatcagaaccaatgtaggaattcaacctcaagttcaaaaaaatcatcttctagatcaaaatgaggaaagactgcaatttaccattcaaggcaaaaatatccatatattgtaccagacacctattaacttcaataaggatggtcccaggttcaagagtgaggagaagagacccacagccagtgaatgaaacatggggtttatttgatggggacatacgggacagtccagtggtggcaggctggacagaaccgctacagcttgcaaactgcatgcagtttatgtagcattttcacttagcaccctctccttagcaacctccaggttaacaattcatttcttaagttgttattgctttcaggtatgtctgccatacagggtcgttctcggggtatgcttaagttattgctgtcaggtacatctctcataaaccatagtaatccagaccaagactgctcccttccacaggccaaaacctccaacttcatctttctctgtcccttgcaggggtatagttaccctgtttactatgtttattattattattattaatattattattattatttatccctgactggtgataccctgaaagtcttcccacctgagagcttggttattgcttccaaccccgggtgaacccctaagctagaccagtccgttagtgaccagattccagtgaagaagggggcagttggcttgcatatatggttcatgttgaaccagcccttcatgttcctggagctcccactaaggggatggagaagggatcaggaaagagggttgaatgaagaagagaaacacgtataaatgtaaaaacatgcatctgagaaaagaatcttagccccgttcttaaattcagaactctatttttgtgcttttaaacctgtcagtcctcagcgtcactccctccaccactgccatctcagccctgaagcttcctggtttcttcacagaacaaagatcagtacttggaatgtggcaagtactcattaaatgttttggattgtgcaaaacagtcacaatcaattggtacctctctattaatgctcccccacctctgtatctctgctcatgctatttctcatttgcaatgctcatccctccttatttctcctttgaagttttattaatctcaactgaaaaaaggttttcttcttgaccaaactccaatcaggcttccctgaactctttttcaactaggcctgacttttagacgcctgtgtttgtgtgcattgtctaattgcagtaagaatcttgcagagttggtttaattttagcaagactcttgcagagttagtttagccaggttctcccatgcttcatatctgatcaccatcaatatctaattgggttccccaccctccactatcctccaggtgatgtgaagggaatgatatctgatgaccctggcctgtcttcagcaagaatcctcataggttagtttaaacagaattcctccttacttctaatgtttcttctaagtaattttccatccactgactcacatcgtgctttttggctgtaattccccctcattcatgctgtatcaggaattgaacccagttctgttctgaggtcccttttaccctattgcaataatactgaatagaatctgtttctattgccttaactaccgtccagttctaatgttatttgatacaataatccatcttgtcatgttccatatgtagccttccaggcttttccagatgagcctggcttggtaatcattatctcttctaggatcttacagctctatttggtgtttgcacgtctattactttattctataactgattttcttactagtgtttacacacacacacacacacacacacttttcataaatgtgactccctataacccaatatacattttggtatatttggatcattgagtaaatacattaaactttttgttttcttttttgtctcaaaaacttacaaatcatctggcttttaggaggtgatttgtacacaaattacataaaaagtgaatttctttcatggtgttaactgttgagaaaatcttacgccaaccttttcaggagccatggtggttccgagatgctttaaaaataaattaccaatcctctgtaattttgcgtcctctcatctcacctactcataataaatgaagagaagatatgtcatgcctcacaggcaatcatatactgataaatatttaatgactggctctcaaaaaatattaaaaataccaatttgtagtgtttgctgatttttatgatataaatacacccaccatgacagatgcctaattaccaacatgacaacgctgaccctggagttaggaagaggtgtgtagtgacacatcatcatatctttaccatccatatatgatagctgtgaataaactcgaggacataagtcatagtaaaatccaatttttaatgatggatatgtttaaccactggcttgaaacttcctgatatttaattataagctctcaaccactgtgtgggttggctccagcacatcagaaaaatggattgcagcatattcagattatataatcactctcagtagcataacaaggatattacttggcataaaaatttcataaattgattatagacccgtgttatcaagaaacatactctatatattatttcatcactagtgttccttgaaactgaattttacaaggttctaacattgtcacatgcctcaaatcatcctccaaagatactaataatctagttattgagttatataaatgtataaggaaggtacgtgggaaaaatatataatagtatgaatacatggaattatgttgatcatgaccattattccttaagaggaatattatattttcagaaagatttgaagaacttaaagcttatacctccagtggcccactaattcacagtctaaaatgacagaacatgataaatttcaatatcttatacaatttctcatagcctctggcaggagcaattcttgaaacagtaggtggaaatatactcattaagctgcaaaattgcctatattcaggacacctgccaagcaagcattccctaaattaccacctgttaccataacatcaaagacatccaaaatacttgcttactaaatctagtctccctaagtatatataattttcctataatgctgcttgatggtagagcagtatcttaatttcatatacataaatcaaagttgtttctggacagctagggctcgaacctggttttcaacagctattcctgaggtatagttgatctttagtgttctatttgatgttgagttatagtcacactttttaacttgtccaggtgtaaatggtagttgctgaggcctttatataaagcaaatttactatcactgatacatgaaagaaaatcattttactgatattgtagcactgaaagttgtcaatggattatctaagatgattagaagctgtggataaattagtagtaggccaatatattttgcttgagatcatgtgtcaatatagcagcatgctccggagcagacatctataactaataatcatataaattctgctatatatgtctatagtcagtctatccacatagattttcagtcactgttacattcagtaaatagaatgtaacaatatcatgtggaaacttggttagataattctgcaagacatatcaaatggatgagtgataagaggaaaccaactgctttatgacaagctgaggtggagtgaattggtacaaggacacccagaagcacaatgtcaggtgatgaaaaggctgtgtaataatgagaggaaacagtaataggagaagaggaaataattagcaatcagaaacatcgtgattagaagagtgcataggttatgagctgatgaggctaagccctaaacaccaccactttttaataaatgtgcctacattattacccaaaaagagttctttcaaagaatttttggccacattcacccccccagcctccaagaaagagagagatagaagggagacagagagagagagagagagagagagagagagagagagagagagagaaattgttgaggggctaatgtgagccatggtggttttattcatcactataacagtagtttagagactacaggttcaggggccagacagcatggattcgaaagtgagcaatatcatttcttttgtgaccttaggcaagtgacttaaactctttatatctctgtttcctcatttgtgaaatgctgattgaaatgatatcatatttcataaggacattgtgagggttaaatggaataatgcaaagaaagcccttggcactgcctactgtgatgaaactgttccaaaaagtcagctattattttcatccccactgcctaatatgtagggtgtcagtaaccgtaaataaatgttgaggttgaatgaattcacattaccatccaagatactttcaaaaataaccaggaaaaaaggcatacatccctttagaggaagatgaagaaaaatgttattgcagcacgggagagcactgtattcttattaaggagtttatgttctggatagaacttcataggaggcatggcattgatcatcactggtcttttatcatcattatcattatagtttggtggccgttgttggcataaatcaaaatcatagaattgtagatttggatgagagtgtaaaggttatttagtgtgctttactataatacgatcatctgctataatatccgtgagcatgtcacctctggtcacgtatccacagagaataatctcattgttggctttagaaataaaataaatacctgagagtccataatggcaattttaaaaaaatgaatacattgagcataaccacaagcataaattatatggcttaattattttgacacgcacacacatacacaggcacatgtataagttttatatatagaagtatatataaatgtaatatttgccctttcttggtgctttacataatactcatgcactgtttcactaatcctttgtcttcccagaaccttagttatatttagcaatgttatttcacaatttacaaaagaaacacaacttattttgactccgacattatggacatttctggggatactgctttttggattgagttctaaagttggacataaataattagatcaacattgtggagaaaatatactataatttaaattttacgttgttatttttattaatgtgggtacaataaaataataaacatgacagcattaattaaactatgaaatagcatctcacaaaattgctaaaattataacaatcagcaaaatcctctctactccgaacctcttctcctagagtcacatgcatcttttggctcctgtttctcctctgaagaacactgcagccttacaaggtcataactgtttcacctcctttaaacttccaggcatacgcatgctcctctcttcagtcacactcacttggataaacctcagctcacaccaaatccagtccctgcctactctgtttaatcatggaggcaactaagtcaggctggagaaaaacatgcaactttgatgacttgtctcactgtgtttcacgaccattgaattaaatgggctgtttctgctgtctgggcaccatcccattcataaactccagatgtcaacacagcaattgtctcttcttttttctgtttctcgattttacctttctactctatcacttccatcgtcataataacatgctgttatttttcctttcaaataagaataaaaaaaaggaatctcgatctgacaggctagttgagttcctgcctatttctctgcacgtcttttggtagatctcctggagagttattttttatactcactgtctgtactgtttcctgctgcaattatgttttgaacacctcaagtttagcttttgtgctcactactctatcaaaatatgtcttgtcagtgttaccaatggttttcacatggctcagtccaacagtcaattcacattcctcatttatggacctatcagaaacatttaacacagttgtcctttttttctggaatacttttgcttggcctctggaaccccttccctatccacttctttactgtctcattggctggaacttcttttcctctaaaaattagagcgcctcagattttctttctcaaacttctctatgtaaatcactctttaggtgatctcactcagcatcatggctctaaatattatttatattctgaggaaaaaaatacatagatacctttactcagaactgtttcccaaactccacattttcaaatccagacttcattttctccacttcagtgatgtaaattctcaaatggagaatgcactaaatgcactaaaaatgaaaatccttccaattccccaaaagcctctttgttccagttccccatctcattaactgacaattccaaccttttagctttggtcaaaaatattggagtcagtcatttttttcccttcactccttactttccctgtcatataaaaaataactaatcaaaatatatgttgtctctgccttcaagatatgtctagaatctaattacttttgcactaccaccattgggcaagccattttctcttacctaaattattgcaataacttgctacctgttttctcttcttctgccttgaacccatgaataatctatgctcaatctactagctaaaataatcattcaatattagagacacattgtgtctcttctctactcaaagccctctaattgttttctgtcaaagccctccaattattttctgtctcactcataataaaagccacaggttatacaatgcctcctataagtctaacatggtctgggatcccgtatttcctctctgatctcattgtgttctactcttcttcttgctaggcatattctacctgtgcctagaactatccactttccttcctccttttatgtctatacctaaatatatccaccaatcaggccatttccctgatcatcttatagataaaaatctgaactccctttttccccgccgcccataattcttctcctccttatattatgctttaatgtattccagcgctcacaacacttggcttaccatcagctttttggttgcttgtgtgagccctctcacacaaagtttagatagctatagagacagagagccagaaagacgacagacagagatagatagatagatagatagatagatagatagatagatctctagttttatgtactactgcatcgtttgtgcttacaatgcctagaatataagacactaaattttttgaatgaaatacttaagaaattaattatgtactctatgcttttgatggcattctgtaaaactatgtgtaaaatgttgatttatagagatttatatttcccgttaatttccgttatgctttctgaaacatgtttctctggggagtgaaatgaccttaaacatacttaagggttagtctaacatttatctttgagagcattttctcttcggaagctggccacctagacacattaatttttcccacacaatactggttaaagaggtatttcagtggctagcgatcctcaaccattcgtaagcaacactccataatagtcagttttcaggagcaggaaaatgaaggctaatcctagggcacccatgatacctggctgtgctaagtagcaaaattacgggcattttcttttcattacaactcacgtactgcaaatatgttatctgcattttgacattaaattatattgccacataaaatatgtttaaataatcttatttttgttctcattagtacccaacttaaaaatacttacaaaatagttaataataaatactttaaaaagacgttttaaaataaataaaaataaacactttaaaatcgctcacaaagcactactttcatttccgatgcattttttctccattttttgcacacataatcatattctaaaaggtgaggtggaaagagttactggtcctaaaatatctgtttgtaatgttttgattatacttgtgctttgggtgtgtacacgtttacatatatgcatatatgtgtgtttgtatccaggcatgcgtatgtattctgtacctttttagtacttgtattgttgcatcgctgaatacacaatataatttttacttatcctttttatgacccatttgacctccatgagaaaacatgtggcatattcccttattcatctatgcatttccaaaacctagcttagtacttgacatataatagctggtcagtaaatttgctttattttatactgaaatatattgctctaagccagattttcacaaattgttatgagagatatagtaattctgcaatatgtgagtaataatattctagggtttcacatacagaataatctgaataatgaactccctcttgggatgctgtaatgttcattaacataattatactctctaagaaactaaaaattaccaacaaaaggcaatcgttttaacactgcttaagatataaacaactaattttcccatttccttttttaaatatatctcccctgatatcttaattttagaagcagattgcattatgataaatacttacagagtgactagaatattgtttggcatagatctaggttgataatgacattaatgaactttgcaaaccgagttcaattccagaaatgggtactgtacttttctgagaaattgctatctcatgtggcagataacttatatatatgaaaaagtatagtaagaaatttgaggaattttgacttaaatgtgtgaagaatttttataattgctgtgcctacagtgaaaatggctattttgtcacctaaacagtcagggagaacttggaaatgtgaaagtccttaaaattctactgcttactgtagtctcagtatgaaataatgtaattatgtttacttgtaagttatcctatggttgcagataggaagactcgatactataaatatgtcaattcttcctatatcaatccatatttatgttaatataaaagtaaaaaataagccaacagtgtgtttgaacaaaataagcttattttagagtttatatgataaaagaagtatgcaaaaaaatctgcgaaattatgttgaagaaaaacaacatgggagagctagctctataagatattaaaacatataaagtctcaataaatagaacagtatgatactggttcaaagaaacaaaacaggaatatgtgcaaatacataggaaaaattattatacataggaaatggtatgaatgcaaaaaaagtagaagaattaagttgactccatataccatttcttatacaggcaaaattccaagaaaataaaagatctaaatgaactaaagtggtagcaattagaagagtgaatataattttaaagaaagtaaaaaaaataaataaataaagattgaacccaaatggatgtacaaagcattcaaaacaagaatccacaaaaacttgtaggtaaagacaaatgttttattttgggaataatgcagaaaatggtatcaaaattgacttgagttaaataatcaatttgaagttgtggaaacctgaggatgtcatatgctcagtatgaaaactgggtttgatgttagggaaagatgtatgttaatttgcacggagacccttaagattatatgcggctatagagggaaatgtggctatgatcttaaggatgagtttttggcggcatccactgaaaagatgtaaaaagtaggagagtaacttgagtgcatagactaggcatgtcaagacctcaagggaagaggtagtttgaagaatttattaggtgatcaacagcatctaatgttgcaataggtgtttattcatacagagtaagataagagatagaaagacagcaaaggaaagaacatgcagggatattgcttctaagttttccactatgactttcaatgatcttcaatttccatttccacaaagaatgtttacttgatatttaaaaggaaattaattgtaggcatctcttatttcctttgtattttaatgagtcatcatttcaaaacttttgtcacatgtcagtgttaaatatgacataactacgttgcccttgatactagttaaaattaaattttttactgattggaaaatacacatagtgatttatttcagagggtaaaaaatattatactaaagtctattaagaatcagttgtgctaggagtctccttcaatgtgtttcaaatatttggtgtgttccaaattaagacagagtggagaacgaaaactttcaagtttgaaacaccaaagattgtataggatgggggagaccaaatactattaaaattcaccagggtcattctatcttggaggtctcttaggaatccatgttccatctcttccgttattcccagataacagcatgattttgccattgtcttcaatttccagatgcattagaagtgtggcaagatacaattagagtgtgtaacttaaatgctagtaagacctattcaagcaagcatagggctctgcacttacagaaatgtacaagtaaatctaatttactaaaatatatttagtacatgtaaatttaaaatattgcgatagctgggcgaggtggctcacgcctgtaatcccagcactttgggagaccaaggcgggcggatcatgaggtcaggagatcgagaccatcctggctaacagggtgaaaccccgtctctactaaaaatacaaaacattagccgggcgtggtggcgggcgcctgtagtcccagctactcgaaaggctgaggcaggagaatggtgtgaacccaggaggcggaacttgcagtgagccgagaccgcgccactgcactccagcctgggggacagagtgagactctgtctcaaaaaaaaaaaagatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaaccctaagccaaaagaacaaagctggaggaatcacactacctgacttcaaactatactacaaggctacagtaaccaaaacagcatggtactggtaccaaaacagagatatagatcaatggaacagaacacagccctcagaaataatgccacataactacaactatctgatctttgacaaacctgagaaaaacaagcaatggggaaaggattccctatttaataaatggtgctgggaaaactggctagccatatgtaggaagctgaaactggatccctcccttacaccttatacaaaaatcaattcaagatggattaaagatttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcccaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagataccatctcacagcagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgtggcattattcacaatagcaaagacttggaaccaacccaaatgtccaacaatgatagactggatgaagaaaatgtggcacatatacaccatggaatactatgcagccataaaaaatgatgagttcatgtcctttgtagggacatggatgaaattggaaatcatcattctcagtaaactatcgcagggacaaaaaaccaaacacctcatattctcactcataggtgggaattgaacaatgagatcacatggacacaggaaggggactatcacactctggggactgttgtggggtggggggaggggggagggatagcattgggagatatacctaatgctagatgacgagttagtgggtgcagtgcaccagcatggcacatgtatacatatgtaactaacctgcacaatgtgcacatgtaccctaaaacttaaagtataataaaaaaaaacaacaaaaaaaaaaagaaaaaaaaatactgcaatatcttcccgccttttacactgttttttaataattattttatatcctttctaaactgaaagttccatggacatagagactatgtcttgtttctttattgtattcatttcactgtatggctagaaactagggctggccattttgtgtattattgtacttgttccatatctcatattatcagatgattgatattattatcatcattgttttcattttaccaatgaggaaatggattcagagattaaacaccttgctctggatcaaacataactcttactctggaagccaaattcttagccacctcatggtgttgccctagtacctcaactgtattaatgcacttagtatagtcatgttatgcagaaaaaaggactctaagatggtggagggtctcagagccaagttatgtcactaatgaactacagatattcaatgtaaattcaggaagaaataagagaggtatgtaaactctcatgaatatttgaggtttgccatatcatggatgataataatcatgctgaagtattatttctgttagtattattattttaattattagcatttgaatccacaaaaagaagatagaatgaagtgtggtagatgtaacacattttaattcaatagtgagcatagttgaataactggcatagtgatacgactgatatgattcatctttactgctggtgactaggcagatagtagatgattatctgtctcgaatgctgttgaaaagtctaaaagtgctgagctaacttcttccaagtgttatgaatctatggaatttagtatagtgctcaacatttatcatgttgagaataagatttccattgacttgagaaaagtaaaacataatctataaggcaggaatatcagctgttgttattccctaaggtcaacttaaatgtaaacctctgatttacatagaacattaatatgtatgtatacatttttagaagcagatttgattgcagtcataaatttgctaaagtcctaaatgcattgttggcatccaaccatttactgttttggcataattattaatatacttactattattctgcctatgaatgtgaatgagtgtgatatcagaataattagaatgagtcatattataaatcctctgtccaactttgaattatattgtatgtatgcttgagcattatagatgtaaaaagtgacatgagttctacatggaatataatacaagtattacatcaagacattttcatgtagattattttagtagtcgtagaattttactacattgaaggaattgatattatgacatttttgataggcaaaccaagagtgaccctttcaaattgtacaatgtcaacttctatgaagaaagataattgaatattgttatttgttatttagaagattgaaaaatttcagtcatattgtcatagtctgttgattgattaagcctagccataagtctataacattcatttttatgttttgtctcttttgtatggttatgtggaatcgatgctattactttgacctccaatatttaattcaacaagcagaaatataaccttttcacttgacaaaacccacttattttgcttgagaaattataaaacaaaaccagcaggtgcctgagattcagtacttgaaattatcatttaaagcaaagtgtcttgtatggtttcaacattgttcactccattttctggcagctgacactcatttactctcaacaagtgaataagcagtcggtgagtgtccctgatgtcaaggagctgtcataatttccatggagttagctctgtttggcattacagaaattcactgtgatcctgctgacaactcttttgtatagtcataaagtatacagcagaacagtttgtcccagggctaaggtcaggctttttattttgctattatgagaaatcaataaatacacaatactatttatcttatttattctaaggaaggaggagaccaaggcatattttcctccttctaattcaaaatatttctaacattattattagattagtactgatgggtcagtcagtactacaggaaaacaaaatatgtagaaacagtgatagtctgtcaaagtttcgagctaatttcaaacagattgggtaacgtttgaatcttctatggaagcattccccaatgtttaatcttcaagatatctctgaatttatcttcatcagatgttggatatgtcccatgtgtccaatgatcacacttctgcttgacttccagccccagcccttgctcctctacctggagttgcttccacttcacacacgaatgggcatttaggctgccataacccaaactcaacgagcctaaaactagatgggccatcttttgtttttctttttaaaatttatgtttttattattattttttgagacagggtctttttctgtcacccagactggagtacagtggtgcaatcatggctcactgcattctcaatctcctgggctcaagcatttctcccacctaagcctgccaagtagctgggattacaggtgcatgcatcatatctcgctaattttttaaaatttttatagagttgggggtctcactatgttacctaggctggtctcgaatgcctgggctcaagcgatcctcctgcctctgccgcccaaagtgctgtgattacaaacatgagccaccgggcctggccttcaccatctttcttcttaaatcacttattaacttgggatttgtcacaattttatcatccaaacctaaaattttccctcatgtgcttccaaaatcttctgaatttacatattctcttaatattctccttcaagtttaccatgcctcagtccctttacttgctttaatggtatttattcctttcttcattttgtaaaaaggacacattcatttaaaggaagcagaaaatgcagaaagattaaaaggacataaaaaccccttgcaatgttatctatatttaagcattattaatatttggagctaaacttcatgttctccatcttttaatgttaaactaaacaaatactttataaagtatttcttgatcatggcagcaggatgcattctctttttcttgctgcctgtcaatatcacttgagtggcatatacagtcctattgaagatattcgtgcaaatatattgttcctttttccaggtttaaaactctttaaggccaaggcacatgcttatacatttctttgtttaagacagatctggtacagtgtataatgttaattcaatatttgttgaatgaatatgcttaataattcagatctatttgaattatcaccgtgaataaacaagtttaattctcttctatagaatgaaaatatgtgtgagtaagctggttaggaggaagtgaaattttttattcagttaataatgacaatacagattacatgcttcagtgaagcaaattcctttgtataaagtacaatacattgttgggttcacaattgcagagtcataagaaaatgtatttctcctcatatttctctcttacagaatgtaccattcaaaataattgatgtaagtataaagaattgtctttttgtgctactaaaatttccactacttattttcatttgtcttcccagcacttcttctgatcaattgtatatttttaaggcttttggtattcattgttgatattccatttcattttatatgttctatctctaacaatttcatcttttttgggggatgatctcccttttttctgtgtataattttaaatttcaaatttcactgtctcagcaacatgtagtgtacatacctcttactttctcctaaactagtcagattgcatcctattttttgcagaaataattcaaagtttttcctctttataaataaaattatttccaagttagggaaataaagacagaaatccagccatactaaataagtagtactatagaactgctttcccaagaccatgcatacttggagacactcaaggattatggcatttgtcagtccattttattactaggtctcaaaaatctcatttactatttcctacttcaaatgacccaagtttcttcacattgatcatctaagttttgcattctttggttagagtttcatcaaaaagcacctagtgttgcactcacatgcatcttattctgatgatcaggtggtattgttttgtcttcttctgtagtgagcattatcggtatttgcacccaccccatagctgcagtagtatttattcacatttctaattttaggattgtggaatttttttccatcacaaacaaataggattttatatttttcttccacatagtccaagggtcattctgaaaacaggatttctcatgtgtcaccccaatactgcactgttatagtattctgctgtgaatactgtgactactaattcactatatctacatttgaaaattgaaacatcagtctgtttgctgttcattttgtgacaaacttaaaacacttgagctttttgaaggtcttggtacatgaatttttatcatatacctaaaaacactcagatactactgctgagagattttgggccatggtagaggtgtttgtccaaaaatagaaaaaagtaattggttaagaaatatatacaagtaaacagaattatttctaggtaagttttattctactcaataatacaaaatgcactttgcatggcattgttgtgagatgtccattataggccttcctacatttgattagaaaaagttatcataattctagatagtataggaatcagctggagatttcttaggtctaactccagaccagtggttcacaaagcatgcttataagaccagaaacatcatcacctgagtacatggtagataagtaaataatggtctgcaccccagacacagcgaatcagaaactctgagggcagagctctgcaagctgtgattgaacaagtctcccaggtgagttccatgaacactaaaggctgaaactcggcgagaaccattgtttttaaccaattaaaatacaatcttcaggtgagtcatatacactgccaaaattgagaaagcttgagaatcaccgaataataataatcatcattttcaggtggtacttggtaaatttacaaacatgtaaacctgtgggatttgcctagccagtcacacatttattaggattattctcgtgtagtcgtctcctaggagagagcagagccctgggtgataggaaaggcttgaaacatgagcagcacccaaacagagtagttttggaagacttgacatggcaggaaaaaggtgcacatttgacaggtaaggagaacctgcatgttcggaacctaaatattactggctttgttgactttgtgtttgtgtgtgcaaatttggagtgcaatgggataatgctaaaaatgtggcaagaatgaaaatactagagcataatgtaggtagataatattaaggtcagaataaaggaaaaatatagggaattcagcattagtgaaagtagttaatttaatattctactatcatctcaaaatatgacaatattttaaatcccatttttgagacatgattgcactttcttcttaatagctcctcctctaataatcttgatttatatctatgcaaatctagacttctaatggttccggttgttttaaacatgtaatctggtctctgaactcaagtagttattctagatttagaaacagtgctagtcatctgttagcactttaacacgtaaacctatcctgaattggaatatgttttgaaaatgttccatccccagagtaattttgttcttgccttgagcccctggtgccccaatgctgtttatacattaatttagtctcttatatgcttaagaagaaagtatatgaatgcaaatgagaaagtcccaacctctgggatttgaatctgaaatttaaaacaagctaaaagagcatcagaaatggaagcaggattaccaataacatttatgatttaatgatttcaggaagcattaaaatgatagttgtgtatttataagcaaagccgtttatgtattttgcttttacttatttcatttttgagataaggcctcgctctgtcgccaaggctggggtgcagtggtgcaatcacagctcactcagcctctgcttcccttgctcagcttcctgagtagctagggctacaggcgaaccccattaggcccagctaatttttgctttatttttttgtcgatacagagtctcactatgttgcccagtctattctcaagcccctgggctcaaggaatcttcccccttcagcttcccaaagtgctgggattataggcgcgagccaccgcacctggtctattttgcttttaaagttaataaactactagtgttttagttggaaaaaaaattctctcatgttatttgtagaaatgctgtagaagaaaaaaatacataatattatataaaatttgctgccttttcacatgtgaaagtatttgaggtctaaaatcaggtatatctgagggcaaaaaggcaaagattcatggtcattgaaacaggaatcttaagagactgtatctacaaagaacatttcttgtatatgttgtagacactttagcagtaaaattttctattttgttctctgtctcttcagtgagaggtacccttattaaaactctgcaagggaatatataatttaaattacatattttggtataactttaggcaagctttatagtagtaatgcttttcacatgtattgtgccttcagactatcttgatattcaagtagatcagcttagcctggaaatccagtggaaatatggattgtccacaggccaaacagaaagtcttcttttgcaaaatcacatgcagacttttcaatattgaaaggatttgttcaaacttccagttctctgatgatatatacataacatataaaaggttatccttgtccatcgatgagtcaaggggataaatgtgtaactaacactatctacaataaaaatatttttgttacatcagattacagccccaagctttatttaaattgacaacaataggactcatgtaatagtgtcgtgaggattaaattagatttagaatctaaaaagtaaaaagagcctagaataatccctagtagatacgacaaacatttaataaaaatagttattactgttaacagatatgtgatttatattagtaatgtaaaatagcatactctctcatactcacatggaccttttttcttgttccatgcaatatgttaacagcaaaactagtttacaggtgagaatgacaagaagatgtgaaagattatttcagctttccctttctttaaaaagctagcatttcaagacataatttttttaaaaatgaaaattctaaattgttacttactttaaaagtatttaaaagagattctgccaatggtttaatataagaacaaaaaggagtatttttcaggaaatcaagccagagattatgagtatccattcttgttggcagaccttatttgcttattttaaaggcagtgagcaaaagatgtagaactccaagagacagacgttgattagaagtttttctttaagatgtcatttttattttctgaaaaagcatttatttttaaaacttggcacggattattaagacgggtacagcttaaatttcccattaaaaaatcatatgtcattcccaaacctgttcatatacacagagaaaaatacttaggtatgtactcattactttggcctttccttaatctgaaaaatttttttataaaactgagtatttttgtgatgttgctccatcagctcatttaaaaactactatatgatcttgttcaatgttgtttaatcttaggaccactttgtttcacttatagctctaacatctgtcttttttttttttttttgccacaaactcttttgtttctgtgtttagtagctatccatgctttttgtcctcccactcactaccaattgctctcaatatgatgacaatttaagagaattgtagcaagctaattgtcttccttatattttccctatctatagatttgtttactcaaggagctctatgagaagtgtcaggcatttgcagagacaaattgtcttggttgcatccaccactgttaaaacctccaatgtcacagggagacttgtctgtaatttctagagtcactactggaagtctttttatgaacacaggtcatcattgtggccacacaaaggctctggcactaaagaactctgatagacaatctataagaatgaagcttacattttggctaacagtcctttaatttcttatctccaaattttaagaaaattaagtcttcatgatttattcatcatacataacattttgttcatttgactttcatggtgatttttgattatagtaaaatccaacattcctatagaaatataattcaattaacatgtgttctaaaatattctaccatctacattattgagtaaacaaagataaatacattttatttaatccagtgtgtcgaaagagtaaaaaaagataaaattaatttattttatttaatccaaaaatatgatttttacatctgttcaatatgagaactataggtaggatgttggacatattttttaaattaacgattccagtgtgaagtgtattttatacttgcaacacagcttagtttgaactagctacatttcaaatgcttgatagtaacagtgacctatgactaccatattggacaccgtgggaatcaattccaaaataaaaagtataaattacatgatctttaagtgttctttcagcttttctttcacagttttctgttgagtgatttctatacctctaaactacgtgttccaagaaacaagtagaaagtgaatatatccttgaaatatttagcagtaaataaaaataagtaatttattatttcttatcattgactgttttgggaaggaattcactaagtagaccctttatcatattatcatcaaggaatactacttatttcttggttactactatctctttgatacatttaaatacattattaagcttttattatgacccgtgagtcctatttaatttttaagcaatgcatttgtagaattcctctggttttactagagttaaccttttattttctgctaatgacttaaaactcctcttagaaatgtatttaaatgctcacgtgtacaaaagggaaattgactaataactgattaagttatgcacaatattttatgtgtaagctttatttttataaatcgtgtttatggtcttcctaaataagcagttaaggaaatacatataaatgttagtaaactatcaattatactgatactatacatgaattagacaaagttaaaaaatttagaaaatttttcaacctggcatataacatgtgtccaccttgaatataacaaatccagagacacaagaaaaagccaaatacagagaatatgattctttggttatgagcatgaagcggtgctgcagtgtttggggaaaagggccacaatcatgtctgctggggattcaccctgtaattatatcaccatccagctgaatgcaaacctgcagggaaaatggttaaggtagtcttgtcaaatgttgtgcttgcaatctgtttctctgcatgctgacaagaaggcaataaagtcaaagacaactacacaactaatgtatactggagaagaaaactaggctcagttgcaatgtactgtaacaattttgaagttatatagtaccactaacttgagtgacctagaaaaattgaagttcaagatggtagcattatataaaccagtgaatcgtgtcattaccgtatggatacaaaagtggattatttattttaaatattctattcagttatctgcgtatatctatcctgcatatatccatatttcacagactgcaagaatacatataataaaagaaggcaaaaaaaagcttttgaaaaaagaaaatatactgggaaatgtaattttaattctgtaaattgtaaaatactaatcttggtgatttgggggaaggagagctgatggaaatgaccaacaaaagttgaccctttgctaaataatgaaattgtatcctctgcctagcttacttgatctcttttagtcagcacagctgtgtgctattaatattttctcttataaggaccctgagcctgaaaaaaattaagttgcacagtacacaatcattaaactaaaaagctagatctatctaactgcaaagctcacattgtttacaagttacttgaaagtctagaaaattcagttctgagtcttgccagttatgtccccaaacaggaatttgacccattggactcccttgtgaatcactagattaaccaatgtgcttattagagcccttcagaagggccaagacatttcttcctgtgaaataaatatggaaacaagatattaaatatcttctgtgtttcagaggaaaagtcatgctcagatattaaatacatacaaaaatgtagcaatgaaataattggttgcaggtgctgttggtgactcacccatatctcatcaacacacatcactcttgtgcattccaactggaagcacctgagactctttctgaaggcttttctggccaaggtgtctggctcaactgaagggcaaatggaaatgcatgcattcatatcacctgggagcagccctgaatcaatgactggcagctttgtggatcaatatcctagttcctttgttccttggtggggagaaacctgagacacagtatacattgcttctcaaagttgagcagtggtgttgggttccaaagatcttcatgtgctacggtggtagtctgctcaacatctcaacatcgtactgattccttgtccccttgggatcataccagtgcttcccttggaacatctctccccacataatattaatactcacgtatttgctcaagttcttctgggagaatttaatgtaatctgtaattccagtgctggaagttagaattttagtatgacaatggtaatcctttaaactttcacaaaacaccactgctccatttgtttttttcctattgcagtaaaatatagaaagagaatctagaaggaagagcacaaagtctataaaaataagaggggatgagagagaaacaggaaagagaaatgaaacgggagttgagaaaaggagggaatcacaactcgggagcagaaatgagtaaaatgtgagcaaagcaaaggatcacggtgaggggaacattttccagaggattcttttgaaacgacttgctggaaatttggaaaatgagcaacagtaatgtcaaatactatagctctttgaaagagagagatgaatgaataaataaaaaatatttatttgttcaggcggaagaatctggacaaataagtgaaatttgcagtgaggatgatgattgttcaatatgaggatggcctttctaaccgaaaccatcttctagggtaaagctacctcttcgtcacttaaccccagcttcaatgaagttgttcagatggttggtgtttctgagatttggtttattactcattatccaataaacctgtgaatttatagtcaaaaaaaagctgatggtgggcagacattgcttaatgatcagctagtatctgcatacctgcttaataccctgtaacatgattttgtctgaaaacacctagtttcccagactagcgtctcttctaatgtcaactttcccactgcactgccaacgcaggcccattcattcaaaatttaagagacatttgtagcattccttttctgtatcgggtttgctcaatctcactgagaggagtcgagatctctacacaattatctcttataatgaaacatgcattgatgagattagatacagtttattccatagaaaaaaaacctaaagttgctgtaaaatgtgtttagttattgtgaatcctttctagttggttataattacgtgattggatgtaatagaaaaagtgtgtattccaggaaacctggtttttttgtttgtttgtttgttttgagacggagtctcgctctgtcgcccaggctggagtgcagtggcgcgatctccgctcgctgcaagttctgcctcccgggttcacgccattctcctgcctcagcctcccgagtagctgggatggaaacctgtatttttgtcttatcttgaactatacctaacaggttaaccttggaaagtcatctagctctggaggaccaaagtttctttgtctataacatgagcttgaacaaaatctccaaattccactacctttggttcatgaatagactacaaagatgtgattcaaatgtgttggaactgaatgcaaaaatttgtgagcctgtgcatttttctgcgagagggaacatagttttaatcaaattctcagactgttatttgaaacattttaagaaatgctgaattgtactaccttgaagatcttactttttctgaaatactttgattcataattctatgactcattacctctttggcaatttcgaatagccatttctaggaaataaacttcttccttaaataaatatcaaagttacactgatcttaaaataatggtttatctagccatgaagtatttcacatctaaaagaaccgtttacgtttttggccaattaaaattgatacatcaaatgttagaaaaaactgaaactgtgggctgaattacacaataaaatttcaagaaatgtagaattttgaaacagtaatagtgactaaagtgaaacaaaatatttttttaaaatatctcataaaagtcaagtctgaaacgtaaaatttctcaggtcctgcataatgtaaaacggcttaataaaagcagcaaatataaaatgactatgataaaatactcaaaaaatggatgttgtcttttgtgagtgtactgcctcaattcatatgtatatgcctgatttaaaataatatatatttggattttattggtgtgatggttttatttggtttgcttttcttgtataatccttagggttaattttttaaaaaaagtaaagaaaaataaagaaaattggagtaataaaaaccctttaggaagtagtttgttagatattcatcattccttgaatcttcaaattcactgctcagcgtggggtagacatcctgcctcactgaacgttcaattactttatgggctacagctcagaaggcgaatcacctttttcataagctgcttgttgagagaagcttgaaaaggatgatattgtgtggaggttcaatacctttgaatctcatagtaaaattacaaaattattgttgatttacataagcatgttatttatctcaaactactcaccagttaagttgagactcattaattgtacattttagggtattatttcatgagattaatgaaattagcgattacaatacgttttatttttaggatgctttcaaattatttacaacctatctgtattacactacaatcatgtctaagagaggaatattgccataattttggggaagactgttcctatgatgatgaatgagtgtatttttcaaaatccaaaggacaattgactgatttctaaaattcaatcctagggtaacaaagaaactctgcacttataagcattgcatatttgttttaaattataagagcagaatgttagttcatttaatgagtatatatatttgactttaatcttgttttgttgaaaataatgcataaacgttaatggaaaataactgaaaccaaagaagggaaaggtagttgtgtcaaacaccatataaaaagataaatatggctgggcatggtggctcacgcctgtaatcccagcactttgggaggccgagacaggcggataacctgaggtcaggagttcaagaccagcctggccaacatggtgaaaccctgtccctactaaagatacaaaaattagccgggcgtggtggtgggggcctataatcccagctactcgggaggctgaggtaggagaatcgcttgaacccaggagggaggcagaggttgcagtgagccaagattgtgacattgcactccagcctggaggacaagagtgagacttcatctcaaaaaaaaaaaaaagtgaaatttctaaaataataaaaaagtcactttaaaaaatcttaaaatatgaaaatgacatgaaatttatagaagtgttgttcatttttatatgtaagcagagaatagtgtgtaatatttaaattctttccctaattttttaatattctttacaacatttgttaaatataaggtatattaaacccaaatggtgaattaaactcaaactcaagacactacatgaagaaaaatattccatcttcattatcactatccattttctgtaacattcagagtagttgaaaacttactttactaaagagaggtgggagagggttaaaatttgttattaatattaactgcctatatgagttttgtgttcctttaactttgttgaatttaattattcaagtaaaagtagtctattcaatcattaattgtatgcaattctattatgttataaactagagtatttgaattcctaattcttccctctgaaaatagtaatataagaattttatatgacataatttgataaggatctgtgactataataaattataaatccaggtgtctattcagttttagacttctgacctcaagcgtgtgaaacaagtgggtatgtaaggagagatcacatcattcacggcatttgcattttatatgtcctcaaaagttttcttctaaaactgactgttttgctaattttgtagtaattttattctagatttgttcagttttgataggttttctccattcactgccaacatccatttgagtattcgaatactatgtagatgtatttttagtaaaatatgtttcatttttataattggatccacacagtgctggagaattctacgtgttaaagatgtataaaaataaaacttatttaaaaattaaatgtaaacttacgttctcacaacagagtaactagtatttcaaaaatgttcatatagccttgcaaatagttgaaaatatatatttagaatttagacatttttattcatcttaacagttctgttcactgggatgcttttccacaatactcttaagtcattgttgtaactgaaaatgatcaagagtaatcatttagcgaagactttgagttgtctccataaaagaacttaagcagggagaatgatactccctgcatttttcctgcagatgacattgcatataaatgacacctgccgaatcatgccaagacatacaatctcatcgtgaccatggaagctcatggctaacggtgctgcctgctagttgatccaaaaagttgggttcctgccagagatgtagagcaatgcagtacattgataattactagctagctctttcacctctcttcccataaatgttaatgatagccttgaaatcccaaagcatttctttaacatttctattctttttgtgcaaaattgtgactgagggaggttaatcagtattgccaaggagactaatggtggaagtttctgctatgactcttatctccagttcataaaatacagagaatgttttttagatatataacacctttagccttttttaagtccttaaagttggatcccttatatcccacatgtattatgcaacatttagctgtgaatatgcaggagatattagacttgacataacagaaaacaatgtttgatgatccagtgagagtacatatgagagaattttgaaaatggtaggactgttcattattattaatgttgttgctatgtgtgctcaccccctccaagtcctttctgcttttttactttctttcttgtaattaaattgaataattttaaaaatattttgaaaccaagtaattctaaatatcatgtggcaagagaagaggaaataaagtgaccttttaacaattgggaattataaaatttgtaatatttatcttctccattaattatatcatcttatggttttctttcttatagagctttcctcatttagctacattgaaccgggacatatccatatatcgatctcaactttagccgaattttcttagcaaatgccgagctagagcgaaatttaagaaggcatagtgataaggaaccgtatccctacccccattttgttatatgctaacataaggtcttgctgcctcatttttaaataaacatttttattttagaatacatttagatttacagaaaagttggggagagaatatagagttcacattcccgttatcaccgacaaccagtttcccctattaactttttaccttaatgtgctaacatttgtcataattagtgagccaatatgcatatattaagcctaatgttcattgagattttcttaggttttacctttagtccttggctttcttttttggttccagaatccaatctagctcaccatattacatttggtcattatgcctccttaggattctcttggctatgactgtttctcagactttacttacttataatgactttgacagttttgaggagtactagtcaggtattttgcagaatgttcatcaactgggattgacctaatgtttttctcatgattagactggcattataggttttagagaagaagatcacagatgtgtcattctcaccacattctatctaggatacacactagcaacacgacttgtcactgttgatgttgatcttgattacctggctaaagtaggatttgttagttttctctactgcagtgcagactctttccatactgtagtattgggaaggaagtccctatgtgcagttcacatgtaaggctattatgtctgcctctttgagggcacagtgttgacataaattattctacatgggccatgtataaaattttattattcctccccatttattcaatcatttacattattatggacacatgaaatttgattttatcataatttggattatattctaatagtaccttgtttctctttttaatcaaataatttcagctctggccactggaaactctttcagttgccctgtgtcctttgacacacctgcatcactacagagtttttgaaaagcatttctttattttctggcattacaacttgcatcactgttatgtatgtgtatatatatatatacacacacgtatatatatatacacacacgtatatatatacacatatatacatatatatacacacatatacacgtgtgtgtgtatatatatatgtgtgtgtatatctatctatctatctatctatctatctatctatctatatatatatatgttttagcttgtatattttttgctccagtcttagaatcaaccttctaaggaatcctggtttttgttgttgttgggtaatggtacttaccagaaaccagtatctggatgctatgtatgctcattgatagtggaatataattgtgcaaggggatatatgtgtttctactaagccatgtatatatgcatatctataaatttctatatctgtgtcttcatatctgtttgtatgtatattcatctgtatgtatatttaacttaatgtgtgttcatattgatgtatccaactataatcaactataatcaattaccatgtcaatcattctaaccttctccccttgctatttgtaacttcccaccccaatagtaataaacgtggatcccaggctgggcgcagtggctcatgcctgtaatcctagcactttgggaggccgaggcaggcggatcacctgaggtcaggagttcgagaccagcctgaccaatatggtgaaaccctgtctctactaaaattacaaaaattagccgggcatggtggcctgtacctgtagtcccagctactcaggaggctgagacaggagaattgcttgaactcggccagcggaggttgcagtgagctgagatcatgccattgcactctagcctggacaacagagcgagactccatctcaaaaaaaaaaaagaaaaaagaaaaaagaaaaaaaaaaacctgtatcctaccattgccatcaatttaattacttgttaaattcttgttatcatgtatgggagtttcagaattgttagtggtagccccctggagaataactttgtcaaacagagaacaggatttatgtgcaatgactctagtcttgcaaactctatttccaaagttgcctaggttagcatcacccctctcccctgccaccacataagtgaggttttgttacattttcatatggttagattatttttttcacattctgccttctgacatgtgatcctgacttcctgcatacgttttaaagcgtttttcatatattaaggttttctcttctgtatagttctatgggttttgacaattgcataatatatattcaccattatggtatcatatagaatagttccaatgccctaaaaaaatgccctgtgctttgcccactcaactctctctacagaaaaccctgcaactaataggtgtaccctctctgtagttttgtctgttccagaatgtcatataaatataatgataaaatacttaactttcacagataggcttctttcacttagtaatatgtatttaacattcattcttgtctttgcatggcttttagcttatatttttaagttcattatatagttgtatcacagtttatccattcacctactgacattttggttgtttccagtttttgcaaattacaaatgaagctgttattaatgttcatgggctgtgtgtgtgtacataagttttcaattcagttgagtaaatacctagcattttaattgtgggtcttatagtgagaccatatttaactttttaagaaactgctaaattgtcttgcaaggtggttgtgggaatgcaaaacggcacagctactttataagacaaattgaatgtaagttcttgttactttgtgttctcactgagaataatattcttagttttgtggatgttcgccattctagtagttccgtagtgccaccacatagttgttttaatgtgctctaacttaatggcaaatatgttgtgtattgttaatatatgtttacttgtcatctctatatcatttttgataccgtgtctttttgattatttaataaatagcccaatttagtaattgggctattttcttaaggctgggtttcaagagttctttatttaatttggatatatgtaccttatagaatatgtcttgcaaatattttctcccaggccatgctttgtctgttaattcttttaagtgtcttttgaagagcaaatattttaaactttaataacgtccaagatcaattttttatggataaaggcttgtgtgtacctaaaaacttttctctaaatccaagagaaaatccattttattctaagtatagttttttaaattttacatttagaactatgatccattttgagttaattcttgcacaagacatatagttggtgtctgttatttttattttaatatgtgaatgctcagcattattactttttttatcaacatttcaacaaagcagaaagattatcctctcttcatttcaaatgcctttgttaaatattaattttgtttgtgtgggtttattttactggttttctactctcttccattttctattcctctgccaatccctcatagttttgatgactgtagctttatttgtcttggaatacagtagcatgagtccttcagtttgttcttttttcagtattgtagctatttcatgtctctttccttgccatataagttttagacatggtttgttaatatcagtaagatagcttgctgagagtttgattgggattgtgttgaatctataggtcagtgtagaaagaattgacatttagaagtattgagtcttccaagtcataaacctggaagatatttccaacaccctcttctttttaccctgagaaataacaaaatagtgatatttttaacatgttttcctcattaaatatgtcttataaattatgtaggtccagaagacaaaaaagaaaaataatctccatccaacaaacagcatagattaagattaaatagatatacaagtatctgggtcttgccaattaggttttcaagtgcattcatacaagaaatttactggaacacattttgatatatattaattataaggctgctttaatattatagatggcatagaaattaaaattcattgtgcagaagattgacacatatggtcagagaggaaaggagactcagggagcagcacattattaattagaagatgggggaggataaacataagactctctggagaaaaaattaaggacatgagacaagaaataacctgaatctgttttgaagggatagagatgcataaaaggactggggtattagaaaagactactttgaaaaaaatgagagttttgagttatgagaccagaaatgaatggcttagaaaggcatcctcttctacccacaaattatacttgaaaaataataatcaaaatatcatatgttttaaaaataaaacacaggcttattatttgaatctcaaaatttattttcaaattaacaaactagtatttgtctgtgagttacaaattctatacatttgaccaagttccatttacagagtgaaggcagattttcttcttaataaaagacgcattttaagaattctgaaatgtaattgaaagaaaagactggcaaagacatatgaggacacaaatattccaaacaattatttggttgttaacatgccaacaaaaggttggttttcaaaagaccatgtttttttaatttcagaaaaatacggtttcagtaattctcataagtaattcagcgatgagctatcagctaccggtaatgaattctcctacaaaggaataatttattcccagtgtactcacacaagctgggatgttaccaggaacttgaagctgtaaaagaaccctatcttattagctacaatgcctcactcataatacatacctcatgagttacatattaaatgatcagaggttatttatcttcatacactagtttggaaatggatgaatcatttctcatttcttctgaaagacatacattgtgcttttgctcaaatttcaatttcagagcttcaaacttgtgatacttatctaaatgaaggattagactcacatttgcacacacacaaagcacaaaacaagtgaactaccatatctaaaggcaatagatattacaatgaaacacattaacaataatgtttacttttctaaaaatgttcagttatatattaaagcaaaatggtatttcaccctaattctatgcaaatgtttttgttaaggcattcagttgcttaattaatggtattgaattttaaaaaatctattggtttgcaaatcaggttcttacgcttgtatctatcattctgttctgagagggttgatttatgggtacctataaataaaacagaaatctaaaaaatttagtgagtggagcccagcatgcttcaaaatggaagttgaaacaccaccgtatactatgatcaaatatgttgacttagagttactaattttactttaggcttgataagaaaggattgtgtgtaatctgaatacttactggtagtgagcatatgattgtgtgcctgtaaatacagaatatcattgataatggaaactcaatgtatccaatgcttagttatttacacaaaatacatcaactcatcatgaattaaagactagatcaaagtcataaaaagtaaaaagatacaaaagaaaaatgcatttttcttagataatatcttcattaaaataatagttaaaaattagtggggcttaaatttattgctgtgtattggggcttgtggtgttctttatgtgtacttcaccccatttaacctgaataacaacatgctagttataacctcatagctttaaaatggaggccattctgaaggcctaacttcattgggtcatctctaatataacattgcttcttttgtaattccagcctcatttttctttatttctgtattagcccattttcacatttctgataaagacatacccaagactgggaagaaaaagaggtttaatggatttacagttccagatggctggggaggcctcacaatcatgacagaaggccaggaggagcaagtcacatcttacatggatggcagcaggcaaagggagagcttgtacagggaaactcccatgttttaaaccatcagatcttgtgagactcattcactctcatgagaacagtacaggagagaccagccccataattcagtcacctcccaccatcttccttccacgacatgtgagaattgtgggagttaaaattcaagatgagatttgggtggggacacagccaaaccatatgactttcctaaactgactgcttgatatttgtatgcattatgtatgaaaatacgtattacttcatgtaaaatgaaagctgtttgattatgctaaagaaaacaattttgtactgtatctagaaaagaaaatgtttaattggtcagcattaaaagaatgagtaaaatcccaaatcaaagtttagaatatactaaatgtaataattacctccttatatcattctcttgtaatgtctagttcttcaaaaagctttataggaaatggacgtaggtactattgagagtagaattttaattttaactcagggaacttaaaacttttatgtaatgaccttcacagtatacattttgcaacctgttattttagggcattatcaatttctcagatcaaagtttgaattacagttataatattctgttcaccaacttccttatttaggtacaaaaggtttaaaagatctaaaatataaatgcatgaaaatttagaaaactgtttttctcctcaaggaagcaccaaaatggaaaaaataatgacactggttactactttcttcttttatataactcagttggttttaagtttcagcttcaattcctcagttttgttctatttggtttgggaaagtggtacattatgtatatacaaatttatgtgtgtttgccaatgagtgtgtggtcacgtatatctttgtgatttattatagtataattttacccagtttttccaaagatatatttaatagtactaaatagaaaatctatgatatccatacttgttcatatgggatatctttttccacttcctttaagcaggaagtaatttcttagactgaaatgagctttagaccattcctatcacctcagcatgcagacaatattggtccctcaagggaagataagttgctgataaatctgtagtataacattagagaactcaagagccacagtatcagattgtcccaacaaaattttagagcaccttgtttatcatatgcggaatctatgaaagctaatctaagagtagatagtagaatagtggttaccaggagctagagtagttgatcaaatgatataatattttaattaaatagagatgtttaagagatctattatacaccatggtgactatagttaacaatacattattgacaaatgctgagagtggatgtaaagtattgtcaatacaaaaataattatgtcaggtaatgcatatgttaaatagctgaatttagtcattcagaatgtttatatacttcaaaatataatgtggcatatagtaaatacatacaattttatgtcaattttaaaaaataaaaaaatgaaaaaagaaaactatgaacccttgagcactttagagagagtagaactttcctgttacattcataggatagtatttagagactgtacttcgatcaagtatatgagcacagaaggacctagtattaagagccccggagcaaaatagtcatctcacagaaactagatcaaagtgttaagaatcatttaagcagctacaaatacttcctgaaccatattttgcccacattacttgacggttattctttatgaattaatatggaaacttaaataacctactgcacactctatataacttattgtaaagaagtaagcatgtaaagtcatacgggctcaaactttcacgtacctgtgagatagtgttccactttatctaccaaaataatctttatttatgataatggttgatttcccttatcttttaggtcacaatacatgcttttgactaatgttatctgcttccatactcaacataattcagaaatgttcttcctaaaaaataacatgctgaatgtcatatgctccaaattgtgtgtaactttaaacaagttggcagagggctgcctcctacaagtctgtcccctggcagttacccctctcactcctcatcagccacacacatagaattacatactatttagaaacgggctaatgtaggcatgagaaatgtaatgtctttgtcataatatttgtcactacttttaataataacccttctaaaacttgtgcaggaagttaatacttttctttaaataaggtttattaaaatccattaaaaatgctataactttatcaaaaatatatcattttttaaaaatgtagaacagagcagttgaatagtttctctaggtgtcaaatttcaacaatatttgttattgccactatataaaatcttctaaataacagaatattttataccaaggaattatggcatatgatttcctgaaaatgaaattttccttgatgatttaacatttccaacaaccctgataatcatcatcaaatatatatttgttaggttattactagttactagaactataaactaggccgtatatttaaaaaacaattttcttcttgcagattatatgttacatggaaaatcccaaaactttatggcacactgtgcatgagtaataacaacaagaagaaactggaggcttatgttttgagactggttcacacagaaactgcaaataatagttaacatagggaatacggtgatgatgagttcattagggagaaataaatattgtattgcattagccttcatattttaggatggggtatacactggatagttaagaaattttattttataaaataaatttgaccatataatgcatagaatatggtgttcttttttttttaagttctggggtacatgtgcagaatgtgcagctttgttacctaggtggtttgctgcacctatcaacccgtcatctaggttttaagccctgtgtgcattaggtatttgtcctaatgctctccctcccctagcccctcattcctagacaggccccagcatatgatgttcccctacctgtgtccatgtgttctcattgttcaactcccactaatgagtgagaacatgtggtgtttggttttctgttcctgtgttagttttctgagaatgatggcttccagcttcatccatgtccctgcaaaggacatgaactcatccttttttacggctgcatagtattccatggtgcatatgtgccaccttttctttatccagtctatcattgatgggaatttgggttggttccaagtctttgctattgcaaatagcgctgtgataaacatgtgtgtgcatgtgtctttatagtagaatgatttataatcctttgggtatatacccagttatgatgctggaacaaatggtatttctggttttagattttgaggaatcaccacactgtcttccacaatggttgaactgatttacacccccactaacatggtaaaagcgttcctgtttctccacagcctcaacaacatctgttttttcctgactttttaataattgccattctgactggcatgagatcgtatctcactgtggtattaattttcatttctctaatgaccagtgatgatgagcaaaaatcacaagcattcccatgtaccaacaatagacaagcagagagccaaatcatgagtgatcacaattgctacaaagagaataaaatacctaggaatacaacttaaaagggatgtgaaagacctcttcaaggagtattacaaaccactgctcaaggaaataagagagaacacaaacaaatggaaaaaaaatccatgctcatagataggaagaatcaatattgtgaaaatggccatactgcccaaagtaatttacaggttcaatgttattcccatcaagctaccattgacttttttcacagaattagaaaaaaaactactttaaatttcatatggacaaaaaaagagcccatgtacccaagacaatcctaagcaaaaagaacaaagctggaggcatcatgctacctgacttcaaactacactacaaggctacagcaaccaatacagcatggtactggtaccaaaacagaaatatagaccaatggaacaggactgtgttcttaaaatatgaatttttcgactgcatttgaaaggaaaacaaatatttgaaatggtcaattgaaatcgaccacattgaaataatttaaagagggtgaaattaatatattcaaaaataaattctgccagaatcatagatgtttgggacccatttcatgtctgggcacctgttattatgggcatgcctcctacactgaactaaaatttacatccctgaaactccaaggctttcggttctgtcccaaggtaaatctacatcctcttccatgtgagagccttctgagtatttgatgaataccagtaagacaaatgaccccaggttcttcacttgttctttacaagagaagttttctggtctcttctgaattctggttagtcttctctaggttgcaaagatctttcgtaaagcaagagttctgaaaagatcaaattttatgtgtgataaaatggcacgctattggaccatactgagtctgctgtttaattttcaaccaattcttaaattatttccacagtgaactacatactggctggtatttttttaagaatctctcacttacatacaaactcactttaccaatctccaagttttaatgtcagtcaatactctcttttgttgttgttctcccaaatacaaatgttcaaaatcttactaatgtaactttcttcagtgcctgctcaaaggctcagaaatcactttttaaaatttactttttaagataaaaattgattaaaagtatatcatttactccaaccattcatatgatgtaattactatgtgttagagactttattagcaagagcatattctgcaaacaaggtagtctgggctttggtctcacaggagtgatgatggacatgtcactatgcgtctgtatgctttagtttcatcaaatgaaaatttagagagtttggttgtgtgaggaggaatgggtttgactgaatcaggaaaccttagtggattcttagtgattgtatttttcattggtaaattcccatgacctattcccaaagctattccagggattttaggatttgatataaaaaactacaattttcatttcatgtgaatatatttttgttattttacagtaagaaaatgttcatgttaaaactatatgagcaacataggacagcaaatgaatttttagtactaaatataaaatgcctcaaatatactggcatccaataataagattttaaaatatcagattttaaaatcgatttagacttaagtaacattggccatgtgttcaaaagatgggattttaatatacagactattgagatctaatacactatgaatatccaatgaatattttcaagttaattattcaaaaatcaacattttctgaacaaaaaaatgaaaaagataagttcttaaccataacgtagagtaacatttacaatccaaaaccttttgatctgaaatatcaaagattataaaaaatattagcctatatttgtagaggacataaactttttaaatataatttaagaatataaatttataaacaatcatgtagtcataaggaatttaaaattataatctatgaatactcatcaaaaatcacattagaatttataaagatcctgaatttatagtaaaagatttattgcttccatgaattagcaatttggctgagctaatttgtaaatgatgtggtcgcttgaaagactatacacaaaagaaaattggtaagcaaaaaaaaaaatacaaaatatcggaagaattactgaattgagagaatgaatgctctccacaatcaatgtcattaaaaaagcaactttctgaaataaaagagaactgtctacttttttctttgtcccttttttagtaagcagtttgcctctggtttaacaatatgaacatacttcctttcccagctggaggcatccgatcctgggaatattgatgtatgtacaccccgtagattatacttttcagactagatggatttctaaattcaagatctaccaaatacttccacaattctaattaaaataagaagtttgggagtcagaaaccttttgccctagaggcttgccccaccatgtattaattttcaccattattccatttaactggggttactcatttttatttcctaaaaaattctatatctggaaagaggtaccattctacagcatttctggcaaatcataaattaacctacagtaaatgacattaaggagatagctttgttctgtaaatggataggataccatatggctttgatgttagtgtgaagttaatcacaagctccataacaggccatgacatcatttcataataaattgcatgaacaaatgctgccgttatctgaacagcatgtgaattttggtacctataatctttagggaaaaatgaatataaaatattgagttaaaaaatagatataaggatggtaccatagcgtctccactaaaaatacaaaaaactagccgggcatgatggtgggcgcctgtagtcccagctacctcgggaggctgaggcaggagaatggcgtgaacccgggagacggagtctgcagtgagcttagatcgtgccactgcactccagcctgggcaacagagcgagactgcatctagagaaaaaaaaaaaaaaaaaaaaaaaacagaaacgtctaagttgcaggaagtcagtaggtgtacttttggagtcatcttaaaaagagacgatagacatttcttccatttctccctttgctgccatctggcaggcagcctacaatgtgattgatccagtaggaagagtaccctatgggccaatctatgagccctgctagctaccctggaaagaggctgaggtgccttttttcaagaccccaacactagctccacaccacccaaccacatcgtttaaatttcagttattttctggtacacactggtacacatttgccaattatgtacaaagactgtcaatgaaatcagctgttcactatgagattacagtgtggctattcttttgtaacaaagtacttgattatctagagtattttacttcaaaatatttctgaaaaccatacttccctgtgccgaatcctcagtcagaagagagctgacaatcaatacagaagtaacatattgttggaaagaataattagaacattaatgaaaactgatctcattcatttttcttaaaaatggaggaaataatgttttctgatttctctccatcattccaagtgcaaggtaccacgtaatttatatgtaattcaaacatcaatagagagattttttttatattgattgctcccactttagtagtgctctataaacaaataaagaaattaactgattttacccctgatcagatgatctttctttggagatgtgacatttaatctgattattcatgaatatgttaatgagagagttatcacatgccagtcattagacactgaatattaaaatgcaaccagtcatgcagtgttgatgacaagcttccttttccaatttgcaaggaaagaataagcaaacaagatgagtctaatctctgggttttgttactttttgtaaaatcttcagtggcacttatatgtgtcaagaaaaaaataatttcttaaaatcgcaaactcagggactgcaatgttttttgtcactcattccaattaaaccaatggcacttaaatttaacaggaatgagactttaataattaatagagtacagttgtgtgtttctaatatgcaagcaattccaagttgataaacagctttggattaccaaagtttactggtaaagctactgttaggaacttaaactagtcatgtattttctgtaagaaattactttgcaaagaatggtaggaaatcagagatttaatctcactccaccaagaccctctgagggcaaagaaaatgtgcgtccaggaataagcacaaggcctcaaacatagcacacacaaaataaagattagatgaaggaagaaaggaatgaaaaatacctggatgtgctatactagtagtgtataaaaatctaatcattatttaaactttgtttctatgtgaaaacttaatggaagattccatattggctctaagaaacacagcagctctcttcctacctgtctgccttagtaaccagcagtgagtgacacttttctcttacaaccagccagtggcctcaggatgctatgctagtaacaggagagcatgaaactcctgaagtgtcaggggctgtcatggctttgtgtggacattcttaggtgaggtacagcgatgacacatcgtagagaagaggaggtggggtagtcaatcgcctcagacactaaaccataaaacatctctgaaagtgtaaagcaaagaagaaaattgtattcatcagaattcttcttaaaagagaatactgggtgtattacaaggacctcttggttaagctgcatggggtagactgtaagaggcttttgtctgttccactcacagcaaagcccgtatgctccaggaattgttagtaattgctgtgtttgtttggtgaagtggatgatataagaagcagggagtgctgccttccggagtcctccttttctgcctttgttctcatccaggtgccaggactcatctctaaaaaaaaaaacagttgagaaaatatttagagtatcagtttgaaggggtttcaaattactctgctaagagcaccgaaatgcctgtctctagccaggagtcaataaatggggcaggaaaaaggagggactgttccagtggcaagtgaatggagccgcctaaagtattgcttgctcactttagcaaactgccttatagtattaaacagtacattatgagactgttttcaccaaacatcttgaacaacagacaggtgcatttttcctgttattaaaatgtgggtcataaaggcaaagctacagagacggaaaacagatcagtgaattccaggacacaaaagtaggggagaggtggactacagcggtgcccacaggaattctgggcagggcaggggggcggggggtgatgggattgtgctttatcttgaatgtgctggtgattaccaaacatatgcatttgtcaaaacttatggaactgtatgctaatcacagtgaattttatggcatgtaagttatattttaacttacgaatttttaaaaggcattatattattactctgaagattcagataaacatacacacacatatgaaattcaggaggtgttactagaaaaaaagcccagtttctccttatctaaaaaaattgccgaaatgggctatgattttttcaatatcttttccaatttttgcctcttataattctgtgtttaaataactaaagaaatctgaaattacttagcaactttgtactagcaatggtcattattttacaacctatgctcagatactaattaccttctcataattgtccagtatgcaactgagaaggtcaaccactaaaatcattttaatttcccttcagcttcactgattatttgtagagagcatttcgtttctaggtcaaatcgtcttaatacacacagatcactctggttgagccaaaccagattttcttcaaaagctctgacattgagaccctgctctggcatttcatttgtttgtatagaaaatgttaggcgtctctttgccaagtctaagctgtgattccaaaatcccctcataaccttgcttttcaactgtattccaaacatatataaaactgaaattgaccctacagtcattgccagaggcatacatagagagaaatgtacaatcacagtgtcattggacacacgcatataaattgcgtatctctaaacttcgcaaatctaatatggtattcacaatttgggcaataatgtcagcaacaaatttaattaaataaaaaccttgagagaaatagtggtttatttctgaaaaccaaatattgaaattttgctgagtggcttactttaaatgatcagaggaatgcttcataaattcttgcagtagcatcgtaagactttatgaccatagattctctgatacatttattgggacaccttgtaaaatagtgaagttgcagaaacacaaaggcatagtttttaatttcacatttttcaatacatattacacatgaaaactaaagttttaattaaacaaaggaagtcttaagtttgcattttatacattgattgacaagatatctcttaacataacatgcatagccaagttccttgtgtcacttgctttgcttttttcattcttccttaatttttactaggattttattttctatttctttttcaacaggaagctctgaagccaccacctagttcacttcaatagttatgtgcttttctacgtttcaccacaattttctcagtagttcagacgtatcactcttgctcgatattgattgagttatataatcactattagcaaatgctctttgatttgatcctttctaatgtgtattttctcagggacaggaccagttttgaagttgaacacacactggtgtgtaatgtgcatgtacagagtgcctctgaactatgcagagtaggaattgattcctaaaccccacataaatgtaactcagactggtttagaaaggctattggatttgaaatggcaaaatactaagatatgggaaaaaataagataccagtttaattttaaaatcagtattaatcatgtttaccttattcttgattttttaaaggaacaaaaaccaacatatatgttatttgatttgtacaaatttgtattattctatataacatccatatatattgtccataaccatgtgatcacatagtgtgtctataaggaccttgtatctagtcatatgtgcacctgttgcagtaacccatgctgtgtaggcaggttctatgacaattcaaatcagttctagtgataaatcaaacctgttggttgcttttattgaatgttgttctatttctgtctgtaagcgtatagccaggttaagagaaactgactgaactaaaggggcgcttatgactattccctaatgatatcacatccaaaacaatgaactgacagtgacttaaattattaagcattaggagaaatccctgtatccctgcagtgttcagttccttgaggctctgacaaatgacctccagtttgttggacaaagtaggcgggatatgaaggcagctcttatacacatactttattttggctggggcaagtatcactggatatctcatttggtagcatattaaaatatgcagatcttcatggatcagacaatattattaaaacagtttaatacagtcaggtgtttcttttttttttttttttttttttctttgagatggagtctcactctgttgcccaggctggagtacagtggttcgatttcggctcactgcaagttcctcctcccgggttcacgccattctcctgcctcagcctcccgagtagctgggactacaggcacccgccaccacacctggctaatttttttgtatttttagtagagacggggtttcaccgtgttagccaggatggtcttgatctcctgacctcgtgatccacccgcctcggcctcccaaagtgttgggattacaggcttgagccaccgcgcccggccaggtgtttcttaacgatgggaatgttgtgagaaatgtgattctaggtgattttgtcattgtacaaaaatcacagagtgtaattccaaaacctagatggcggatcctactatacacctaaggctgtatggtataacctatggttccaaggctacaaacctatataacatacagctgtactaatgctgtaggcaattgtaacactatggtaagtatttgtgtgtcaaaacttatctaaaatagaaaaggtacagtaaaaatatggtaggattatcttatgaaaccaccattgcatatgtgaagcatagttgactgaaacatcattaggcagcgtaggctgtatgcctcaggtgccaattatgtgattccatctgatagcaactatatgaatattatatatttgagactaaaaggctaacataccaatttattttgtatgcagcttttaaaattcatgctatttttacttgtaaaagttctgttcactactttaaaagctgaagcacattaccggaaaaagcatgatgtgacatcgttctctactataaagaaaacacctgataaccaataactttcaaggaacacacaccccatgccacatcctatgcattctaaccattttacaagcattatctcatctcatggaatccccacaagtatcatgtaagatagattctctgattattcccattttatgggggaggaaaccgtacttcagaaggttaaataaaacttgcttgagtgtaaaatatattttcttacctctcactaccatttactatgatacatttactaaggatttattaccctctgaacaggagccttgtgatctcacatttcccaacccctcctccagggagtggagttgatctgagtattcagaagtaaaaatgacagtagttagcaattgctgagaattgtccatgtgccaggcactgtggtcaacacttacaggtattatctcatataataatcagaatctatcaaagacataggtcaattattatcacagttttagtagacaaggacactgaaacttataaaggttaaaagtctttgtccacatcacagctaagaagtggcagagtccgaagaagagggaaggcagtctgactgcatggcctgttctagtaactattatgaaatagccaacggcacccaagacttagtagcttttgaagcttcaccattgaggatgtgcatttttaaagatggggtcagagtataaggaagtcttcctggtcctccttaagttccacggcagggtgcctgcctgtgtactctacctacctgttctaattctggggattatcaggagaagaaacaagaaagctataaaagccttagcttctcatgaaatatcttagcaaaacatttttatgtgaaaaatgtatgccaccttttatgtttatggccttgttttattattttcttcttttggaatatttctttctggagtttacaaaggaattatactgaacgctgatgtgaatcccaaaggaaagatacgtttcttctctaatgttctcaaatgtcaggaaatcatttagagagtgaatgtctttggtggctggttctaatttgcactgttgtttgataatgtgcacactggagatcaattgtctgaagatctccttagggctagaaggtcatctttggtgaattagcctgatgcctcattaaagatatgtcaattctcctttttccttgcaatgtgtagagtatgctctctaagtggagtggcaaaatgtacatgaggagggaaatttagcaaattagtttaatgagaattattgtgtttatttggagacttcgatttgattgaaagaggattttactattgggcttcctttttggcgaaggttatccgtagcacctactgtaattgcttcctgtaaaagagtcagtatccatgcagttgcactaatgtgctcttgtttggtgcatttttctcttctttaatataaagcatcttgactgcgaaaattttaaactccagtgtttgaaggatgaattgatgttgattttctgcaaaggaaaataataaatagacttggagaaaggaaaaggaaacaaatctcactgttagaggtaatgtggaaagaataataaacaaatgtaaggaagacaacatctgcgaacagggtctatctattaatgcttgttagggagaaaatgcctaaaatgtgaataagtaaaagcctaacaagaaataaggtatagcagccttccaatagtttgcaattgaaaagagacaaacttgtccaggcacggtggctcgtgcctataatcccagcactttgggaggctgaggtgggcggatcacaaggtcaggagatcgaggccatcctggctaacactgtgaaaccccgtctttactaaaaatacaaaaaaattagccaggcatggtggcgggggcctgtagtcccagctacttgggaggctgaggcaggagaatggcgtgaacccagaggcggagcttgcagtgagccgagatcgcaccactgcactccagcctgaggaacagagcgagactccgtctcaaaaaaataaataaaaatacataaataaattaaaaagagacgaacttcttccagaagcagaaaatcaaatacttgggcaggtttctaataatttataagagaagaacatattttatgttaattataatgtaggccatattttataagaagtagctggacagttaattctgtttcagttctttttcctctttggatttctttgcttctaatttatttttctgtttctatgattatttctctcagcttcaatctttagctctttctactctttaatctctggttatgtggggtaatggaaggcaggtgctggtgtgacagtggcccagtatcatgacattctgatagattgtattccctttgatctctacttaagagtttcatgcaggtgtttcggaggagagagaaaaaaatgtttttcctgacatttttgtcactgcagagagaattacagttttacaactatcatagagattcagaacagatgaatatatgtctatcagtgagcatattaaaacctaatattttgtgggtttgttgttattatttgcaaacttggcacagtaattgtgaagacaaaaattgttcttcaggctttgtgagtcagattaaaaaaagttttaaaattagcactagtttgtaaatgagaacattcaagaaaagaacatgaaacaaaatatatgaccttaaattatgtataattgaagagaacttttaggttggtgaagctatacttactgttttttaaagaaaaaagcttatcataacttatttaaaagacaaattttgttttgttttgttttggttttttatttttttattttttatttttattttttaattttattattatactttaagttttagggtacatgtgcacaatgtgcaggttagttacatatgtatacatgtgccatgctggtgcactgcacccattaactcatcatttagcattaggtatatctcctaaagctatccctcccccctccccccaccccacaacagtccacagagtgtgatgttccccttcctgtgtccatgtgttctcattcttcaattcccacctatgagtgagaatatgcagtgtttggttttttgttcttgcgatagtttactgagaatgatgatttccaatttcatccatgtccctacaaaggacatgaactcatcatttcttatggctgcatggtattccatggtgtatacgtgccacattttcttcatccagtctatcattgttggacatttgggttggttccaagtctttgctattgtgaatagtgccgcaataaacatacgtgtgcatgtgtctttataacagcatgatttatagtcctttgggtatatacccagtaatgggatggctgggtcaaatggtatttctagttctagatctctgaggaattgccacactgacttccacaatggttgaactagtttgcagtcccaccaacagtgtaaaagtgttcctatttctccacatcctctccagcacctgttgtttcctgactttttaatgattgccattctaactggtgtgagatggtatctcgttgtggttttgatttgcatttctctgatggccagtgatgaagagcattgtttcatgtgttttttggctgcataaatgtcttcttttgagaagtgtctgttcatgtcctttgcccactttttgatggggttttttgtttttttcttgtaaatttgtttgagttcattgtagattctggatattagccctttgtcagatgagtaggttgggaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtcttgaatccatcttgaattaatttttgtataaggtgtaaggaagggatccagtttcagctttctacatatggctagccagttttcccagcaccatttattaaatagggaatcctttccccattgtttgtttttctcaggtttgtcaaagatcagatagttgtagatatgcagcgttatttctgagggctgtgttctgttccattgatctatatctctgttttggtaccagtaccatgctgttttggttactgtagccttgtagtatagtttgaagtcaggtagcgtgatgcctccagctttgttcttttggcttagggttgacttggcgatgcaggctctttttttggttccatatgaactttaaaatagttttttccaattctgtgaagaaagtcattggtagcttgatggggatggcattgaatctataaattaccttgggcagtatggccattttcatgatattgattcttcctacccatgagtatggaatgttcttccatttgtttgtatcctcttttatttccttgagcagtggtttgtagttctccttgaagaggtccttcacgtctcttgtaagttggattcctaggtattttattctctttgaagcaattgtgaatgggagttcactcatgatttagctctctgttggtctgttattggtgtataagaaagcttgtgatttttgtagattgattttgtatcctgagactttgctgaagttgcttatcagtttaaggagattttgggctgaaacaatggggttttctagatatacaatcatgtcgtctgcaaacagggacaattcgacttcctcttttcctaattgaataccctttatttccttctcctgcctaattgccctggccagaacactatgttgaataggagtggtgagagagggcatccctgtcttgtgcccgttttcaaagggaatgcttccagtttttgcccattcagtatgatattggctgtgggtttgtcatagacagctcttattattttgagatatgtcccatcaatacctaatttatggagagtttttagcatgaagggttgttgaattttgtcaaaggcctgttctgcatctattgagataatcatgtggtttttgtctttggttctgtttatatgctggattacatttattgatttgcgtatgttgaaccagccttgcatcccagggatgaagccctcttgatcatggtggataaggtttttgatgtgctgctggattcggtttgccagtattttattgaggatttttgcatcaatattcatcaaggatattggtctaaaattcgcaaatagacgcaataaaaaatgataaaggagatatcaccaccgatcccacagaaatacaaactaccatcagagaatactacaaacacctctacacaaataaactagaaaatctagaagaaatggataaattcctcgacacatacaccctcccaagactaaaccaggaagaagttgactctctgaatagaccaagaacaggctctgaaattgtggcaataatcagtagcttaccaaccaaaacgagtccaggaccagatggattcacagccgaattctaccagaggtacaaggaggaactggtaccattccttctgaaactattccagtcagtagaaaaagagggaatcctccctcagtcattttatgaggccagcatcatcctgataccaaagccgggcagagacacaaccaaaaaagagaattttagagcagaaatttttttaaaaagaaattcaaaaaaatcatttattaaaataggcaagtacttctaaaagcagggcttgaaggatgcactgatatgtactttgataatgtaagccccaaagatcaggacaggtgtctgtcttatttgctcttctatctcatttacaattccctgaatgaataatgaatgaatgtgtgtatcacaagaaaaaaatcatggctatggttgccattcgaaagaggcacagagttataacactagtcataggtagtgcagatagaagcaagatcattgcatgggggctggagggaacttaaataactagtagattacatataataacctcgattctcatccctcattctatgtcaggcttagagggtctgcataccccctggccacagtgccagtggagaagggtttctatcccgtcatgttctataatatgtatctacgaaaaatgagatcagggaacatccctgtgggtatgaaacaacaaaaactttttgaggaagtgaggaggtatcttgttggagatgggggtgaggggcacttggcatctaatgactgcataactgtattctttttaacagcttgactgagatatatttattcacataccatataggtgacccattgaaactgtgaaattcaatggcttttagtgtatccacagagttatatgttcttaagtcagatctgtggagtcaggtctcaactaagctacccagtgtgtgtgtgtgtgtatgtgtgtgaatttgtatatgtttatgtgggtgtttgtggttagggtggggaactcaagctgcactgacttccagatctgtctgtcttcaatagtgttggtaatatacttcaaaatgagcaatttcttttttcctgtgagctctctgaactatattttatctaaagatactgtctgaaatttcatattaagctatgggaaaagtcacatatgtcactgttacaggtgacgaattactatgttaaaacttctagtgaaaaggtttccaacattaaattcacattaatgatttatagtcttgtattcacactttacaagtgctttgccatggttaagtaagtctcacccattcttgtaaaagtgaaaacatatctgcttaaaagcctggcaaaatgaagcttagaaaaatcctccttttagaaaatcacataatgtagttcatgaacatgttcgagaagggagcttgaacatgttcattgtctgtttctgtgcttaaataccatagctttgtgaaatatatgtgaatgctcactagtttgtgtgtgtgtgcacgtgcacatgtgtatttatgtgtatataaattagaacaagccattatttttaattatttacattaaaattttcagagggttcaggtataaataaatctgtataagtagtataatatatagtaacagtaatgtataacatataagctgtaaattacataacataaatatacattataggtaaaagtatatatacacacagtagttaaatatgtgtattttaaaattataattgaggaagctaattcatccttaagtacatttccggaagttcctctgttggtggacatattctcaaattttctggcataaataatgtttcagtttctgattaaaaccattcttgttatccacactaaatagacttgcctggccagtatctaattttatggtggagtcttgagtcatcagttctacaaagatatttaacctgttcatgataatcacatgcaagagaagctggtcttctgtgacctgcagccagtgtgccagaaagaaggtgtcaagacaagagtcgcctagtgaaacagtgctggtgaatggggaaaaagagcaaaaattaaatggaatccaagccagtttgacacaggacaaattataaagaaaatcctagaacaccctggagagaaacaatgggcaatgattcttcaaccaaaaaggctctgaggcagggcacaatatcaatggtcacaagaggacagggactcccggccatatgccctatgcccttgtctcatcggaggcttgactgagggcagagtctgtagtgccaatgggtgaagggataacaagaggcaggtaaatcccaggagctgtttctacctccagagaaggaggaatccagcaatgctacagcatctcagtccaaattggctccctcgctgtttgacagcaacctttagggctccattctggactttatctcgagctcctttcctcaccccatttcctttaaagaatggccagaaaatctgagcatgatatccttctgttaagaaggagaagaaaaaaataatcttatattagtccatgatgtacactgaaagaaagaaaagttcagtatctttataagaaccttgtctgagggattatgttaaaaaaacaaataactgaaaacataatataatattcaaacttctcttgtttgtttcttggttgttactaggccattaaaaatcttataaaacattaattgtttaatcttggaacaaaatgtatttaaaaaggtttaaaattctgccttattcctcatgagcagtgataaagagaaatcactgggaagcaacaagtgttggcagactggttcagcatggtggctgcgaaaagaaaaacataaggtcttacttgataaacagtgcagcacaggaaatccaaggctcaaactccgttttgaccttcttgatcccaacagttagaagcaatcattctctcctgtcagctttcatatctctttacctattcttttgattagagatttttaaaagaaatcttttactctactaatctatagtcatcctaagaagggttcccgtgtataaagaacatgttttatatttacatgccacagttacattagcagttccatgaatttatggagacttaagtgcagctttgactcttcagcctcagctcccaacctttccaactcatcacccaatgtaccacaattcttatcccatcagaccctggatctggctatagtcatttcctcacctgacctggagccaggactgcacatgaaaatgaggcttccgtatcacaggttggacaaacctctctcataaaatgcttttgtatttctctacttcatgggtacacagaccacttcagggacttaaatgtaacccttaataccttttataaggtagatgttgtgttttaaataagttattttcaagtgatcctttggaacaaactttatgcctttacatttctattttccaagcatatagggggtgagaaaacatgaatattttccccatgggaaagaagtgaacgttttcaaactttataaggaaatgacttttctctttgtagttataatcaggaaaaaaataataaagcccatagcttggggtcatttttaattagaaaaactttttacctgcaaagcaaaaagtctacaaaccagatttttatgctgtgaaaattttttattatgcaatacttctttaaatgttttttaaaaaactaatattttcttatcttataaatgtatgaagattttgagtctaagagaccaaatagatttatgttaaaacttctctgggcctagatgaaattctcagatattttgtaagcaatgaaaaattaattttaaagtgtttttccccaatgtgtaatgcatatttataacctacagaacaaaaaacacaatcatattttggatctttaagacctgacatagcaaaaagataatttgctttgaggccctttgatgcatttaatttaatttattggaagcaaattaatgtgaaatgataaaattattattaaaatggaaatagaagaataggaatgactcaaatcaacagaggagagaagtggctgattaccatacttcataggataattcccaatttaatcatattaaatctaattgttggcggacagatgatgggaaataccgctcttgctttgtagtagacagaagaagacagaaaaaaattttaaaaagcaattcagaatgtcactaggataaaccaaaaagtaaactgaaaatgaagaccaaagtggatttcttaaggaaacattgcctctttacattgccaaatgaaaatttggtagatgaatattctatggttttagataatcatttgtaacttgaaagggatttatatacaacttaataaatatatattgaatgactgctattttcaagatattgtgctgctgatctgtcttctagctgataaatttagctgaatacctggagcaataatagaaccaagttttattgatcaacagcaatctctattaaaatggtaatgaacagcttctgcagtatatcttgatatattttctttttactgggtgtgatgaatgtgtaaagtagtagaacttatgatacatgtgacatgatgtaagttcatgataaatgctagaggattaatttcatatagctacatattgtcattatttcaaacttcagtgaaatgaaaacatgagtttttcactgctgtttttaaatttttgtgatttttcccctcagtggcaattccaaaataaatggaggaaactggaaattattctgaatattgtgtatgaataaccatcttattaaatagactcatttaaaacattttcaaaaatttacatctttctcaataggaaatgggtcctttaattctgctcatttctctccatttttagtgatgttattttagtctaaatttccataatctttattctgggctattatagtaatattccaacaggctttttctcttcctatttcttgggatattcctatttatttcccaaaccatagtcttaaacatcttaaagagaaatatacagaatctgaaaagacacttctcaaaagaagacgtttatgcggccaataaacatatgaaaaaaaagtcaccatcagtggtcattagagaaatgcaaatcaaaaccacagtggggtaccatctcatgccagttagaatggtgatcatcaaaatgtcaggaaacaaaagatgctggagaggatgtggagaaataggaacacttttacactgctggtgggagtgttatttagttacaccattgttggtgggagtgtaatttgtcttacaccattgtggaagacagtgtggtgattcctcaaggatctagaaccagaaataccatttgacccagcaatcccattactgggtatatacccaaaggattataaatcattctactataaagacacatgtacacatatgtttattgcagcactattcacaatagcaaagacttggaccaacccaaattcctatcaatgatagactggataaagaaaatgtggcatatataccctatggaatactatacagccataaaaaatatgagttcatgtcctttgcagggacacgggtgaagctggaaagcatcattctcagcaaactaatacaagaacagaaaaccaaacaccacatgttctcacttataagtgggagttgaacaatgagaacacatggacacagggagggggacatcacacactggggcctgttgcggggtggggggctaggaggaatagcattaggagaaatacctaatgtagatgacgagttgatgggtgcagcaaaccaccacgcagttgtatacctatgtaacaaacctacaggttctgcacatgtatcctagaacttaaagtataataaagaaatatataaaatctgattatttcaccccctcgatataatggaaagagtacattgtaagtcatacatctgaattaaatggaaaaataaaatgatatagtgctaataatcagatatacagaattgtagctttacaaagtataggagataagttactctgaagattcctttcattagaaaacagccagatggactggtaggcacctgtatcgcaactattcaggaggctgaggtgtgagaattgcttgagcccaggagttcaaagctgcagtgagatatgatcacgctggtggatagtgactgcactccagcctgggcaacatagtgaatttttttttttttaaagaacaactagattctccataaaacagactatcacactctaatacataactgagatcacaggaaatcagggagaattctaaaccctcttaactcattctctgagctcatgacagagtgggtagtaagtgaaaaactgaaaaattgcgtatttttttagagcagcttagtggacagacagtattttagaataccagaaagcacaagaaatgtgtgtgttgttatgcagaattcataaacaactcttttgactcaaggaggaaaaacataggatcataataaacaaacccttaacaggttggaaacaagaatagcctgtaacatatgaagggtcactcaaccttgttagtaattaggacaacctaactaaaatgtataaatgctatttcacataacaagactgaccaagggttgtgatgatacgcaataataggaacttacgtactttgttattgatagtataaactggtatggacatgtggggaaaaaacttgctcttgtcttacaatgttgaacattgaattactaacaactcagaaatttcacattttatgaagttcttcttagtgttgtttatattatgagatagaaactgttatctgtatagtacaccaagataagaataaggcagttcctgagtggaaacaacattatgatattctcttattgctgtcactcccttccttagacactggctacaaaaaccaatgaactaattcatctgggcataaattgcaaggttgagatagtgtgtcaccaatgctatatattattctgaaatttgtatgtgggttttcatgcaaaaccattgtctgtcacagtaaagtatcttttgtcatcactaagtaaaaaccttttcaagtaacagactcagaccacgtgcacacaatggatgggcttatattatgataggctggctatcctaataaaatattttaaaaagcataaatggtgggaagagcaatagaaataaagtatgtgaagaaggatactttaaaggtgaaaaagtataacaattagaaataacgataaattgaacaacaatgcaaaaggaaattcccaaaatgcttccaaaacaaggacagaaaagaaaaaagttaaattcagttattaaaaaattaaccccattttaaagccacttgcatttattagtgttaattacttgtgttaattttaacacaagaaaatggcaaactggtaatgccttcctactgtaatataaagttacttcaaagaggaacattttctgaatgacacaatgaatttatcaaggacatggggcttttgggaaatagacctacgactgttggttctctgattatctcactgtgggctacttctgttttcattatttatttgcgatgtgggcacattaccaaactgctttcagaattgcttaatgtgtaaattcctctgaaactttgaacaagagatttttgacaggtatgattagtaagtaggatttcaagacatttgacttcactgaaaaattttactgtcatgacccctttaacaatctttttacttctggagatgtgtttccaatttgggttattattaatgactgatgtattcttaaaggaagagaaatagaatattatagacttatttcacagtaagacaagtcattaaaaataactttgaacttcaagaagtagtagaaatgggaatttgaattttcagaccaaatagatcatgacagaaatcaaagtgtagaattacaataaagtaaagagactggatcatttcagtctattttgatttgacattataattttgtggttgggaggaaaaagaaggcaactgtatttcatcagctttgaagacttcgttgtcgtgaagaaggctggataacttccttatgttgtcactatcttgcttccatccagagactgtggagtctttctggaaccaatatggttgaaaaagcctttcctttttagtcagcagggcttagtattcacagcctctgttttaaatacaatgtaacttgctttattacaaggcatactgtgacttataaagctagaaattctgttcaggtgattacagatgaaaaaaatgatgaaaattgagaggttgccagctcacgttcttttctttctcactaaagagtctgcttctattttggtccattttaaagtttccttaactcctcgagtcacagagaaagtagtcattcttcagtgttgccagctcctgattccagatgagctaatgattccacagagctatctctttggttcttaactctgcacctttactgatagtcattgtagtttaatttttattatcaatgtttatagggcctttgcggtgtgtcaaattttaggcaccccaaaatataatagcgaacaagacattcatggtcactgccttcatggagcttctcggctagactgtgtataaattttcaatctacagagaatgtctctatgtttaataacaatagaacatttgtattgactcttaccaatacatgtaaactactctttgaaaagtacactaaatcccaaagtgtcttttggaaaaggaatgttacatttttaaaattagacctgatagtccatagttgaatgctaatatgatggtcaatgactaggaaaaatgttccaattcaaaacaatttcaaagttttcttcagtacccttgtatcatcatgacttgggaaaatcatcttaggaagtattggatgttatcttggaagttaatttatagaaacatgggtggggcattgtagatcatttagtccttaaatacatttttggctgaaaggaaatctctcattaaaagggaaagaaacagaagaagagaaggaagaagcaaggtaaggtatttgctaggatcacataactggttagtggcagaagtagaaatcatttccttggactctttagtgctttattactgccctcttgtaagtttgttgcttttccactgactgttgggtaagaaattataatcccagaacagttctttgtatattaaaaaaaaatcctttacatattccatagaaactgggcttggtttgtaaagctgaggcccaggagaagctctttttcttacccatttggtctttaatgttgcttgcgaatgcatgggggtagaactctaataacaatgatggacacgatgtccttgcacataaacatttggctcctcacagcatgagatgtctggtcagccacagaggataaaataatggcgtaaagatttactgtcagggagctgggccagtctcagcaggacagcggctccaagcagatagatggcctggtatgcgtaggtcacctgtgtttacactgatgaatgtgtgtggtttccctagtctgcatcattatattgagttgtgtggtgttggtagcacttgttactcaccctagaatgtgcctttctattgaaagacaagtagactaatagcttggcttcccagaaataaatgagacaattcacatgaaagcaattgcagttagacaaaatgacataaatattaaagattaagaataatattatttgtatctgtaatatacagaaatagtcaaaaaatacttggggctgcataatttgtggttgtagcagttgctgaatttagtcccatatagtgatttggttgcataatttaatgtttatgttgtatttgtttaatacatcactttcctgaatgaaatgattgtggtatgaagttataagaaataatgtctttggcttgttatagaaacagttattttagggattttttgtacttttgaagcagtttcaattacaagtcatttttcatgagttctgaagtaagttttaggcatttgttatgagatcatattattagcagcttagatgaaaatccaaaatgcatttatggatattttaattggaaaattaagtggatcttttataaaattaaatactctgctataatctcttagaaaaaataaatcccttttacctaataggcaagttcatgagaaatctgtaatgatatctctcaacatagcatgttaacttatagattatataattataaatttataagcctagtttatactaagtatattcaagttataagtcacaatacgtgaaatgaacataattctctgaatatgtcacattttttaaagatatctgtaatcccagcactttgggaggctgaggcaggtggatcacctgaggtcaggagttcaagaccagcccaaccaacatggcaaaaccctgtctctactaaaaatacaaaaaattagccaggtatggtggtgcacacctgtagtcccagctactcagaaggctgaggcaagacaatcacttgaactcgggagacagaggttgcagtgagtcgcgatggcaccactgcactccagccttggagacagagtgagactctgtctcaaaaaaaaaaaaaaaaaaaaagaaagaaaaatatatctttattttcaatattactgtcagtgcctgaaatcatgccttgttttgctttgtctacaaatatattctttcaaaaatcatccataatgaatatattttccattctaaggtgtacttcatttttggaaacagaaaaatgccaattatcatccatgcttgtgaatacagtaaataattgatctccctacatgttacctttttaaaataaattgaacatgaataatgagtctaatatagtacaacaggtgtttctgacaaatagtattggaaaatgtattgctatttgattttctatttatctgtgaagtccttttaaagatatccatgaaaactctctcttatgaatgtatggctaattgtaaagtagaatcctcataagaccagtattctatgatttcctcttgattaaataaaataaaatttaatgtgacaatggtttgtgtacttttctttccttgtcttctctgagcatctctctagaaataggaaaaaaaaatgggataggttttgtttgggtgatttccactgaagcatagcaaggtcatgcttttgtattgtctattatcagttataatttctcaaaaacagacagcaaacaggcagtgttcaaaaatttgtaatttactatcccgtgctaaagacaaaccacagagtaaaaccgcaacccggttaaccaccaaaacaaccttcaatcattctgactggttctgcatgtttcaacgtttatggtcttttggctgaaggccaaagttcatctcttattaccctttcttttccatctgtgaagatcattgcacacacactcgttctgcattccaaacaatttcacctggcaaaggaactaagtaaaactgtctctcatcttcattactattcatttcatctttcaaatcactgaatcgtgaaaattagaagtaacaaaaaaaagaaatcaggtgtattaaaaacaaaaatttgaaacagtatatctgtgaaaccgctcagtgttagaaattgtcactgatccatgtcaaattcagcaaacaaaactgaggcaatttactttcacattttactaaatggccacttgtaagcatacggatgagattttgtctttccccaggctggatcagtctgttggtttcccaaacagacaggggctgagtggcttaacaggtgtgccaatgtgagaaagaaacacaaaagcagctgttgttaaaggcgttaggtaggctttgccaagactttacctctcagatctcttctgtgaattgatgactaaagtatgtcaactttggaaaaatattcttgaaatattttccttgatttctgacttcaaaaggcaaattataaacaccttaatcaattaatatttactactagaatgattgcccaaaagactgaactaatcaagatagaaaacaaaagtattatggcttattatgtcaatctcctatttaaaaagcctcaacattttctcatagcctttagaagaaacaattttttgtacattgagatcccaattcaatgcctctttttgtccatatctcattgcaactttgactcatatgatatcactttgctgcaaacagattaagctactaatgaagacatgcaattatctttttgtcatctctctctctctgtagctctctctgtgtgtgtgaatacatgtatacttgctcaactaaaatgatcctcacagcctcacatattaagatctcatttattctcaatttgggcttgacttctaacaaaaactgttccttaactaatccaccaatagatggcatattcttctcctgagctttcatcctgtttatcatttacttggtattccaacctacctctatggcattgctttacagatctttaatgtggtctcgcattgatatggaaagtttgcttttgtagatttaacttatcatgtgagtcaatcaaagatttccaaatagttgatgaactttatgagagaaaaggcctgggttttctttctttgcctcccttcaggtacctggtggaggatgctatttctagtagctacttcaaaaaacaagttttctgagttgctctcttatttctttaaccacattgtctctgtcgttctctgtctctctgtttctctctttctctctctattcttttgcatggacaccaaattttgtctcttagattttgaccctcttatctttgaatactggttttgttctctaaactactagttttttgccataactgttttttctttgggattttggactgtatttcttagatctaaggtacagacctcctgcagggacttccatgaaccatatatccattgtagcaatgatcttcattgtcaaaaagagtctaattttaaaagcaaagatttgtcaaagaaaccttttagaatgcaaaatagctaggaattttaattctattaaatatcaacaataacaaaaaagtggtaactatgattattttctttttgacaaaataagttcatcattaaaaaaaccaataatgccaaatcctaaaaataaatttcagcctgtaaaacatacattcaagcatgtataaatatatgcatgtacaataaatatatttaaaataatttttaaatttctagactgttgactagtgagaaactagtgaaactatcgagagttgggaacattccgtgtaagggggtaatgaagttgagagtgataatggtacctctaacttatggctcagactgaggctagattcaccaactttgcatagcgtcctctgcatttagattttctattcaacattcttgcaatatcttgaatgaaggcatagaatggcagcacattaaatttacaaacggtaaagatcaaagaaggaataactgaaattattttgagagtgtggaattctgagctaagttatagtgctggtgtttgaacggagttttaatatgagttttgcctgttaggtgatttctgccaaaaaaaaaaaaaatacgaagtttgcattaatgaaagcagagtattcagctaaaaggaatattcatccttttcattttgaagtttgttattataccatatctggaatgttttgtttacttctgcatggacattttaaaaaaacattgaaacaggagacaatggcatgaaaaggatgatcagaaagatgaaacatttggaattgatgctttatgagggacattgaatatactggaagtatgtagtctaaagcagagaaggctaaagggagatatgatgcaaattcatgagaaatgttcatacctaatatttatgagtcaaatgctaagtataattctcatgactgatccagtgatgaggtaagtgtgtggacacagaaaactgtcacaatgcacagtgtgaaaagaataacagtagttcttacgtcagggtacaagtcgagaaaacgaatgcctctatggattacaggtggagagaaatgtgatctagggaaaaggggaaaggtggtattaggcagagattagaaggtgctgtagtttttgagctggagcctagaaccccacactctctcagcctctgagctgcagccacctcccctgcagctactggagacaccgcagccactaaggctgcaggacctcctgctactgaccgtgggtacttctggtggctgctgccagaaacccaatcccttgtttattctctgggtttcaattttacccccaaacctgatgaaataccgttggcaagggagtcttagaaattttagttttcttattctcagtgattaaagaaaagggcgcagagaagattatgggaatgttagaaggttagttagttaccatctagcacaaatgggattaagtgttagaggtctaggcaggatatatagagataaccaatttaaatggtcaaggaaggttaatatctataagtactttcaggcctgcctttggaaaggcagagtggagttctgtgttgctccagagagcaatagatgatagaagttattaggagatgaaatttaggtatttgtgaaaaataacttcctcataactagagctcatggcaaaaatgtcctgctattttaatatgttgggtgtttgagcaaaagtttaattctatttttttcagggattctctagaagagcttctcatagtaggcagtagatggtttagttggcagctaatgttccttaaaaatttacaattttatgattcccaaaccactcatctaaaaataacaaaatgtgtttaaagagtagattagttaatcacaaaacataaaaggtaactagccaaaagaattaaatatattcatcacgtcttaataactttgaggaaaatgagtacatgaggtgggaaacgaacattaaaggagtttcttatcagcccttttcaggattccaaacttttcttataaatatccatcagtgctccaattaagcctttggagtgatatgcaagaactccatagtggggagggaaaagtgcctccttccacacagatgttggcacagtgctgaaggatggcggctggccagcctgctttacaagtgagggccaggagcagcatctgcatatgagagcagattatcccattggcaaactccattaacactgccaagggcacggttatgctgttagtgactaagaagtcatccctttcacctgaacatacctctggtaatttagggtaataaagaggatgcctttcttttatatgcaagagaaataaagacttgaatggtaataagggagggcaatacatattcatttattatgtaagtaagaaaattcactggtaaataatctcataatatctaatgattggatgatatctaagcagtatgtcgatgatatctagtttatccaccattgaatcccttataaaacagaccagtcagctggtacccagtggtcttacatacagtcaaagatgggaagctcaggatccccacatgcagccaactggaagatgggatagcaaagtcagaaagacctgagttcaaatcttcactatgttggtcattaactatataaacttaagtattttatatcatcgagctaaatttcagtgtgtatacctttaagatagtaatgtgtacttcaaattgttgttacaaaattaaaagaggtaatgtgtataacagctatctcaataaatagcagatgttttaattccaatgtgcctacttcacactgttgttacaaaattaaaagagataatgcgtataacactatctcaataaatgggaggtgttattctatctttcagatgtctctaatggttagaaacgctttatattaaactgatttttttctctataatttaagcctgctaatcctcattatgacttaagggcttcttaaaacaaatgttatatcttttatcttttactgaaagtctttcacatatttgaaaataagaatcgttaacttcactcatcatttcttttatggactgaacacacccagtccctcaacctttccttgtattccgtggctcttagccacctcaccatagcaagaagtgaggcggggaatgtggaaggattgtgattaagtggttgaagtgcagagataaggatgggaaatgcagggtaaaaagcactggaacaggcccagctttgttttttggccaaaagattcagcagctctgatcggcttactgatattcacacggtgctgaggttggcatttttccagaggcattaagcatcattccactcacggttgacagtttccagaaaggtttctcccaaaaacacactctcctttgatttcttcctgaaaatcatgtatctggtactttatcattttagctcatatatccacaggcagccctgggtgaaaccacactttcactaattttaatcatctatacttaagggcttttaggttttttttttaattgggttcattaaatcatactttaatgcattgaaattcaccattttcatgtgtacggttctacgaattttggcaaaggtatgcagtcatgtaaccactgcccccaaaaggacccccatgctccgatgtaatcaatattctcccccaatccttaacccctggtcaccactgttttgctttctgtctctgtagttggaccttttctagaatgtcacataaatgaaactatatagtttgtacccatgctatttctgcttctttcatttaatatgatgctcttgagactgtaagttgtatagcatgtatcagtagttcccttttttgcagagaatttttccattgtatcataatttatgtatgtgccagagttgtttgcttatccactcactaggggatgaacattggagagtttttctttttctttctttctttctttcttttttttttttaaataaagctgcaataagcttccatgtacagatcattgtgtaggcacatgtattcattattgttgggtaacaatgttggagtaaatggctgggtaggatggtatatgttcatttttgtatgtttaattttatgagaaaataacaaacatggttataccattttgcatttctagccaaaaaatataaaagttttagctgctttgcatatttgtcagcaattggtattgtctcttttaaatacagccattttcataggtgtagtgtttttttaatgtagttttaaactgtaattcactcatggtcaatgatgccgaacatttttcatgtgtgtgtttgccatccttatctgccatccttatcttttctttggggaagacagttcagttcgttttctctccttttttttttttagacggagtcttgctctttgtcacccgggctggagtgcaatggcacgacctgggctcattgaaacctccacctcccgggttcaagcgattctcttgccttcgccacccgagtagctggaattataggcgcccgccaccacgcctggctagtttttctatttttagcagagatgaggttttaccatattggccaggctggcctccactccggacctcagttgatccgcccacctcggcctcccaaagtgttcagattgcaggcgtcagccactgcacccagcccagtttgttttgttttgttttgtttattggtttgttttctattattgagttcattatattcattatacataatttgcacaccagtccttaattatataggtttttttgcaaatattttccccacactgtggtttattttttatattttaacagggtctttcaaatagaatgttttaatttttatttatcagtgtttttcctgaccagtttgtattttttatgccatataaaatatctttgtgtaaaagatgtcacaaatattttctcctccattttctttgataatttttgtagttacatattttacatttaggtctatgattcattttaagttggttgagtctttttctgcatatgcatatgtaattgaacatttttttaaataccatattttctccttttaattgccttagtgccttcatgagaaatcaactgaccttatatttgcgagtctgtatccagacactctagtctattatttcctttgtctatatttatgtccttttgcaaacaccaaattgtcttcattgcataacattagaataactacagaaatcagagccgggtgcagtggcttatgcctggaattccagcactttggaaggctaaggcgggcggatcacctgaggtcaggagttcgagaccagcctggccaatatggtgaaatcccatctttaataaaaatacaaataatagccggctgtggtggtgcatgcctgtaaccacagctacttgggtggctgaggcaggagaatcacttaaacccgggaggcagaggttgcagtgagccaagatcagccattgcacctcagcctgggcaacaagagtgaaactccatctcaaaaaaaaaaaaaaaaaaaaagaaagaaagaaaaagaaaggaaaaaaaaagaaatcagttaatgtgagtcctccttagttgtttcactttctcattttttttttaattccattctagatcccttgcttttccatataacctttagaatagctggatcatatttgagattgcattgaatgtataattcagtttggaggataattgacaatctaacaatattgagtcttcccaaatatcggtctattatatagctccatttatttaggccttttaaatttatctcttttatgttttgcatttttaagcccacatattttgtatatattttcttcgctttaatttttgtttgtattttaaactgtactttttccctcatttgatcatgaattgttatttctaatataaagaaacataatggaatactttttgtatcctatgaccttggtatactcactagttttagcagcttttctgtaaagtgtttgggattttctatatacgccaccatgtctactgtgaataaagaaaattttatgtttgctcctttccaatctatatgccccaattttttatttattcatttatttatttatttttgtagagttattacattgattaggacctctaggtgaatgtggtaaaagcaagcctccctgctttcttcccagtcttaggggaaaaacgttcagtcttttcccagtaagtatgttacctgcaggcttttgtagatactgtttatcaggttgaagaagttcttttctattaccagtttgctagggtttttattataagtgactattgaattctgttaaatcatttttatcatgcgtaaagatgagcatatactttctcttcttagtttgttgttacaataaattccttttttttttttttttttttttttggcacagtctcactctgtcgcccaggttggtgtgcagtggcatgatctcgggtcactgcaacctccgcctccggagttcaagtgattctcgtgcctcatcttcccgagcagctaggactacaggcacgtgccaccatgccgggctaattttgtattttcagtagggatgggtttttgccatgttggccagactggtctcaatctcctgaccttaaacaatctgcccatctcagcctcccaaagtgctgggattaccggcgtgacccaccatgcccagccccatggattggtttttgaatataaaatcaacactgcattccggacaaaactccacttggtatgatacactaaatgttttatatattgctggatgtgatatgtaaggatttttgtattcatattcatgaaatatattgatctgtagttttctttaacataatttctccacaaggttttctatgtactaatggtggctcataaaatgaattggaaattctttttctttattgttagcaagattgtttagaggtagtaatatttcttccttcagtgttggaaaaaattcactattgaagtcatttgaacctcaagtttacttttttgcaagaagttaaaccaataatttatttttttaaatagatataggactatttaggctgtttcttcttcagtaaatattagtttgtatctttgcatgtgtcgacttcatccaagttgttgaatttggggagcataaattggttaatagtactctcttgttatcctttttgttttgttttgttttgtttgagatggagtcttgctctcgcccagctggagtgcagtggtcagatgttggctcactgcaacttctacctcccaggttcaagcgcttctcgtgccttagccttccgagtagctgggattacaggcacccaccacaatacccggctgatttttggatttttagtagcgacggggtttcaccatgtgggccaggctggtcttgaactcctgacctcaggtgatctgcccatcttggcctcccaaaatgttgggattacaggcgtgagccaccgcgcccggcgtcttgctatcctgacatttatcattcctttctctctctttctgtcagtaatctggataacgatttattactattattgattgttacaaagaatcagctttaagtttcacttattttctctattattttaatctgttttcaagttataatttccctgtgactatgtctttgacccttgggtaatttagaagtctgttctgtaattttttgttttgtttgtttttcatgtttggggtttttaagatacatttcggctgggtgcagtggctcatgcctgtaatcccagcactttgggaggctgaggcgggtggatcacctgaggtctggagttcaggaccagtctggccaacatggtgaaaccccatctctactaaaaatacaaaattagccaaatgtggtggcgcatgcctgtagtcccagctactcgggaggctgagacaggagaatcgcttaaacccaggaggcggaggtggcagtgagccgagactgtgccattgcactccagcctgggctatggagtgagactctgtctcattaaaaaaaaaaaaaaatacattttgtaactgatttctatttttaattttataacacttttaaaattatattgtcttaaactgacataaaaatatttatgtataatatgtaaattattacaaagtgatgcttcagtacatatactgtatattaatcagaatgggataattagcatacccatcatctcaaacctttgtcattacattatgttgggaacattcaatatcccccttttagctatttgaaactataaagtatatgattattaactataatcatcctaaagtggtatagaacactagaacttattcttctcatctagcagtaatattgtatcctttgataaatctctccctctctctccctgttccctaccctttccagcctctagtgtcttctattatactttttacttttatgaggtcggctatttttagcatccatatttgagtgagaatatgtagtgtttaaggatcctgttcctggcttatgtcacttaacatagtatctattagttctatatacgttgccacaaatgacagaatttcactgtttgtttatggctaaatagtattctgttgtgtatatacaccacattttctttatccattcttctcttattggacgcctaagttgattccgtatcttggccattgtgaatagtgctgcaatagacatagagatgcagatgtctttttgatatactcatttcatctcctttgggtaaatgccaagtagtgggattgctggatcatattatagttctatttgtaatttttgaggaacctctatactcttctccactttggctgaactagtttacattcccaccaacagtgtatatgagttctgttttctccacatcctttcaagcattggttacgttttgtctttttgataatagccatcctaactggggtcagatgctatcacattgtggttttaatttgtatttccctgaggactagtggtgttgagcatttttcatttgttgcatatacatgtcttcttttgagaaacatcagttcagatcatttgcccattttttaatcaagttgttttgctgtttagatgtttgagttttttgtgtattctagatgtgaatcccttgtcagatgtagagtttgcaaatattttatctcattctgtaggttgtctttcagtctgattgtttcttttgctgtgcagaagctttttagtttgatatgataccatttgtttatttttgcttttgttgttgtacttttgaggaactttttgttactcataaaatattttccagaccagtgtcttgaagaatttatgctctttgcctccagagatcttataatttcaggtcttatatcttggtctttgttctattttgagttgagctttgtatgtggtgagaggtgggggattagttactttctgcaggagatactcagttatcccagtaccatttattgaagagcctgtcctttcctcaattagtgttttcagtacatttgtcaaaaaatcaattggctgtagatacacagattagtttttgcattctgtattttgttccattagcctatagatgtttctatgccagtaccatgctgttttggttactatggctttgtagtatatttttaaatctggtaatatgatgcttccatatttattttgttcaggatttatttggctatttgggtcttttgtggtttcatacaaattttaggattttttttctatttctgtggagtgtcgtttgtatttttatagagaaggcattcactccacagattcttttcgatagtatggccattttaacaatgttaattcttctgatacatgagtatgatgtatctttctgttcatttgtatcctcttcagttttttcatcagtgttttgcagttttccttttaaaggttttgtacctccttggataaattcacttttaggtttcctctttttttttttgtacactattataaattggactgtcttcttgatctcttttttttagtttgttgcttgtgtatagaaatgctatggattttcgtgtgtcgattttttattctgcaattttactgaattggtttatcagctctaagagtttttcagtagaatctttaggtttttctatatataggatcatgtcatctgcagacaggaacaatttcacttcattcatttgaatgtggatgccctttaattttcatttcccaattgctctggctgggacttctagttctatattgagtgcaagtggtgagtgttagcatctttgtcttttttccagttctgagaggaaaagattttagcttttgcttctttggtgtgatgttaattgtgtgtttgtaatatgtgccttttattattttgaggtaatttccttctacacctattttattgagatttttaatataatggcatattacattgtattaaatgttttttctgaatctatcaaaatgattgtatttttgtctttaattatattgatttaatgtatgatgtttattgatttgtgtatattaaaccatcctcacattcctggcataaatgccacttgattatgttgtattatctttgtgatctgtgctggatttagcttgctagtattttcttgaagattttgcatctgtatttgtcagaggtattggcctgtaattttcctgtgtgtgtgtgtgtgtgtgtgtgtgtgtgtgtgtgtgtgtgtgtccttatctggttttgttattagatttagactgggcttgcagaatgagtttggaagaattccctcggcttcaattttttgaaatagtttgagaatgatttgtattaattctccttcatagattgaatagaatccagtgatgaagccatccagttaagtacttttcttttttgtgagactttttattactgattcaatcatgttacttattattggtctattcaggttttctccttcttcctggtccaatcttggtaagttatgtgtctaagaatttatccacatcctctaggttttcaactaggttttcagttggtgtatagttgttcatagtagtctctagtgatcctttgtattatgtggtatttgttatgatgcctcctttttcatttatgatttttatttgggttttctttctcactttattgctagttagcccatattgtatgatttcaatcattttaattcttttcaaattcattttttgtctcagaatatggtctatgttgttaaatatttcatgtgtacctgaaagtatatttttctgttcctgcatattctataaatatcaaataaatggatacaataatactttcctgataatatattttgaatgattcaggaaaacttaagaaacgtaagggttaattatgccactaattaaaaaattcagaaactttatgacaactttcatctctcatagccactttgactgcacagtggctttgttctcaaagccttgaaattgagttattgggatgtagtagaagcagtttgaagaacaggcagtaagcccaccttctccattagtatgttctatttactttgacatggagattttgcagtagtttgacacaaatctgaatagaaacctatttaatttcagacttctttacccactcttagaatttttcttttgatagcagataaggattaagtaatatacacaggagacagtctaagaagcatatttatttaaatataactttgttataacatcaattgcgtgtaaccaatctcatgccaaaaacaaatgcaaaaattctgttgcttaggattttactttatgtgttttaagtatatattgaaatgtacttcagaacatgtgctttttaaaatttatccaactttggtaattttggtttttgaacatcccgtagatacctaaaggactcctttggagcagcagtgctatatggatcacacttcaaaagtgtaattctggggcagcaatatgaaggtcaaaacatctccctccaactaggaactggatatttaaaagaggttaaggaaatttgatgcactgtattaaaaattgtttcaacctttttttaaactttagtgtaagtactacaacattttactaagcaaatttggagttctaatttaaccgttttttcatgttctttatcttagattctgaggacaaaaagcaatgaacacagctttttagtagctatttcctttcaaactctctggagagcaatcaaattttgtaatctgtaaaagaacatacattaatgttttgttcaaagagaattcaatctataataggccttttaaagaaatatgtataaaggcccgctgtctgtcctttttgatattttagtgtatgtatttgttcagtgtagttttgtttctttttaagaagctaatattttaggaagaaccagatactactaggccaagtacattctttttgtgtaactagaaatttcaggtcttttagttttccccaggcaacatctgctaagaacatagcattagttacatactgcttggaccaaccccatctttgaatatcacttgtagacatagtcacctaaagaagcaactaaacgttgacctaggggtccactttggcaattttgcctgcacctcattccagcgtatgccatggactttttttctgtttatgaagaacgtagccagagatagtcctaaaatagaagctaagggaaaaaaacaaaactctcacttctagatgtgcgaactctagcaaaaaaaaagttttaaaattctgccctgtttatagtcttatagacagactcggattaaaaaatatactttaactgctttatttcataataaaacagagacttttccacaaacttgggaagtgaatagaagcaatccactttaatgtattcctcagaatgagtatattctcacgtctcaacttaacaggatattccacatgtctatgttgatcccatcactctcaattacacaaggagaccagtactgccacaattccaagccagagggagcagtccatctttcacagccaagggaaggactggagtgagaggaccattctcactatagtcatagctagccactcccacactggcaactgaggctttgctccgcccagtctggtagactacacttttctattcctaagatccctgtcttattcatgtacaagagttttgagagaaggcaaccccattcccttaatattaagtttaattatacagtttccacctgttcacttcaatagtggtaattcttaggacctagcactcccagtttataaacacaacgaacttcaaaggtgccatccagctcctcaaattcttgaccaggacagcttatctcagagttagaaaactcccaacccttctctctagaaatgtcttcattacattaagagacttttcttcttaaactgtaaaaacaaaacaaaagtaactgattagtatcctctttctctagacagtgaagtcattagtctactcctggaggccaccatgagttacataggaggtttcccaagacccatcacctgtgtgaaggtctatatacctagactttggaaaggaatgaaaataagaggcaagctacttttagtctctgtctttgctatcatactcttcctttaaactatttctctctatcccacctctgtctctttctttttctgtctccctgtttctctctttttttgtcactcacacacacacacacacacacacggacacacatatacaaaagcaaccctgtaaaaatcactgcttgtgtaaagcctaaaccataattggggttagaatttggagctccactagttacgcagagaatgatttctgtgggttcttaactttctaagcttcaaatttcccatacataaaagtgatagtctaataattgtgaactcaaaaattttgtgataaataagttaaataattcctatacagccttcaggacaatgcctaaaccagaataaaaataaagataatgataatttagccttatatttctccttccattttagtcaaaatatttttaccaatccacagatacagtattctctttcttttcttttcttttttttattttgtttttatttttatttttttttgatggagtctaactctgtcacccagactgaagtgcaatgttgtgatctcagatcactgcaacctccgccgcctgggttcaagcgattctcctgcttcagcctcccgagtagttgggattacaggtgcctgccactgcacccaaataatttttgtatttttagtagagacggggtttcaccatcttggccaggctggtcttgaactcctgacctcatgatctacccacctcggcctcccaaagtgctgggattacaggcatgagccactacacccggctagtagtattctcattttatctgaggttatctccacattgcacacacccatcagagatgctctctctcatcctggtgaaacataaccattccaaaacgcagtgaccgttcactcttcagcaaatctttcttagttgaaatagccctcactgcttccctttttctcttattcttacacacatctcaaaatcagttctctattagttccaggagttgtttccttgtccttcgagtaattctacatagacaatcatgttatctgtgaacaaagacacagctccaagggtgagaacgggagctttaaaatttcttaaagctcatgcctatagaagtcattcagtgccatctctgcatctgcatgcattctcttggccaaaacaagtcataggaccagtgtagattaaagatgtgagactgcgggagaggagaaacacggcaaagtcacatcacaaaaaaccacttggaatgggaacacgggttatcctcctttttgaaaacaaactgtgtcactaatattgtcagtcttattattacactcaaatggattacaagatccctaagagtaaaaagccatagttttagtatttctcaaataggtacaatgcactgtaatgttggaatgtgtctttagaaagataaaataaccaaacaatcataacacattattctcaaaacttattttatatttttgttttaatgtgtacaattgcaatctcatatttgtgttagaatcatttgtttttgtgtcttcatgtttctataagataggaccaatattctttattgggctttgattttattttgtaacttaaatgtattaaggcaataaatgtaattttccacttaaaactatcattatagatttggttactacctactgctcagcaattttttttcttatcaaaattcttcctggttggtttacttctcattttttttccattaaatgatataaattttaagatagtagtttttcttgttacattagttcagaatcatagattcatgcataatagctttgatattcaaataaccttcattggtcttgatacttttataattttcatttcagaatcccttattgccttccattgaattcttctggtttgtgttataacatttcctgtaatttgtaagcaatccattctgttttcaaaatcacttgtgtgtaaatttttctcattaccatgttcatttcagttttaactaaagttcactcataatatgtcatacataaagaaacacttaaaatatattagaactatttacattctatatataatagttatgccagaaacgaaacagaaatgttgaattaagtttagcctaaagatgctgtcttatgtgttttaagtttggcctaaaggtttttccatacatagtgaactgtaacctaactggatgtgtaaacagagtatagcctactcttgtaacaagtagccaagtctcatcccattacgacaaccatacttcaatcacacacagggtccacctgttcaaactgtgtttgaataagccagacaccagctgtaaccaatctggctgtttctgtgcctcacttccgttttctctatgtagctttcctttgtccatacatcctttccaaacctgcagtggagcaccatgctcagctaattcttaatttttttttctagagatagaggtcttgctgatttgcccaggctggtctcaaagtagtggcttcaagagatcttcccaccccagcctcccaaagtgctggggttataggcatgagccattgcacctgctggagcactaatttctaaacaaacaaacccaagatcaaattagccagtcagagtgtgtcctacttacattctgtacataaccctactaaaacctttatgtacttactgttatgaatacttttagttcgtccctggcagaggtgctaaatttcattccctgatatttagcatgatgtcaccaaatcgtagttgtttaataaacatttgcgtaatgaaagactgactgaatgaatgcatgaagtaactatcagctacaactactaaactaacatgaccaagattcaaaggaaactttctaaaatcttcaaaaatctaagttctagtgctctttcaagacctcagaactgccttagagagtttaatggaaataacatacataggagtatggggaaaagtgctatttacttagcaactatgtgtcagacattttataagtagtgtcttacgtactttcttagtaatattttgaagtattagtagatagcatttatctaattttagaaataagaaaatggaggtgggctaataagttgtttaagattccaaacattctgtagtaaaaccagtattgatcctaatttgatggactttaaacctgctgagcctctgtctggtggaggaaaaaaaaaattaaaaaaaaaagcatttttcttccttcttaggttcagtggctgaggcctgtgaattatactgacaaaagagagattatcaagaataaatatttatttgatgtgtaggggctggggaggaacaggggcagctcacataaaagcaaggaataccccaaagaggcagttggacccgggccctgtatcccattttaacaaagtgtgataaagtgtggggaagagactagataaagaaaaggagggtttaatccctgggtggccggagtaggttgtgggaaaatgactaggaaatgtgtagtaaataagggctatttagtaaggtttgttatgcaaccttaaggcatctcaggtggtgacttattcacttctccctgatataagaaagtaggacacctttacaggtataagtttcctttacaaccagaaaattcatgccttgctgaagacagttcatcttgtgtttgctatttctaattgccttcagcttaaaatactccttatgctaaagtggcatattttggggtagcatattctgatctctttcaccccaaccaacaagactgtggctgttggcaggcaaacattacatcttatttatttacacttctctgatgtctgtaacagtgcatagcacagagtaggtatccagtagatgtttgagaaaaaaaaaataataaatgggataattaacatttttggcttctaggagattattttcattccaaattggccttctcccgctgttttttcccctcatactggtgacataccctcctgtttggtcagaaagaattctgatcttggatcatctgaaatacatttactaaaaaaacctgatatgtatttacatattgaaagcacatctgacttaacatttaggagcatgggctagcaatcttactagtttcaagccttggctccaccaagtgacttgctctatgaccttaggtttcatagcctcttaagtctcagctattttattttaaatgatgggcaaggctttttgctgtttggtttacttataagtcctgagtgcctgaaacaaaataagtattcagtatgtttggttgaataagtgaatgccatgtagtacctattttggttgtcattggctttaaagaggtgaatatactttaagtggttcaagagctcccacaccataggagcttaataaatgttagccattttattatgtaagtataacccttcacacactttcactagtcatttgttataacattgactttttcaaaagttctgtggaaatgagttataagactatccattgttgaaggcaatgttcttagttgtattcattgttatcaatttagtcattaaaaaacatttgctttccttatcaatacatatgcttcattttattagtaagtagaatttcataacccatcctgttttccatttctcttgcatactaggaaacacaaagtgaaatttggttctcgagctagttcagtcacataatgttgttggtaaaattatctataacatttggattcttttggatataaatttgcccttgataggctaagctatattatattttctataatcttgtgttctataatattctaaaatatcgttctgtaattattttatgagaaacattcttcataaatatgaaatgtatatcataaatcagtttgtttatgatatacatgtttttcatgtaatttaatgatttaattgtaattatcaataaatatgcgaaatctaaacattcattggcaaatatagtagaaactataatgaattggctatagtgtttctcatgttagacattgttgacctaaaaagaagaaactgaggtgaaattaatggagtgtttatctgggcaaagcttgaagattacaacctgggagcattgattcaagttttcctaaatgtacactccaatttgtggcagctacaagtgtttgtgttcttttttttaataatttcaactttcattttagataccgggagtatatgtgcgggtttgtaaacatgtgtatattaagtgatgtggaggtttggggtacagatcccatcacacaggtagtaagcatagcacctgtagtagtctgttttcatgctgctaataaagacgtacctgagaatgggtatttataaagaaaaagagatttaatggactctcagttctacatggctagggaagcctcacaataatggaagaaagcaaaaggctcatcttacatggtggcaggcaagagagaatgagagccaagcaaaagaggaaatcctttataaaaccatcagatctcatgagactttttcactaccatgagaacagtatgggggaaactgcccccatgattcaattatctcctactgggtccctcccacaacacatgggaattatgggagctacagttcaagatgagatttgggtgggtcacagccaaaccatattggcacttctacactaaaaagtatccaagacaagtctcaatcaatttagaggtttattttgcaaggttaaggacatgcccatcacacaacctcaggaggtcctgagaacatgtgcccaaggtggttgggctacaacttggttttatacatttagggagacatgagacatcaatcaatatgtattaggtatatagtggttcagtctgaaaaggtgaagtgagggacttccatgttatacgtggaactggaagtgggggaagtgggaggcttccaaactggaagtggggttcttccaggttataggtggatacaaaggttttctgattggcaattggttattatctaaagacctggaatgcatagaaaggaatatcttgtttgtgataaggggttatagagaccaaggtttgatcatgcagacaaaacctcaaggtagcaggattcagagagaatagattgtaaatgtttcttatggaacttaaagagtcacttctattggtcttgaggtctgcattggtggtaacaaggcatattttcaggttaccttcggaatgcccttggctgagaagaggggtctattcagatgactgggggccttagaattttatttttggtttacatatccaataggtagcctttcagcccacagtgccctccctctctctgtcctctagcagttcacagtgtctgttgttccgaggagtgcccaatgtttagctccttgttataagtgagaacatgctatagttggtgattttttttttttaggagaaagaggcagttcctgaattgtttactaagaatttacataaaaatagcttaagctattgattagctatacgttgttctctatatcagaaattccagaaacaagaggataaggggtgaagcagctaatcaggaacaaaatgaattgaaataattgcccccagacgtgggtgcaggggttgggatgtggagtgttggagggtgaaggcatgactgatgtcccacgctcatatctctctgggcctgcatacctcgcatagttcatgctattctgagctattttacttttctcaacatttagatatttgactatagaaatgcttataaatataatttatacacatataaatggcatgtttgttatttatttagtttgagctggagacttgctctgtcacccaggctggagtaggagtacagtggcacaaatcttggctcactgcaacctctgcctcccaggttcaagcaattctcctgcctcagcctcctgagtagctgggattttaggcgaccaccgccacacctagctaatttttgtatttttagtaaatatggggtctcaccacgttggccgggctggtttagtctcaagctcctgccctcaagtgatccaccaacctcagcctccaaaagtgctggaattacaggcatcagctaccacacccagccataatgtcatatttattaccttaattatgatatttataattttcaaatgcagtcttttaaagcaaaatcaagagatattcaaggacctttgaaaatgcaaaacaattatttatatttttaatgtgccttagaaatagctcaatttacactgtcgaaaatttgcatatataatttagtaaggaataattccacagtactcagtaggacctattaggtttcactagaataatttatattagtaagtcacaaattaatgcttatggacttttcaaaagtttatgtgtttcaagagaaagctaactttgcaaaaagggtttatgaaatcatctaattaattcatacattataaaaaccacattaacaatctctcaattttctttcctccttttgtatagacaattaatatagaacattttaaaatagactatttgaatattgaaaatccaattacaggtaaagtaggtggagtaatttgaaattgcattctaatacttataataaataatttgttttcagatcataaattgcttactataaagcttttctaacacttataaaatttatggcaacttgagtatttgactcatcatgtcacttttcaggattgtctttctttttcaggaatattaggtgttctttgttttaacttttaagttcaggagtacaagtgcaactttgttacataggtaaacttgtgtcttggaggcctgttgtatagattatttcatcacctaaatattaagcctagtacccattagttattatttctgatcctcttcctcctcccaccctcagccttctgataggccctagtgtgtattgttccctttatgtgcccatgtgttcccatcatttagcttccacttacaagtgagaacagaggcagtgtttggttttctgttcttgtattagtttgctaaggattatggcctctagctccatccatatccatgcaaaggacatgatcttgtttcttttttttttttttttttttggagacagagtctcacattgtcctgttgccaaggctggagtgcagtggctcgatctcggctcactgcaacttccacctcccaggttcaagcaattctcctgcctcagcctcctgagtggctgggattacaggcgcccgccaacacgcccagctaattttttgtatttttagtagagatggggtttcactatgttggccaggctggtctcgaacgcctgacctcatgatccgcctgccttggcctcccaaagtgctaggattacaggcgtgagccaccgtgcccggctgatcttgtttctttctctcccttccttcctcctttcctttctctgtcttcattctgcatttatctttccctcttttctctgttaatctctttcccttcgtttcttctttcttttctcttttgcctgtattcccaattatagcggtaacattacttgacttcaattgatgggacttttacagtttaaatctttatacttatttatattccaaattaattataagacattcttttttttaagacattctaaactactttttgccttgaaatgtcagtaagaataatatctaagaaatgtgtcctattttagtcatataaaacaaatgtatcaatttacatttatattttcatttaaaaatacatatgtagaacatgttatgtgtcagaaaccatccttagaagcacttctaaaatgtagcggatttaattgtcatcattaaattattaaataagcataccttattcatttcagttaggtattattattatgaccactttatacatgaggacttaaggctcaatgaattaggtgattttgtcaagggcagttcgtttgtgagcaatagaatcaagattcaaacctagacttttggattatgtaaccacatgttatgtgtggagggaaatttaaaaaacaaaacaaaaactccagacaccaaaaagcaaacaaaacccctaaacaaaagctaaaagctgaattctgttctttagactatgtctaaatattatctgtcagtttttacacctcttttttcttaacagatgactggagggagtgttgtattatagtataatggaaaaccttcataaccttgattacagcagctgaagaactcttgagagagaaaaaaggaagatagagttttgcctcattctctccttatttagtgttctcagaagtcattcttaatcttttacctcaattatccttagttcatttatgaaaaaatacaaaccattcaaaccctctgtcatatcatagcgtatgtgtgacttgactttatgagtgaaggctttctgtacgtgtgttctgaaataaaagcttaatgaaaacatctatttccttttctgcagtgtgcagatgataataacgaagcatgtggcaatgctacagcagttatagtcacatggatccgggacatactagaaagaaacatgtcactgatccatgggcctgtaagtgacacaagcaaaggcattcttacataggttcactgcatctattatttatctgatagaacatgtgtgaaggtgttacaagagtgctggacttaatatggattactgtggaacttcctatcaaagctgatgagatgaatactaaaaaaaggttaatcaaagtttgacactggcccttacagaagccagagctactaatttccaaatgctacaacttttgaatactctaaaataatcctagtggcagtgtcaacagagtgctatgggaaaagaaagtgcggaggatcagtgttggcttaggggcctcagaaagcgtcacagaaaaaatgattgtttattgcagagaaaggagagaaatcaaacagggtgcaacaagtgctaagtcatggcttgtccagaatactttagaacttcctgtatagttgagtcttgccttttgggagacaggaggggttgggaaagctaggattacaaataaaattggtgatattcagattatagttgctttgagaatatgcagttatttgggggtgtttagaaatggtgttattcatggacacatagagggaaacaagacacacagggtcctgtgggtggggggtggagggtggagggtggcagggtggcggggggagagggtagagggtggaaggtggcagggagaagggtggggagtgggagggtgggaggggtgggagggtggtgggggagggagatgggagggtggggggaggtggagagtgaaagggtggtgggggatgggagggggtgggaaaggggagagtgggagggtggagattgggagaaaagagaggaatgggaaaaataactaaaagtaattgggtactaggcttaatacctggatgatgatataatctgtacaacaaacctccatggcacaagtttacctatgtaagaaacctgtacccctgaacataaaataaaggtttgaaagattaagtgccttgctaaaagttagagaatatgttaatgtgttatattcagaaagtaagagcttctaatgctttctactcccttccccacaataattatgctagttttctattcatcatctctatctaagtattccacatagtatttcaggttaatgaatatttttatatctcctatttccagataaaaccatataaagttctctcaggtcagacgcacagaaacacatgtataagctacatcatcatatatcatcactttggtgttttaagtcatagaaccattgctcactgtagaacaagacagcaaaaatgatgctttatgaaaacagaaagtaaatttcacatctatcattcatcttataaattctttgtatcaaaattttaattaattagagtgacctagtttcctcactgtggaagaacaatatatgtatatacgtatgtatatgtatatatatatatttttaatgtaagtactctctcatccaggaaatgttccctgttgagtgataagcctagtgtgagaacataacgttcagccagcaaaggttatattacattaatctttgtacactgctcaatagttaagaggtttggaaccgtttatagtaaggaccatgctatcaggttttatcagtggcttattacataggtgacaatcaaaacattattgccaaacttcatgttagttcacagatttaatatctaatatacattttacagttatttgaggcaagttaccttcatttctgggttgcacacgtatcactgggagaaaatgcaaagtacataccagagaagaggtgagttccctttttcaagcagtgcaaaccacagaaaaacatcaagcaaaagatctaatgtaactctgttgtgaaaagagttgtacaagttgtactagtaactaaaatacacctagaagaaaaaagatttttggtcaacagacatttcagggcaaagatatttgcattgctaagcagaaatacattatgcataatcggttaatagataaggaagaaaaattcaatattaaagaccttcttttgtacccaatgtattataatctgagctagatgtgttccatgcactggattgtttcatcctggtagtaatttataggtgggcattatcgtctcagttattatgaatacatactactgacatggcagaactgctattctgtcaccctcacattaatctctctctacttcctgtgtttgtatacatatataacattgtatataaagtctttttcttttttttgagacagagtctctctctgacactgaggctggagtgcagtggcaggatctcagctcactgcaacccccgcctcccaggttcaaatgattctcttgcctcagctttgccagtagctgggattacaggcacctgccaccatgccagctgatttttgtatttttaatacagatggggttacaccatgttggccaggctggtctcaacctcctgacctcaggtgatatgcctgcctcggtctcccaaagtgctgggattacaggcatgagccaccatgcacggccaagtcgttacctaaaatatttcagtgatttggcggggagtgggaatccttgttgcttaatattttcctcaataaaagtgtcaaatggttaatctctttatagattatcttccttttgatatttataataattatatttgaaactctcagaagaccagatgaactcaaactacagtgccacaagagacattggaaattctgtgtgtcataccggacattaattatatttcaaataacaggaattcctttaaacaggctgaaacaataaacatacaaagagtttactcagcatttattgtgtgttgtgcatttgtatgtttgttcaatgagtcacttaccccataggagaagtttagtcacaggatttttcagaaagcctaagagggtcatgaatgaaaatatcctcctattaagatattaagcctatcacatgtggcatataagtgatgtgaaattcatgctcttaagtgatgtatttcaaaggacagcctgtttcaaggtatggtaaaatgatatatgtacaaatattgccctgtgggtgtgtagaactgaggctcttaatgacactttgacgatttgtgagactcttgccatcctgtaaatagtcatagcagctacacctttcactggaaacagggaattttcccaagatctgtctctcaccttctggttcaaaaattcttgctctcctttgacaagcccgtctcttgggttacggctctctctctagcaaatcctccagaggataacaggagagtctgtgcactgactttcagaggttcccttgatccattgcttttgagctgaatctaatgccatagtgcagaaccttacactggacctgttgccccatgattttgattcccagaagtggagatgttggctaccataccatattccaaaatataagatgagttcacaaaccagctgaagaactcacgaggaagtgtcagggcaaaggcaactttaagaactgctgttttcgatgagctaagtgagaataaaacaaaaattcccctatttatgtatcaatagctatgcactgacagtttttacaagtgtaattatacacaagcaaatggaggtaaaaaatcaaaatatcctccagaaccagatattcttgaatttaaagacttatttgactactctaaatctctgaaaacacttctagtattcaaaaatgtggcataacttatgtgggccaactaaactagaaaatggtgagttttaatatttatatgatgacaagatcaccatgacagaatagaatgttcccaaaacagcttcgagcaataatagatccagcgcaaaaaaaaaaaaaaaaaaaagctggaggatttagctctgccagttattgactatgtgacctggtgcaattactattattacctatttgacattttcaaatcacatgacttacttcacaagtaagaacaccaatgtccctaccgaggtttgttttcaaagaatcaggaaacccaactccagaaagtgctattcatactgttttcatgaatggtgctccgtgaccttgataacatatgtccctagagctgtaagccatggatttggctttcagatggtgtcaattaaataatgtaagctaaagagccacagattttaaaatgttacataaatcttactgagaaagtgattaaaaataatcatcttcaagctcacaccaaatgacagttaatacagagtattttagtcctcataaataataaaaacaagaatgatgcacaggtaccattattttcaacattgttctaaagatgaagaaattaaggtatagggattacacatctagatagtggaggagtgaattttgaaacccaaacgagttgacataaaagaatgacaaccttttaactgccaagctgtatccactatcatgccgatttcaaaggatagcatggtattgtgccgctttattttttgtaaaagaaccaacaatacatgcaacttgaaacattcctatagatagatgattttatgattgccagggtgtttgagatgacacacaaacaacatgcatctcagattactgaatagaacagagaattgcatggacatatatgaacattatgtatcattagggttttggttcatctttcaagtcaagctggtacaggctggttgacatttcctggtaaaagggtgggagaaccaaaaaaatacatcctttctcagatatgacttttgtgactatcttgagaagaagaatccatgcccgatttatctctgcatttctgttttcacacagaacaaataagtgctgaataaagtttatttgaatgaaaaacaagcctacgtagtaataacaatgtggaaaggagtaattattctgtcctgaggtgcaaaagatggtttaaaaaggtttctaggtgaattagaaaaaaaaaatgcttttgacatctaagacatgtgtatatccattttccttactgatatattttctattaaacttagaaataattatctgcctaatggaaagaactgtttataattgatgtatgtgaaaatgagctgaaagaggaaaacattcagtctatatctctacagttatgtgttcaatggtagtattgatactagcaaatgtatttggttcttctactttgtttaatctatttaataacacttagtgtaatattgaccttgggattcagaaaaaaatattccaggtgaggcatgatggctcacacctgtaatcccagcactttgggaggctgacactggaggatctgttgagttcaggagtttaagatcatcctgggcaacatactgagacactgtctttacaaaataattttttaaaaaattacccaggagtggtggcatgtacctgtattaccttgggaagctgaggcaggaagatcccttgaacccaggaggtgaaggctgttgtgagctgtgattgcacactgcactccagcctgagtgacagagtgagaccctgtctcaagggaaaaaaaaaatcaaacaatttttgaagtcagaatagagtagcagtgcgattgtacgtagcctgtatgtgttgcgtgtgcagaatgcaacatatttccatggctacttccgaaatttcaatcatcctcttccagaatttccttctccagttaccaacaaatatttattagggaataaatatgtgctagccactgagatacaaatacagacttatgtactcctctcctagggactgtattctaccatggaactagatcttctgtaagatcgaggcacagatcatcggcaagtctaaaaggaaattaaaagataatttttaaggagttctaattttccttcattgttgatgacttttcacagtattacttccttgttggtatatgagaacaaaatgctggcttgtcacatggttcttagaaagactgtctagtcataagaaacattacttgacttacttaattctctggcagttttataatggcatatacaatttctatacactactttaaaatggagtcaatgtaattttcagcaaagctttggaacagattcagccaatgtttgtcgtaacatagggatgcatgctggaaatggttctctctgcttctgtggctgggtgctcctggagccaatgctatactgcaaaaatgaagcactatgttgatgatatttctttaatcaattattctgccaataaggtgcgttagtttatatgcctaactagcattcttcttctgagcgaggtgcatgaggtacctgagagatcactattattgtgtcattgaatcatagttctattattttcagagaaaattttcatttctcaacggttaaatgtctctacaattcagtatgtctcatgcctagctctctaaagccacagaacttatcaaaactagtcttaatatctgtaaatactgactgttggttaaaagtctaggccctgtggttaaactgcctggaatgaaatcttggcttagatactaactaaatatgtgatcttgagcaacataatttctctctgactgagtttcctaatacacagaaagagaaaagtcacaccagctatatagggtcattgtgaggtttaaatgagatagtacatggacaaaaatgtcttgccaaagtaagcacgtaacggatattagctacagtcctcatcattgtctgtgcccctttttgtcgtgtatcaccatagaaaagaagggaacgactcgacttaaaagttttctggtagttcttatctaaatgatgcaaatagatgaatttttaatacatggatgtggatttgtgatatttttaggcttttgtgtttgcacagataattatggctttttaaagaatcaagttatcagatcatttcattttcagatattaaaaaataatgaaaatggaaaagtacattgaaaatgtgatcattgagggaatatatttagcaataaggagatgacaatgcaaccaggaggggcgaagagagagacagagatataaatgagcaaaactttctttgcttttgcaagatctgttgtttataggataagcccagttgttttgcagtctagcactgatgctttccatgggaagagcacaggctgtgtatgtgcatgtgtgtgtgagttcaagtggttttacattactaatgaaacacagacttttcccaagataatcaactggggattataatttacagcaaagaaggtgtaggtgcagaaacttaatttctgtggctaaaaacagctggaagtaaagatgtcgctgaaaagacattgttggtccctaagctagtattgaccccacatggagagggaatcccacagcattaaataggcgtctgtagacacaaactgccatgaagtgattcatttataaggaaggtactaattttaaataatactcaaatcattgttaatttctgtactatttaatagtattaatcagagtgaactcatctgatacagcaataatcataagaactgttctataagtttcatttcaaattctgcaataatcattgtgtcatcatgttatcacatactgttatgcgcatccatgtgaagcgaccaccacacaggctttgtgtgagcaataaagctttttaatcacctgggtgcaggccaactgactctgaaaaaggagtcagcaaagggagataggggtggggcagttttatagaatttgggtaggtagtagaaaattattacagttaaagggggttgttctcttgtgggcaggggcaggggtcacaaggtgctcctgagattcattgtccaggagaaggagtgtcacaaggtaaattgatcagttgaggtgggacacgagcaaatcacaatggtggaatgtcatcagttaagacaggaactggctatttttcacttttgtcgttcttcagttgcttcaggccatctggatgtatacgtgcaggtcacgggatatgatggcttagcttgggctcagaggcctgacacataccaattggagaatgttgccatgaaatgacataaaaacaaagactattaatgactatcctaattatactaggaagtaaatcaaaactcttcatcagttagctaccattcttgttagctgattacagcatgcatgtaaaaaatgtctggtaaaaattatagtatgtaaaactaagatatttagctatgaaaactttctatgttcatcttttattatacagcttacatgatgcttcaaaaaataattataaatgttggcatttttaaaacactttttcacgaatgtatttgaaaagtctcttcatatcagaatttaggaggcatacacatatgctgttatatacagttatatatactttactaaaaattgtttccttttgacttgccctctgatgagtaacatttcacaaggttactcgggtaaccttgagtaaattactccatttggctaatccttagtttcttctctatgagtggtgatcaaaatgcctaccctgtcttttgaaagccaaattaagataggggttatcaagcagtgaattgccataaaatgtattatgcatattttatcacatttgtattgttattataaatatgtgtttatatgtatatcctccttagtgaccatgagatcatccagggtaggagctctctggaaatttagaaaacaaaggaaaaaaaaaattgaggaagtggaaaatacaaaggaattttctcagtggtgtttgttctataagctctaaacagtaggccaccaacgtccttgagaatctttcatttatctgtctgtacctcataattatatctgtcactctcgttttattatcagaagatttgcacagttcattttaaagtctaacttgtcctttgtgctgactgccacgcatgtctgatgaaatataacaaattgaacagaggtgccattattaaagcaatctgataaaaagctgcagttgtgaggtacactgaagaatatatttggtttcttcagggaatcaaaagcatttcacatttaagttattttctggaaacttttatgtgaatatactacattttatcatgcagaaatactgtgtatcttttctttcttttgtaaaagagagcaaacaggatggatatatcaatgagttactactaaggtttcagtttttctcatatgacagaccccctgtaggaagaggaatggtgtttccatcaaaatttgattatttttatattaatatttttattaatttttttcaaatttatatatatctatttaaatcttaagataattttgcaaatagccacacacacaatttttctaaatttgatgagtcttccatttcacataattacaggaaattttctcttcatgtgattcctatctgcaagaattccatttactggaatcgatttaaataataccagtcttccaacaacagttcaatttcaatccacagcgtactaaccataattgcataaattacaaactttgctgctaggccttcagtccacaattcactacataaagaggagacatacgtcatgatcagtaaccaatcatgacacttctttcaaagtctccagtgattggtcactgcacatgtataatttgtataattcagtttatgcagagacagggacttcattcccctgtgttctgaccagttggagctcccaaaatgcctgtggctacagtttgctcacagtggtcacaagtctattgaaacatgaatcttattaataggtttttgtttctccagattaaagtcacaattaccaaagatttaaataaatgttttgtatatgtgaaaactctttaatggcctcatttgcaagttgttttatgcgtatgatagctagaatctgctctcgaccagtagaaggtagtagcatttgccagaaattttgtaatggttcacagacaattctatgcaaacaaggtaatatttcctatgtttttatgtataaattatttaggaaaggggaaaatacatcatgataatttttgaaagaaaaaagcctttaaaatttttctgtttctctttttctaatttctaatacagtttattttgagtgaaaaggaggaaagggaacttaatttgtgaagcaactgtttcattttgtcagtcctctgggctaaaaatatatagaatgattggaaagaacatgaaaaactgtcatctggaacagttcctaaagtgaatgtgcagtcacacctttactattctctgattatgctgtgattctggaaaataaacaaggtgtgcatttctcattgaaatatgtcttggaatcttctccaaattaatacctgcatgttatatgatgcatatccatatgtgtacctatagctgtttatgtgcaaatgataactactttaaccaaacaatttccgccattttcttaatatttccattgggtaatcaccttctttaggaaaatgctgagtcataatgataaatataaagccactaatttggatctgtttcttttctctaagcaatatgttcaatgagaaaaacatgtaaagatgctcctcgatttacaatggagtcacaactcaataaacccattgtatgttgaaagcaatgtaagttgaaaatgcgtttaatacctagcatgcatcacagcttagccaagcttactgtaaacattctcagaacacttacattagtctacagttgagcaaaattatctaacacaagttctattatataataaagcattgagtagctcaggtaattcattgaacactgtactaaaagtaaaacgcagagttgtatgggcactcaaagtatgattctactcaatactcatttgcttttgcaccatcataaagctgaaaatttgtaaggcaaataatcgtaagtcagggagggtttgtagtttcctttttaacaaaatggcagaggattctttatgtgtttccaatgtttctttactgaatgttagagccaggttcgtaattctacccatactaccaaccccgaaactctcctcccccttttgcattcactctcatctcaaatctctatgtcttgcaatggtcaagttggcatgaattaaattgtttaacctgtaaattcaacagtgttcagagatgtataaaatgggcaaattcagtgactactttgaacaatggaaacatggcttttcaatggtaacgtcttggattggattcaaatcaggcccctaaaaatttaaggtcctaaaacccattacgaatgttctgagacatccaatgatgcacaagggtccttctagaactgctagctttaaaatgtgtaaaattggtcagagatgacagtctaactagcaaaaaaggaatgtgtctttcaggttcctggaaataatgggcacatttatgtttttcatctctagttactgtcatctctgcagtcttacgtagtcttctacatttccttttgtcttgtaaaaatgcttttctgttagagtttatgctttcatacaataaacatttacatagagacctgtcacagtggtgagcatgtaaaatgcatttaggaaatgccgtttgatgttgtatttgaattgacattttccctacataaaaacctttaaaacttataccagtaaaggccaactttttaaaaggtagtctccttttatgcatactaagagttatcctgttggaaactgcataagcatctaatcagtgcttgctaattgtgggtgctttcagccagagcatgaaattgggcacacaattagcaaactgaagaaatgtttaattgcaagtgcaattttaacctattgtcaagagggaaaatagaaaggatgaaaatgaccattttgattgtggttaacaaagaattaaaatagataaagagtttggacccttgaggagcaaatctcagttccaatatttatttgtctaactttggacaatcccttgatcactgtaagcatcagtttttgttgttttttcatgtgtaaatggggatcataatgttttaattgcaaagtttctgtagctatctgagatagaagcttgaaaccacctaacatggtgtaaattatgtatgtgatagccactcaggaagtgattgctattatgactattattttgaatattaatactactgatgctacaataaagcaaaccaaaatgtcatccattttttccctgcagttcgtcagccaccatggtatgaaactgccatgaaatacactatccattatgctcttaagtattccttaccttgaactatagtatacggtaaaagggcactggacttgagatgaaggaagtgagttttaattctgattgtgtcatttacttgagtaatcttgaagaaatcacttgatatctctgaaattcaggcttgttagctataaaatggagacgatacctacttcaaaagatccaagagagaatagtaacaaagatagcattgtgcttgacatattagctgtgtaataatcttccattaagtttaataaaatggctctgcatatagtgagtgcttctagaaatttatgctaagaattaagtttattttcactttcatgtattttcttatgctgatgttatgaattagatgtcttattttttgacattatgtaccaaaaaaaaatctgcaagcagaaacaaataatttattcaatcaaaattttataactccattaactttgtttcttcttactctctatatgtgttttgaggttttttctttgattttcttattgtacatgtgttgttattattgaaaatttttgagacattaatagtaaaataagctaggctccaggatacttagaatagggaaaaatattataagatataagtttaattcttattctgccagaatattataccttgacaagtaatctcccctccctgggttctgtttcctcatctattaaattgcaatgttactgacattagtatttttatcagtgccaaatgaaatactgagcaacaaagtatattttaagattgaaaagcagtgtaattattgatttttattttaagttctggggtacatgtacaggatgtgcaggtttgttgcgtatgtaaacgtgtgccatggtggtttgtagcacctatcaacccaacacctaggtattaagcatagcatgcattagctatttttcctaatgctctccctccccatgaccccatcccccgaccagccccagtgtgtgttgttcccctccctgtgcccatgcgttttcattgttcagctcctaattttaagtgagaacaaaaaagcagtgtaattattttaaaattccagattaaaaaaaatcatttcacataaagtatgaatatttgcttcctggttttatgaagctaaaaataatatttttgttcagagaaaaatcatacattgtttaagaatataattggaaaataagaaaggtaagtgatgaactgagagaagcaaggaatataattaaaactcagcatctagagagctaaggaagagagctgctgttgtaaagaatagacaaagggctaaatagaaaataatttggggttatgtgtaaacaatacttttcattttgtgaaaggtgtaagttccatttatagatttacacttttccacgtggatatccacttgttccagcatcatttgttgaaaagactactttttccattgacttgcctttgctcctttgtcaaagaactattgattatatttgtgtgggtctatttctggactgtctattctgttacattgatgtatttgcctattctttcaatgatgctacccagtcttgatcactatggcctaatataaggtcttgaaattgggtagggtaggtcctctttctcatccttcagtattgtttggccatgctgggtcttttgcctttccagataaactttagaatcagtgtgtcaatatttacaaaataatttactggaattttcgttgagattgcattcagtctatagattaatttgggaagaattcaggttttaacaatattgagtctttctattcatgatcatatctttacatttattcaaatcatctttgatttaatgtagttaacattttgcaacttttctcatgtagatcttatacatattttgtcggccttatatctaagtgtttgataatttttgtgctaatgtgaatgattttatatttttaattttaaattctgagtgttcattgctggtatataggaaaacaacttttgcacattaaccttgaatcctacaacattactataattagttaattgttcctggaacttctttgttgattctttggaattttctacataggtaatcatgacatttgcatactaaggtagttttaattctttctccccagcctgtataaattgatttccttttctaattgcataagctagtactttcatgacaatgttgaataggagtggtgagaccagacacccttgtcttgttctctctcttagggggaaagcatccagtttcacactgtttgctatgatattaactacaaaaactacgtttttgtagatatctattatcaagtagaagttgttcccctttatgcctaatttgttcagagtttttatgagaaatgtgtgttggattttgtcaaatgccttttcagcattatagatatgattgtatgatatttcttccttagcctattgtgataaattacattgatttttaaattacattgatttttaaattaattaattattttttttgagacagggtctcactctgtcacccaggctggaatgcagtggcatggccacagctcactgcagcctctacctccctggctcaggtgattctcccacctcagcctcccatgcagaactataggcccacactaccatgcccaactatttgtttttgattgtttttcatattttttttgtagagaaggggtttcctcgtgttgcctagtctggtcttgaactcatgagctcaagcaattcacctgcctcagcctcccaaagtgctaagattacaggcgtgaaccattatgccaggccaattaatgtttaatttacaaataagcatatatttagcatgtacaacatgatgttttaaatatgcatattttgttgaatggctaaatagctaattaacatatatattacctcacatggttatttatcaggttttgaatttgaaccaaccattgtatctggaataaagcccacttagtcatggtgtataattctttttatacattggatttgatttgctaaaattgtcttgaagatttttgcatttatgttcatgagagatattagtaattttcatttcttaacagatcttagtctggatgtggtgttggagtattgctggcctcctagaatgagttaggaagtattccctgtgtttatattttctgtaaaagtttgaaaaaaattgacttaaattcttccttgggagtttggtagattcaccagtggaaacatctgggactgatgctttctcttttgaaaagtaactaattgtcaattaaatttattaaacctattcaggttatttatttctccctgtgtgcaatttttatattgcgccttctgtggaatcagtccgtttcatctaggttatcaaatctgtaagcatgaaattgtttaaaatgcttacgcctaatttcttaatgtctatgaagtcaatgttaattactctttttcatttctgatcttagtgatttgtatgttttctctgttttctggttagcttggttagaggattaacaattttattgaacttttcaaagaacactagcttttggtttcattgatttactctactaatttcctgttttcaatttcatttctttctgccctaatttgtattatagatttgcttctgcttacttcagatttattttgctgttatttttctcactttctaaagcagaaacttttatttattttagatctttcttttctaatacatgcattcagtgctacaaatttctctctcatcactggttttgtcgcatcccacacattttgaaaagttgtattttaattttcacttcaaactatttttattttttcttcagacttcttctttgactcatgtaatccttaaaatttattgtattctgcaaatattttggaattttcagcttctttttatttttgactttgactttaatttcattctggtgtaacagtatactttaaataacttcaatagtttaaattcattaagctgtgttttgtgacctagaatgtggtatatcctggtgaatgtgccaggtaggcttaagaagaatatatattttgtgttgtcagatggtgtaattaaaaccagttaattgttggtgctgttctgattaactatgtcttatttggtgtgtgttgactctgtcaattgctaatagaggggtatcatagtcttcaaccataatagtgggtttacttatttccctttgcagttatatcagtttttatctcatgtattttgacactccattaggcacagacacaataaggattattctgtttcatcagagagttaatacctttttaaatttatttatttatttatttattttgagacagggtcttgctctgttgcccaggctggagtgctgtggcgcaatcttggctcactgcaacctctgtctcctgggctcaaacaattctccctgctcagcctcctgagtagctggaactacaggcatgtgccaccacaccgggttaatttttgtgttttttgctagagacagggcttcatcatgttggccaggctggtctcaaactcttgacctcaagtgatcttcccttctcagcctcccaaagtgcggggatcataggcgtgagccaccacgcttggcccttattttaaatgcctcataattttccttactcacaagtctgctttgtctgaaatttatatatttactctagatgtttttggttaatgttagcattgctgtatctttctccatcccttcatcttaatttatatgtgtctttatatttaaagtgaatttcttgtagccaacccatagtaggttcttgtttttaatccaccgtgataagctcttttgattggtatattcagatcattcacatttaaagtgattaatgatatatttatattaatgcctaccataatttataactgctttctagccattgtccttgtttttgtttttacattttgttttgttttacatactttcctgccttcttcagtttgaagtgcgcatttgatattttctactttctcttatctcttttttacttctattttacctgtttttagagattaccttagcgtttgcaatatacatttgcaatatacatttgcaataatccaagtccactttcaaataactctaccttacttcacaggcgtcacaggtacattaacgtattcccaattccccctatgtcatcacatgtaacattgctcattcatttctcatttatctgtaagctagaaccatccaaaatattgctgctattattaattagaacaaattttatgttgtatcctctaagaaccaaaaaaaattattttaccttcatttattttttcttaaatactctttctttatgtagatccaattttctaatctgagtcatttttttctctgagtaatttcttttaatattttttaaaagggaggcttgctaccgaaaatattacttcaagtttcatttttctgagaaagtcattatttcccttcaaagaatttcacttgatacagagttctaggctgtacttttatttgtttttatttaaatatttaaaattttataccactctcttcttgcttacatgattctatacagtgttggcttcctccaccccttcttggcttctttgaagattttcttcttgtttgattttctgcagttggaatattatgccaggaaggagatttttaactgtttatcagagagtttggcactctctgagtttcctagaactgtgatttgttgtctgtctttgaattcgaaaaagcatcagcattatttcttgggctcttccttctgttcctttctctctctctttctctctctcctccatatattatttgcgttatgcacattacacatttcgtaacactcatacatgtgtagaatgtgctcttccatatttttcatttttttactctttacattgtaatttagaaagttcctattgacatatcttcaaacacattatttccttgactgtgtccagcctactaatgaacccatccaaagcagtctttatttttatcttttttttctttctttctagcacttcctttcaattctttcttggagttctcatctctatgcctgcattacctatgtattctttcatgttgtttgtttttatcatttgaggttttaatatactcatgatagttattttaaattcccagttcaataattgcaaagtttctgctgtatctaagtaggttatgatgtttgttttgtctctttaatctgtgttctctgactttaacttgccttgtaaaatatgatgcatgagggaaaataaaacacatagtgccttagcctgaggttttatgttagtctgcccaggatttaagctgtgtctactatttgctgtagctatatgtgacagagactaaaatgtttttgtctcccctgttgttattgggttgccacagagaacttatcttaaataagatctgagacatgaaggcttttcacttgtattccctcattattatgcaggagttctgctgatgtggtgatagggtgtgagggaggataggcattctacagtctcataattaggtctcagtgttttagtgagcctgggcccctgggttgtgaccatcacaagggtttctcggctttttatccacttatgtgatacaagaaggctagagggagctggggttaggtatttctcttctttaagattaattcagctctggtaaaacctcagtccattgggctgtagtaaactagttttctttgagggtaggcctttgttaagaacaggatttctaggctgggcatgttgacccatgcctgtaatcccagcactttgggaggccgaggtgggaggatcatctgaaatcaggaattcgagaccagcctggccaacacagcgaaaccccgtctctactaaaaatacaaaaattagctgggtgtgatgatacatattcataatttcagcgactcggaaggctgaggcacaagaatctcttgaacctgggaagcggaggctgcagtgagcagagattgtgccactacactccagcctcagtgacagagtgagactttgtctcaagaaaaaagaaaaagaaggaaatattcagggggtatttcacaatctgggctttcccctttccctgataaaagaacaaggggatttttctcccacctttaactgaagaacttggtagacctcttggatgtaaaatgaataagagtgtagccccttccaagactggacctcaaagggttttcatccctcaaactagtcaacacccggtgtccagtcattagtcaattatcccttcagttttctggttgttggatctagtgttgacttcttttggtgtgctgtgactcattctgtgtgttcacctgtccttctggttttcaaagggggcagtggtttgccctgtgatcctgattatctgaaggatctaagaaaaattactaattttcagtttagtcagcatttttcttattgtgaggaccagagtgatgatttctaaactctttaaaagtcagataagactaatcttgttttttaaattaaaaaaataagtatgtagtaactagataacttcagtaatctgaaagtctgaccttcaggaagctcaattatacctaaaggcattgtacatgtatgtttataaaaactacctgtgacaatgaaaaagtaggctctaggcagtgaaaatatactgtgtgggggcattcaaaggaagttatatcagaataagaaatcaaaaatatttgcatctttgtattattttactatgtatttgattatgccagtatgtttctagagaagagaagagaaacaataaaatcccagtcattgtttatttcaaaatgtccttagttagctctgcgtgcaggcaggccaccataaatgtgcatccacaaatccaagtccacggtccagggggagtttcctgtaacacaatgcaaaactgagatataatccatcaaatactgcagactcaatatatatttgcaagccaacaaaggataagaatcccaaggtcctctgagtaaaagttgaaagagcacataaaattatgctagccttaggaaagaaattggagaacaggacaaatgtttaggttctatttaatattatttgcctgaataatatggagtcaaggctctgaaaaaaaaaagtagatcaaacaaggatgatttttccaagtgattttatcaccattttttcctttagtagaaaaaataaataaaaccaactgcttatctgttggcgggaaagatatttttcagttaaacaattgcacaaggccgatgttctgctggcctgcttcagtaaggctctaaacattattaaaatatttcttttcagcttgttggtaaagccactgcccttagacctccagatgcccctcatcatgaaacccttcccgagagtcttagagcacctggcctttgtgcaacacggtggatagtatttgcagtagcagaggtccagcagaatcctattagcatgtttgttctgggccaatgcccatactctactggttgctaaatatttggaatagcatcctttaaatcatgaacaaagcaaactatgatgtctggttgtattttaaaaatatatattcttccagtctttcaaaattactttttgatgtaacttatagacaggggtattatttagagtttaatacttgatagaggagatatcatcaataatttcaatcctacaggcatttaaatacaaagttatatcattcaatgtgattgttaaatttttgtatatacacacacacacacacatagaattgtatctgaagaattaatagtatgacatctactttgacatcatccttgaaaatatattatactctgatattgagaaatttgcagattttgaagtaagcccttctcaaaatattcttaccaagaagtctttcagcataaaagagacagtctttcatattcaatcaatacacaatgcaataaacttctgtggacaaaacataggctatgcttgtgattcaattagaaaagtaatatttctgttgaattttgtgtcaaaacaaaaggaagttacaacaatgaggaaggagaggggtgtgcttcgctggagagtgaaataattaattttgaagacatgcagctatattgtactttatttgaaagcaagcaaatgcaaatctttttcttcatcattgtgagaaaagaacagatgtttctatttgacatcaaatattttttcctgaaagcaagtcttagggacagcactaaagttggtatccatttaatcctacatctatgtacttaactatagctgaagcactgtataaaataggtgaacagaaattagaaaaaattaagtagttttattctattaaacgggtatagaattgtgaaattctttagaaaagcattctatagaaaaaaattaagtattctattaaaagggcagagaattgtgaaattatttagaaaagcgttctatagaaaaaattaagtatttttattctattaaaagggcagagaattgtgaaatactttagaaaagcattctatctagaaatgtttttaaatactctgagtcagagctgtctaatcgaacattttgtgatggtggaaatggtctgtgcctgcattgttgagtacagttgccattagccacatgtggccagtgaggactagaaatgtggccaatgtaagatataacctgattttttaaatttcattcatttttaattatcttaaattgaggtttcagtagccatgtgtgcctaatatactttattagatggcacagcccaaaatatttaaacttcaattatctggaaactcatttaggtggaatgtctcaattctgaatgattattaatagtggcataatttctgtatttgtgtttttaatcaaaaattaatgttgtgtgctttcagatgcttgctctaacgacctttaacatgttaaagatcatatataaacaatactgaaaactgcaaaattaagacaagttcatttccaaccaaatcatatatgcattgacaacaatggtagcaaacatcaggaaagctttgttgttgatcttatatgcatattgagagtttctctttttacgtgagacaaatccccaagggatccttaaaaacaaatatttttttcttctcacaaagcaagttatccttccaataaattcttaacccattaaagttacaaaagaaaaagccaagtcagcagatgtatctatgcttgtaaggtattcttgacctattgtgtactcacattcaatcaactagtaggagctttggtaacactattattttcagctctactgacaaatcagtatcctaaactgaaataaaccatgtggtctcagcatggtgaaatagctacaatagccatttctctggaggggtctctatgagggttggtcaagtgtatgtctcatgatatgacttttctatttggtaatgtgtacgaaaaaatgcagaaatcaaactgtggaaaatatttttagagataaataactctgtcatgcttaatgttgaacaaaatcaaacatcagaatattaattagtctccaaactcattttttaagtattttttctagcatttactttatgtcttagtctgtttgggctgctataacaacatatcataaactgggtggcttataaacaacaaacgtgtttctcatggttctggaggccaggaagtccaagatcaaggtttaagcagatctggggcctggtgagggcttgttccctataagaagcaatttcttgccatgttctcatgtggtagaagaggaaaacgagctccctcaggtctcttttataagggcactaatcccattcatgaaggttccgttctcatgacctgatcacctcccaaaggtcccaccttttaataacatcacattggggattaggcttcaacctgtgcattctgcaggggacacaaacttttgaaccatagcacttcattcctgaaatttgttccatttgtctttccatttctctctcccttctttgttccaagtcttctttattttaatttttttctctgacaaactcctttcatctgtgctttctcttatttcctcttcaaatattttaagtgggagacttttataggtcatatgtctactttgattgttacctgtgttgtatttttaaatagactctgaacaaattaatataaaaaatgcagctctaagagaaaagaacaaaatgtcaaatagtaaatacattttgtaaattgcaatcatggagagacaaccttttttgcattgacacacatggtcagttttcaagtatgtcattgccactcattgtaaaaattacttaatgatgccacacagcacacagtctccagtatgctacatgcgttataagctcagcctcattgcccagtcccagcaattttactaaattatagtctagtagtgagatacagagaaggagaataagagaaagttttagttagtatgacctggaagccagaacagacaaaatagatactaatttgttacataagtctatagaatttttgcagttagaggcaatcttagaaaccatcattagacagatgaagctaatctaaagatgggccaagtgactcacgcgaagtcaggaaatagttaatggcaaagtttgactacttaaatttcaggtcctgtgtctatgttcccatcacactcttacaaatgatatacacttaaatgtaatctgggccctatgtttgccaataagattagaaaatactcactagcctaatgtgaggtcaattggttaaccaaatagtttaggaaacactagcctcatagaagggtaaatattctccatatcctacataggtcaggttggcttaaaaactgaacacgtgaaaaaattctaattctatattaggatgttaggataaaaatagtctcaaacctcatctagtcatcttcttctattgactatatctgcattgtgggcaagacccaagcatacctatgggctctaaaaatggtggttagaggacatcacctaaattttctttcctgtcaactttccttgaagagaatatttcttttagctagatggtcagatccctgaaatttctggcacatcaaatgatgacagtgtctctcagctgagagaagcggcctctttgctaaaaggatttgactacctgtttgggaggcacccttgtcccctaggtcatttaatgattttcagatgctcagacaaatatttcccttgctaatgccgtgatgagagcttttggctaaaaagtgtttaggatgagatgttgaccagtgcctcagtatattaacttgcatcatcagtttgaatagggcagactcttagtccttccaggctgtgatcacaaaacccgtaaactgggtggcttataaacaacgaatatgtatttctcacaatcctgataggtgagaagtccaagatcaagatgcaggaagattcagtgtggtaagtatttgtttcctggttcatagatggtaacttttttctgtgttctcgcatggtggggagggcaagacagctctctggggtatcttttaaaaaggcactaatgacactgatgagaagtctctacccttatgacctatcaccccgcaaaatgctccacctcctaatacaatcttcttggtacaacgtattagtctgttctcacgctgctaataaaaatatacctgagactggataatttataacgaaaagaggcttaatggactcacagtccacatggctgggagacctcacaatcatggcggaagacaaaggaagagcaaagagacgtcttacatggtggcaggcaagagagctgtgcaggggaactcctatttataaaaccatcagatctcatgagacttatttaccaccatgaggaaagtatgggggaagctgccctaatgattcaattatctccacctggcctcgcacttgacacatagggattattacaattcaaggtgatatttgggtggggacacagccaagctatatcatatggtatccaactcattcttaggattaggattttaggttaggatttccacgtatgcattttgaagagacacaaacattcaaaccatagcagacagagtttctcaagagataccttatggacatcttgggccaaataactttgttgtggtggatgtcttgtgcattgtaggaagattgcccacatgcgtggactctagatgccagtaacacccctaccagtcatgacaataaaaaatgtctccagacatagccaaatgttccctgagagtcagaatctttctagttgggaaccactgtggtagggaaatggagatgaagtaacctttttctctaccattgtgtttcgtgtgttctcatggattctcattggttctagcgatatttgagcaaactgaacagaaatgggtcccaccctcagcaactttatagcccaatgagacagttaggcattaagaaagtaagtgaatataattctagattgtgataagaaaatgctatgaagaaaaattaaaaaagaaagagattcatggagatcttctcagcctggatagccagggaagagctatctgtcaaagtgttacaatctgaataatgaatgtgatttatctaaatgaatagtataccatgctaataaattattccaagtgaacaggcggccgctgaatgtccaaagtttggatgtttaatactctgcagccataaaaaaggatgagattatatcctttgcagggacatagatggacctggaggccattatccttagcaaactaacacagaaacagaaaaccaaataccgcatgttctcacttataagtgggagctcaatgatgagaacacatggacacataaaggggaacaacacctactgggtcctttcagagagtggacggtgggagcagggagaggatcaggaaaaataactaataggtactaggtttaatacctgggcaatgaaatctgtacaacaatccccatgacacaagtttacctatgtaaaaaacctgcacatgtacccctgaacttaaaagttaaaaaaaaaaaaaaaaagattcaaaggcactggactctactatttgaagtacagacttgcaaaaattctacattagtgcttggcaatagcccagcaaaatgcactttggcagtgaaaattagccacgtcgtaaaatctgcaattcgaatgtatttacattcacaacattcaatcattattctgtactatctattggggcagaggcaacacttttcatgaccattctgggtggccattgctgctttttctatcacagccatttcaagaggctgggacctgaagccccagtgtgtgcctgaagtctttggaagtgtttctaagtcaccacaatactagcacagactcccacttctattcacggccacctcttatgcctggcccagatcctcttcatttgtgatgggcatggggcctcactccattgtcttcagtataaccttcattataatacagtgccttactggaaggaggccttcaatgactacatgttgaacacattatttaacatataaaaatgatctcaacagaatcaataaggtaaccacttgttagaaatttctttctttttgttgggattttttttgtggttctctcttagaaactcttgccacagctcttcttcattcatgattctccaggcctgggctgcactccactgccagagtcaggttgaccctgtgactctgacaccatctccatctctcagaagggccttgctctttaaatttttagttcaacatgacctttgaaatggtcaagctttcctctgtctatttcctattccttatttccttttaagtctgttaataggttccatgttcaactaatggaaactctagaaaagaaagttttaagcattatacatttgtgtcattatcaaaataagaatgtgcatctgtaatccttcaaaggttaactctttggtttcagccataaaatgcaacttgagtcttgataactgatggagaagtatgtagggtaggcatagcacttttttttaatgcatggagtaggaaattcaaagcgacatttttgattatgtatgcatcagcaactgtgatttatggtacctgtttgtgtctgttacatgagtgatgggttcttacgccaaaaataaagttactatattcacacctgaggcctgagaagtaacagttcagtaaaagaagacaagactctataaaaaataccaaagaaataaatacaatgaacacttatagcctgtcttcttacctaagaacttattactttctaccttgtattattaattttgacaactgtgcttctgctcacaaacctgtaaattgctgggctctgcttgcagtgaagctactaccttcattataatacaggaccttaccggaaggaggccttcaatgatacatgtttaacaaattacttagtatatataaatgatctcaacataatcaataaggtaaccacttgttagaaatttctttctttttgttggcatttttttgtggttctctcttaggagacttttgctgaagcttaaatgctttaaaataatttttaaataattaattactacaaataaatgagctatttagcctgaaatattaaagtgctatttccagaacttatatttctgtaattaaaatgccagttttgttctctccgggctctgtttaagaaaaaaaaaaaaagtgattttttttttttttttttttttttttgagatggagtctcactgtgttgccctggctggagtgtggtggcgtgatctcatctcactgcaacctctgcctcctgggttcaagtattctcctgccccagcctcctgagtagctggaactacaagtgtgcaccaccacacatggctaatttttgtattttttgtggttttgccttgttagccaggctggtctcgaactcctgacttcaggtgatccacctgccttggcctcccaaagtgctgggattacaggcgtgaaccactgcgcctggccaaaaaaaagtgattcttaaatgcagatgccttggtcaatttatgtatgtttgagatataaattataattcagaagtatgaaggtgccaagatcactatgggaattaaatatgatattttaagagattttgagaggcttattttctatatatgaatggataaagtcaaccacagttagaaacatcatttatctgggtaacataattgtgatttcatctgtaaagtcaaatacaaggcagcattatgtggattaacatttttttccatattatagaaacagtgttaaggaggaatcttagtcaaattccatttttttaagagacaaaacaaaataaaactgtgattgagagttcaaagtccttaactcactagtagcagaactgggtcgtgtttatgaacttttctcttcactgtactcaccaccatgcattctaaccatgaaagcaattgtagttctacagcaccacaatccatgctagtgctgatacgagaaacctaaaatgaaagggaaatcatatgtaacattgtgttgattgattgaaatgtgtgactagattcagaagtacaagccagaagtttggggaaccttacttctgagaatgggccagttctgactctcagtcaagcctaaagtttgttgctcagttggaaacaaaagcatggatatgattgtccggagaaccctgttgctgaataacaaagaggcataagcagaaaggagaattcagaagcacaacataatctaaatttgatttatggcagtgtgcagtctggatgtctccagcttgtggtttcagcttctacttctcaagtagagaagctggatggtggtaaaatacagcaggctgaggagggccagactggagttgagattttctggactatgaactctgggtgtggggtgtatcttgagaggcatactggccacaaagggcggccggagggaaaaacaagttttgcatgcccatgctctgttcagagtccaagaactaacatctgtttagttttggaaacacaggctggctctgagtatggggatttagaacagcagaaaggtcaacattgtataggagagactcaatgttttcacaatcgattaggagcttagaagaattggggtggcaagactaagaagtgagctgcaaggatctgaatgaaaagggctgtcaggccaaggcccatcagcgaaggcagagaggaactggccagagaccagggcaggaagtgtggctcacaattggaaagcagtgtcagaggagtaagagatgaatgaaacatggattaggattaggattaggagctaacgggtacagaaccaggacacaaacacaaaatctaagaactaccagtcaatcctggaatatgaaaacaaatgtcatggggatcagaattttgtctcaagggaactgtagtgttgctgcttagaagtgcaactgatcccataagtggggaaaatgagacacacacagaaaagtataggacaagaggcctgactgtttcctattctcatcccttcattcttgttgacacagattttgattgaggtttgaagtttaccatcagaaccatatctttcctagaaacagagaaactacccaataagtaaaatcaactacagtatcctccttgtagttttgtcattatttctcattagttttatttcacttatttaagtagcaatgaagggataggcagtagatgacaaagttactactataggagcactctgaggcattatccttcctcaccactaatgcacttctgatttttttcctctgttctcctctcttatttagtcttttacatataatttgggttttacaggcaatgtctcacagagtcagtggccactgtgactgcttcttatcctcattagagcaatcactaatttaaaatcagtcaccatttgaaaacttttaaaattatgtcacaagactgtaggatatttcaagataaggggctagtactcctcactcatatatatccggtcttggcattgggaatcattagccaagttaggagctctccagctggcccattgcaaagcaatgcagacagagggaaagttgaggcacctgcctggttcactgggtttgattgcttactaatccttcacttaacttggaacctccttgctcaacctcttggctcaggtgctggggagaacacaggttggcaagatgcaagttctgccttgcaagcatttttctcctgtatatgcacacacacacacagacacacacacacatatatgtgtgtatatacaggagaaaatgcttgcaaggcagaatttgcacacatatgtatgtatacatacacacacatacacatatattttatatatacatatacatatatattttatatatacatataaatatataatatataatagaaaacataaacatacatatatgtatatattatatgtgtataatatatgtacatatatgtaaaatatatatgtataatatacatatatatccatgagaatgccagaaacaatatatgtataatatatactatgtaatatataatatatactatataggtatatatgttcatatttataatatatatgaacatatttattcactgcttaaatttccactgttaccatgtgcctggaacagcttagacataactatttgcttttgagtagactgaccctagaaacaccatactgtattcaaaacaactagtttctaatcatggaattaagacactaaggtggaaccatttcagactggaagtcattttgaggttcacactgaagctatttcgtatatatctcattatatatacatatcttatgtatacatatatagtatacacatcttatgtatacatatatagtatacacatcttatgtatacatatatagtatacacatcttatgtatacatatatagtatacacatcttatgtatacaatatagtatacacatcttatgtatacaatatagtatacacatcttatgtatacaatatagtatacacatcttatgtatactatatagtatacacatcttatgtatactatatagtatacacatcttatgtatactatatagtatacacatcttatgtatactatatagtatacacatcttatgtatactatatagtatacacatcttatgtatactatatagtatacacatcttatgtatactatatagtatacacatcttatgtatactatatagtatacatatcttatgtatacatatatgtatacatatcttatgtatactatatagtatacatatcttatgtatacaaatatgtatacatatcttatgtatacaaatatgtatacatatcttatgtatacaaatatgtatacatatcttatgtatacaaatatgtatacatatcttatgtatacatatatgtatacatatcttatgtatactatatagtatacatatcttatgtatactatatagtatacatatcttatgtatactatatagtatacatatcttatgtatactatatatataaataaaataaaaaacaggaaattgcttggtgccaaagcacagaagaggaagataataattttgaggtatttgaactggactttgaagaatagaaagtttttttttttccctaaagcagtgaaaacagttgaaaggccagaatgatttatttcaagtgttacctttaaaagaatattaatacttgacagtctcttcacatatatgcctgtttcttttctttcaaaaaaactaaccccatgactagaattttgatctacttttgcctttttttttcttttttagtttaagataaaataaatagtctaacatctgtaacatatcatggctgaatttggttatacacaacatgcttcattttcatatcatatcttacttgagtttaaacctgcttttcatattttactcctttctgttactcaattcaaaagtatttgccatgaatgacttcataaccatacattttagatggtctgcttgggatttttttttgccttatatttttctattggcttattttcctttattttaatatacacacattcccttaatgttgatttcttcacgctgacctgtacccctcccttaaaatttattgccagagatgaaatgcccttgataatcttcaccttaagattcactcccctctctgaattacttcatttggttttcaaaactaaaacttataagaaatctcagactcgcaggaccctaaatataacattagtaatgcaagagagataaaacatataaaagcaggcatactcaaaaagatacagtacaaaatactgaaagaattaacagaatgagaaaaggaagcattaaattcacatcaaagaaagctttgaacattaaagcaaatgaaagtgaggggaagaaatctatatggaagccaaacaatcactgcttcctgacagctgcagttattaattagtgttccatcatttgcactaaatggtcaatcaatacttttgcttctctggaaggccatttgctttgtagcttgcttcttaatgggaaatgattcagcttgtccccttctttgtcattctgtccataactaccagcttggcagagagttcgtaagctgtgctggctctagataagggtaagaattttgtctccagatttcagttctctcctgcccaaccacctcacctgcaatctattgtttatattgttgctatgtatctctattctttctgcatcaaataatgaatagctcattttgtgttgccttcaagtatgacaaattcctttccaaatgtgattccagacagtatatccaaacatgtctttcttttcccattcctgatcatcctacatgtcaagcactgccaacgtttactcaagaaagcttggttagaacccagcctctagaagcagtagattcctactcattcctgactcttttagccacttgtcgtatggcatgagcaggtgtcttaacttctctatttatgtcatcacctcctgtttcctatccacagagctaatacctagctcagagcattattgtaaaaataaaatgaactagcatatgtatataaaaagtaaggtggttacctggggattggaagacacttccatcatatttgttaagtgaatggcatagagcaaataaaaaaaaattgactcattattcttattattcttttatatgattactgctctctcctggagtgcacttctctgcctgactcaccctttaagatacatctcatatagaaactccacatgaaagccttccgtgacgcatgatcatggctattcactcctctattctgtcacagtcctttgtgcatttctcttcatagctctcacacttcatttcaccatactgcacatctgattgctttactagactctgagaatcactgttgctagaacgtatttgttcactgcttacatttccactgttaccatgtgcctggaacagcttagacataactatttgcctttgagtagaccaaccctagaaacaccatactatatttaaaacaactagtttctaatcatggaagtaagacactaaggtggaaccatttcagactgggagtcattttgaggttcacagtgaagctatttcatatctaaacctcaggtgagatgatatttttttgtaaacttagggttaacaaacctatttataattattgtgttaacacaatgcttcatgtactactgatttttcttgaagtgtatacctataggaaatagaaatgtccatggtcataggaacatagaatcagacaaaagttttcgagttaagataactaattggaaatcatatggacataagaattaaataaaaatgggttatttctagagatatatatgtaactaagaaaaaacaaagataaacagatacttgatggcacattactgaatttcaacaatattccttcaaaataagtgacaagagatagtatagtcactgtgatatatggtcctgtccagtgacgttctgggccctaggtctagacccattatttgggttaccagaggttaggcgcttaacctctttctttgctagttttttcatctgcaaaacaggattgaataacactcttacctactcaggtaattcctaccctatgagaagggaaagagataaagcaagtacaagtatttttatactctaaaactctatagaggccgggcgtgatggctcacacctgtaatcccagcactttgggagactgaggcgggcagttcacctgaggtcacgagttcgagagtagcttggccaacatggtgaaaccccgtctctactaaaaatacaaaaattacccggttgtggtggtgggcacctataattcccaactactcaggagactgaggctggagtattgcttgaacccaggagggggacattgcagtgagcagagatcgtgccattgcgctctagcctgagcaacaagagcgaaactccatctcaagaaaacaaacaaacaaaactctatggagtcaaagatactgtgaaatacagcaagtccctgggcctttggtgactctgtatattaacagagggctctcattcaagaccttatctattgtccagcattatttgtctactatgatattcatcttttcaggacctaatccagctggacctctacttttttaatggttctagttttgatttgtatacagtttcagcagcaaactccctacaggccatacactagattcacgtccatttggcactgaggaacaaaagaaaatcaccctacctaaagtgatggggagcaaaatattgcttttgatgaatcactaatatagttttatctagctacagttttgtcaaaaagagactattgttgcaaaccaagttaaatagttttttaaaatattttttattgtagcctaatgaagattacttaattgcctgtttaaaggacttggtggaaaaatatgtgaaccacagctttagaggcccatgagctttgggcagtctatgtcatgttcatctccttatccccattgttggctccaaaactctgttagagtgttcagcaagtgttaaactgctcctaataatgcctaagtcacagtgttggatctcaggtggtgcagacttacctatcccaacttgagagaagaatgagcagccgccataggtcattaacatgccgcctgcatcattcacttacccactaaattgaggtacaaccagatggaaagaacatgggtttttggcacatgggactggatacctgaagtatggaactcattcctaaacaatggctggaagctttgggtagattccctgacctgagaattgtatggcgcattgttaggaaagctaagtctgcaggaaaaaaaaaaaaaaaaaaaggcatgttttggggtcctggctgtgctgtaagcaggacaaattcttaggatttctggtgctaattgagtgaccttatacataccatttcccctcctggggctaaaagaagatcagagaggatcaaagaaatcagtggtttaaaaaaactcaaaacaaaacaacttgagaccctaaaacagtatttggcctttggaggtttttgtttaataagtttaaattgtccccaaagtgtttctaaaaggcaggttgtgctttgctgcaatacaaacacctttgtttctgatgccacacagcaggcttgagagaagcattggtgttgtatttgccctttgtacccatctatgtttgacactcattgaccaaataggttaacattttaggagtctatcattctataaaccacctgagtgacctagaacaagtaactgaatgtctccaagccccagatttctcatttctcccttggagatggccattataatatctgcctacctatgtcagtggttattatgatcaaaggagatcaatatgtgagcatgctttgcaatctttaagcaggaagaaatgttcattagtgaggaaggataaagcttaagcgggagcttggactagataactgctagacaaggtcatacctctattatgcagttacagtatttgataataaaatgtctttaataatcaggaaaattaaaataaatgggggcctcaattatatctagaaagatattcaagaagacagactctcattagaggagaagtctgtggcaagaggcaaacaactccaagattggtttcttaactggttgtgaaattgcctccgtttatcccataagcagacctccccctgagtggatttccttaagagaggttatataggtgaaagatccttatgcctggcagcatattatttagaaatagtccactttaaattgccatggagagaaccaccaaaagatgcagagagctgtttgtgtcacaaatgttaagctataatctcactttcagatttaacctagttttctttgggaggccgaggcgggtggatcacctgaggtcaggagttcaagaccagcctggccaacatggcaaaactctgtctctactaaaaaattaaaaaaaaaaaaaaaaaagccatgtgtggtggtgggtgcctgtaatcccagctgctcaggaggctgaggcatggagaattgcttgaacctgggaggtggaggttgcagtgagccaagatcacgccactgcactccagcttgggcaacagagtgagactctatcataatgttattaaacatgtaaaagaagcatctgacaataatttcaaataagctgcttaattttacaaaggcattccattcctgttttggcactgccattggtcatccatgtgactttgagaaaactactaacacaaataaaaaataacaaatttaacttagttttatttaactcaccttggttttattcattgagtagtgatgatgatggcaagactggggaaatggtagaaacttatattaattgaggtttttttttgtgccagggacgccacacagctctttagcatttcataaagtatcccaatgatcctggaagttgagtaatgcattatccctaccttacagatgattcatccgaggcacatttgtgttagcattttgttcaaagtcacacggatgaccaatggcagtgccaaaacaggaatgggatgcctttataaaattaagcagcttatttgaaattattgtcagatgcttcttttacacctttaataacattatgatggtatgaaaacacattttaggcagcagccaataaacttcaatataataacaattaccatcctgatttgatacagaagcctccaacttcaggtgttcttttaatattctatatgctagtcgattttgtttaccatacgcatagttataaacagtcagtgcacatgttgttgactgacctaaatatttacactgtcacatattattaaaatctcagtgcttttctccaattctgtaagattaattgtctactaaccaatgaaataatttgaatttctacttttcttcttataagcttaggctaatttctatcaaagagaagtttctcaaaaatgaggactggaataaaagcttctgtggcttgttcacagcctcattgactggaagaattgtgtctcttggtgggtaactgtgcatggggtgctaaggactgcttggagtctaagtgggaaaatggcattctgtgactgggaacctctgttccttaaaccttttctgtttaattagaaggaaggatgtcccattttatcctcacttaaagagcaatgaaatgattaaaaatagtgttttaatttcacaacttaggagcaataaataattttgagtctctggctgtcactatcagttatcgctcaacttaatattgttgaagtttagataaggacagatggttctctcttctcagtattagttctgttgcttggcagttaattacctgctactgtgactccctctcccatcaccaagaaatcataaaaacagaaaaagtaacggtatctttctccaagaagtttgctttgtctcatggattggttcctttgacagttttttatttgagagggctcctcttcgtgttcctaatatgccaaagttaagcatgcaacctcggtcttcatgttcacaagttgaaatgggcgtgtgcttcttttacaattatgtccaatacgctaactgaaagtagaacatgcctttctcctaggggttttcaaattcataggatggtttacatttattagcttctgaagtaaggaagatttctcttacaaaaataaatcactctattttttgttaaattgaatctactttgttccccacccaatgttgatgcaataaggagaattttatttgttctatgacttttcaattcttgcacctgatttggaatatcacatcattctgtctgccccttcggtcttgttttatttgaatctttcagcccaacagtcagctttgctgaggctacaaagaaatgcagtgccaccaaaatatgagagaataactaagctggacatttcacaaggctgctgatgtgagaaaatacaattttagcaagttttaatctatgtccctaaacaatcttaagttgaaaatattgagagaagtataacagtaggagacaatgttttgcctaattttttcagacttcaaattagtgaatcgaaatcatgttaaaaatttgcaatttcagttcacaggcagatttctagattttaatatataacagacaaaccacttcagcaattacttttgcttgcactgtggtttttgagaacattggagttttttccatattttccattatctctgagtttttcactgaattttgctatctttacatattctttctaattgaaaagggataatttgttcgtccttgaattcagttttcaaagacatctgaatatttgaaattcacttctctttctccattttttttttgatgttatcctctctgtgttttctttttaaggaaaggtaaccttttgattttgttgtttattttttgaaaactattgtttcaattatgaaacagagataggaaataataatccgataaatgtccaaaactatcattatatagcatgacattcagtaaatacccagtaggagtgctggcttacattgcagaaagacctgcagagacccaaatgttgaagcattgaaagagctgaatacattggactgaatacatagaattcttccctaaaaaacaagggaggcaagtactgtttttttggtttgtttgttttttctcagttttcaccactaatttgcttataaaggaaagaaaatttgagtttctgtggactcttgttttattacattcatacaaaacttttttttttccagttatttcacaagaaagaaggtgtttagttgtccacaaaggactatgcctctggtttggtgcaatttctggttttagtagttcttatccctattgtctactccaaaatgctgtcagcacagtttctccagccccatttatcatcctgtagagtagtacctctttactggctcactttcaaatacctgagtttgctaatgttgcagctttccacgttacaaaagaccctggtagcctccctagagaaggcaattatctattatgcttaggggacacaaaagtagctcacggagggaagtgcctacatactctgctcatgctgaggctgacctaaatcaatttcagatgcctataagtaaaaattgagctctgtatataaggttaaagctgccacatttttattaaagaattatccttctaggataactgcaaatgttgaataattttcatggtgattacaatgttcaaaggaactccaaaataaaaaatagaaatgacacctattttggagtatcttacttccatttccattcactgtctgttacgttttcactctttattatagattgtatgtctgtctttggtttggttctttcagtcttatgatgtgttaataaactattatagactatgtagaggatgtaatcattaaatacagaatacaaacaaaactaatcttttgaaagctattatttagagaaagagctagaacctatgtaaacatatatatattctatatatatactctctatatatattctatatatatactctctatatattctatatatatactttctctatatattctatatatatacagtatatatatagactatatatactgtatatatatagtctatatatatactctatatattatatatactctatatattctatatatatactctatattctatatatatactctatatatatactgtctatatatattctctatatatattctctctatatatcctatatatattctctttatatattctatatatatattctctctatatattccatatatatattctctatatatattctctgtatatattctctatatatattctctatatactctctctatattctctatatactctctatatattctatatatattctatatatattctatatatgtattctatatatattctatatatacattctatatacattctatatatacattctatatacattctatatatacattctatatacattctatatacattctatatatattctatatatacattctatatatattctatatatacattctatatacattttatatacattctatatatattctatatacattctatatatattctatatatacattctatatatattctatatacattctatatatattctatatacattctatatatattctatatacattctatatatatattctatatacattctatatatatattctatatacattctatatatattctatatatattctatatacattctatatatatactatatacattctatatatatattctatatacattctatatatattctaaatacattatatattctatatatatattctatatatagtctacatatatattctatatatagtctacatatatagactatatatagtctatatatgtagactatatatagtctatatatatattctacatttatatgtgtgtgtgtgtgtgtatatatatatatatttttttttttttttttgagatggaacctggctctgtagcccaggctggagtgcagtggcacgacttcagctcactgcaacctccacctcctaggttcaagcaattctcctgtctcagcctctgagaagctgggattacaggtgccggctaccatgcctggctagtttttttgtatttttagtagagacaggttttcaccatgttggccaggctggttttgaactcctgatgtcaggtgatccacctaccttggcctcccaaagtgctgggattacaggtgtgagccagcatgcccagccctcctgtgtaaacatattaaacgataaggtgctcactattttctgagctgtacaacaggaacaattgctgaaaagaatggtacctgaaccctgtattgggtgaccattggccttttgtgtcctgtgatgggtagggcttggcctaggacttccagacactaataccctggggtagaatgcaggcaattagtaattaattgcactgatgtgtctaacatgttgtagtagtggcgattattgctccatttaattcgatgagtaatttagacattaatgcaaagttttagaagtagcagcaatcatttatattatcctttctcaatacattaatagtttaggaattttcattctgtggctggttggtgagatgagatgaggccaatgaaaactccttggcccaggggattggagatttgaaatatttactatgtaagtgacattgttagaaaacactaggcattatgccaaaattacaattatgggttagtgttatggactgaattgcgtccacacacacacaaaatatatatatatatatacacgttggcgaggtgcagtcgctcacgcctgtaatcccagcactttgggaggccgaggcggatggattacgaggtcaggagttcgagaccagcttgtccaacatgatgaaacactatctctactaaaaatacaaaaattagctgggcatagtggtgggcatctctaagcccagctacttgggaggctgaggaaggagaattgcttgaacctgggaggcagagtttgcagtgagccaagattgtgccactgcactccagcctgggtgacataacaagactccatctcaaaaaaattttcttaataaacatatatgttgaagtcctaaaccctactccctgtgaatgtaaggttatttgcagatagggtcctagcagatgtaatcaaggcaagatgggtgttggggtaggcactaatttaagttgactggtgtccttacaagaacagaaaacaccatctggcaatggagatacagtgagaagatggcaatgggaagatagaggcagaggtgggagtgctgcagccacgagacaagaaacaactggggccaccagaagctagaaggggacaggaaggatctgagagctcatggtccagccaacatcttgagttagattttagacttctaaactccacaattctgaaccagtaaacttctactgttctaactcacccgatttgtggtacattactatagcagccctagggaactaaaggagttagaaaccttttcatacttatttagacttactaaaattatacctatcacaaaatattcacaaattggttcaaagaagttgatcagaatgatgatatatatagccaacggttacattcaattaataaactacaaatgagaattattgttactaatgactcacctgggaagaactattaaggtaatttaaagaacacactttatatttagagaaattagctaaatggtcaatgcagttcaatcagtagttttcttatatttactatttcccaggaactgtagcaaaaacaaggatacaaagataaataagagaagacattatgaaagttggttctctatgaaataataaccaggtattttcttttagaattcttgtgtgaaacttcagaattctctataggctattgcattttgttcccaatgctcaggtcttatagtagtgtgcttgccagataaaatatggaggtccccgctgaatttaatttattgaggcttttttgttttgttttgttttgttttgtagtaatatgtcctgtgcactcgttgggacatacttatgctaaaaaagttgttttctggaattcaaacgttactacctgccccacattttcatttgctagatgttgcagcctgggtagtagtgaaagtcatatgcaagatatcaaaggtgagaaactgaagaatcaacacttggaagtggctacattcctacaatctcacttattgccaatttgctatctcaaggggcttataacaattttcagtcatctgtagtacttaagtcttaggaatattttggtgattaaatgaagtagtacattgtaagtgttagaacagttactgttgaatagttagggccctgtaactgttcgtttttatttttttttcccaaatcagtgtaatgcatagtagagcattttcctgtattttgaatgaggatacaagagatggccacatgtgtacatttgctaacaatgtctaatctatttgtcaatactgaaagacacatctttgaaaaaagatgggtcttgttccgtttggttttaatcactttgtaagattccagttcagtgcctgatgagcctctgactttagaagcatgctgttaaatctaaacttttttttttttttttttttttttttttgagacagagtctcgctctgtcgccaggctggagtgcaatggtgagatctctgctcaccgcaacctccgactccgtggttcaagcaattctcctgtctcagcctcctgagtagctgggattacaggcgcaggccaccatgcccagctaatttttgtatttttagtagcgacagcgtttcactgtgttagccagaatggtttcaatctcctgacctcgtgatgcacctgccttggcctcccaaagtggtgggattacaggcgtgagccaccatgcctggcctaaatctaaacttttatgtgtccagtgtattagttcttagggctgctgaaacaaaaccacagattgggtcacttaaaacaacagaaatgtattctctcacagtgtggaggttaaagtctgcaacccagatgttggcagggttgttttttctggaggttctgagtgactctgttcccggcctttctcctggctactggcggttgctgttagtccttcgtggaccttcacttgcaggcttatcactccagtctcggcctccatgctcactcacatggtggtctcctcattgtgtatatctgtgtctcttcttacaaggacactggtcatataggattagggtctgcccgaatccagtattacctcatttagcttcatttcatctacaaagaccctatttccacactaggtttcattcacagatgctgacaactagtaaaacaacctttgcagacattataacagtgagaaaattatggcagtgaaagagatctgatgtaatcaacctccattttgcctttagccttcaaactgcccttaattattcctgggtttgggacaagctaatttggggaaatatttagtttatagttaaatgataatagcccttctcaaccacctttgtaaagctaatgagagaccaccaggtttaaaggatgagaggaacttaaattctgctacggtgtagacataaaggattacccaccattatttcaaaggtcacaagatacacaacttctctaattactcctgcagataacatcactatttgtagaaccaaagattggcctttccagatgtcttttcaggtttttttgcatgcacatctgatgatggatggctccacctggacccactaatcactccagtgaccccaccccgagggactcagcatgcgggaggaacatcttccattcccctgggattgcacccccaaccaattagcaagctcccattgccaggtcaccccctttcttccaccaaattatccttgaaaaaccctagcctctgaatctgggggaagactgatttgagtaataataaaatttctgtctcccgttcagccagctctgcatgaattaagctctttatttcaattcccctgtcttgataaattggctctatttgggcagcagtcaaaatgaacccattggtcagttatactaggctttcaacatactttgggtggacacaataaggaccagtggctatacttcaggggtattttgaaaacctcaacgattacattttatattaataggcatcttttttaacatttaaggtattctctacagtgtatcattggtatagagaaacaaaggttttctttcaaaaagtgttttcctcaatatttctagaacatacatttaggaactatttagggaacaatatctaggtaacaatacatgaatattatatttaaacactttatgatttgattgtaaaacaaatttcacagtctagaattcccaatgctttgagaagtaaataatgggggtaaataaaataaaattggtaagagaactattttttttcttttagcttcccttattttggggccttcatctctgcattccaaattacttcattatttttaaagtgccattcaattttcaattgtataacaagtgtttgctaagcaattacgtaaattttcttgtttaggtgggcaattagatgaactgaatgctaagatattttaagctaatattcttgcatgaaaatctaaattttctcattttccagagaaatgttaataaattttactcagccatgcaattaaataaatgccaacacttagattattactattcttaacaattaacaaatttcacaaatacttccaaaattagagtggtgtaaagagtagtcttggattgtgaatgacctcattttacagtttactaatctataaatgaacattaagtacctaataataatgccattgtcatgtttaaatactttatattagtaaagaagctataacagattttccatagcatatattcaaaatatattatttctcttttcctctccatttttaaaaataaaccacacagtcatgcccattaaatataaccagatatatttacttgcttggttttccttttgttttttcttgtcggggaattatagggataaggaagagattgatttttgcttttttttctgctgaagttataaatgcttgaatttggaattattttgtaattctagttgaaatgtgaaggagcatttactataggaaacatatggtcctataaaccagtatcagcagttttcaggtaatcaataaaataaatacgagatatccccatgataccgctattgtccaataaacgattacctgttacacagtgtcctttgcattgtgtaggataaaatgacagattatgtacaccgattttggtaatttccaggaaacaactgactcacagaagcttaggtggtgtacttggaatataaatgcacatactaatggagctgattttatcattcttaaagcataatcaaagtcagtagtttactaccactgaggagaatgatgctttagatcccagggcacttaccacaggaaggatacagggatgaggccatttgtaagccacatccagaagatggtgagatgacctctgtgttcctcacataagaaatttaacaccagcacttacccacacacactaaaaccaaataatttggatagcctcgttgtgattcacgtacatgtttcccaattgccggcaattttcactgtcaggctgactaaatgcagatcattaacttacagggtcatgtttttcaggccgttttggtattatgtaagaacattctcaaatctataatagcaagctctacccagtaatatttatagaagcgtatgtgtaattgttagtaggagaaatatctgaagacgattttattcgctctgtaaatatgtaggtcagggtcttaagaaaatgctcattgtaaacatttcttttttggacagggagatgtccctgatgttccccctagatgtccattgaagtactactcatgggagattttatttaggccacctagcattttgctgagcattctggttgtcagaaaaagataaagcacctgctgttatgttgttgctcactaagtagagaaggggtccaatggctaaaccgacgatttcaactcacggtggcaaagagcatcacgagcatgctcaggaagcacgctgaggaggcgggcacccaaccgaacctgcagagacggaggacatctttctggggagacaatacctagactgagttgtacaagatgaatacgatttagttgtgtggcgtgatgtttcaggtaaagcgttcatcttgagaaaatgcatagaataataataataataggggtctgaagaagaagataagagtggtatggtctgaccaggtctgtcaagataagtagctgtaatgagggagtggggaggtcacggaaagcttgtatgacttgcaagtgagtttcacccttatcagatatgcaatggagagcccttgatgtttattgcaaataatgcgagccagttttgtcattggcacttactggttttttgcttgtttgttagatatctgtatcttccagaagttactgaagataatggctacaggtgtgtcaattggcttgcttgtggtaatcatttcacaatgtatacctgaatcaaaacatcaggttgtacaccgtaaatctatacaatttaatatacacaatttttaggctgcaaaaaaaaaaaaaacgaaacaacagcctttgtcctaattccattacacattaaaacatgtattaactagtagaaaaaaagcacagtctgttcttcgagttgaataaaatcctcagctttctgtccttttagacaatctaccatgatcttaaatgaaaggcttaagttcaaatgtggcagtgttccagaagtagtactgtgctgcatatcaggtcagaaccaggcagggtgtaggctgtttaccatagaaggggatggcctcttagtgccaggtcgtcgttctcagtggaaatatatttagcatagatcaactggctttggtttcttcttaaactctgttcagaaaaaactctgagaggtggctacttgatattttaaacttgaccacaagtgttgaataccattcatttcaactatgaaaaaccatttccattatgaagtagaaaattaaaccctctggggctgatccacgcggagctcagttgaagtattacactttctcatctcaggaaggtgggcttctgatgagtctttccattgctgactaagccccagcacagcaaacctgttcttcattagggctcctcagacagcaactcaccacctccagggagtagcttaaaacagctgacccatacacatatactgttgagacaaaagtcttttcaattaaaatagaggcatgatcacagtgagttttaaacaggagattcatatgagcagattctgatttttgaaagacgacagtaaaagcagaatggaagtgtcaatttcagaaaggcaagaggatgtacacaggttacctaggaggttactgaagcagtcagtgctaaactatttgtattaagaaaaaaaaagagcttaagagaaatgcacatttatactgttgtgtcaaactccaaaaataaatggaaattgtgttaaacaataactagtatagatgagtaattttaaatatatgtatatatatatttatttgtatttctaccagatgtgtgtattaaatatagatatagatatagatataataaaacacaggctagagtttattaaattactatcccttatgatcacagccctgaggtccattataccagtttggttgttcttatctctttattgtttacatccattttctatgcaaaatgtgaaaggagctacctctctaaaaccctcggaaagattttcaccttgaaaataacaaaaaatggacagcttcttgtaaatctaatcaaagctctaacatgttttgaccagttacatagtttttaaaaggtgagggacagtagagctaatttaaaatgctaacaagtttttaggtaatcaatcttaacaattagatgattaatagctggggagttaatcatccccagtcacaaaagaatggctctgctcctgcttcatacacaattaattgtgagccagcaacgtcttgccattatctactgtgtctgaacagctattgagttgaggtttcctttatcatctgatgatgtataatttgattgtttcccttaaaactcattcctaaccaaaaatcaaaagaaacatactgagactttgatgatgaaaataatatatctaacatttaaaataaatagattttataacttggtgacgaactcagtttgctctctttccctactccaataaaaattattggttctgaaactaattttgacatttaatatcacattaactttcattgtcatttaattgctccatgtcctccttgttttcccatagattttaaacccctaggccttggacatatttctgaattcctcatcccattttataacattgtacacatccaataaatgtccacaatataattgaacagaattgagatcatgacgttttatctcagtaacttgataggcttgtaattatacagtatgccctaaagtgttgaattacataatctctacccccttttattttcttttacctgattcatttcttatttataactaatgtttattaatatgtaaatatgccccatcctttcctcctgaccgcaacatatatatacaaggactgtggtttctgttttatttacatttgtgaccagtttcttgaatgagtggctaaataattcagtgaatagaactcctactatctgtttcattgacttagtgagtttttaattctctcacttagtgaaattttacttgtcatccttgtttttatttccaccacttcccattcctaaggatgccttctattctataccttagttttagatggttaccacattgatgaataataatcaattctttttattttatatgaatgcaacatcagcttccattttcaaaggaaccttctatccacagaacacaaactaggaccgtgctaaaatttcaggagcctagtgtttattgtgttcataaactcatgacattttccagcttgaggtgatttaagaggccatgtagcacaaacttgtattttacagatgagaaaactgagcattgagcaagttaaatgatgtaccaaaagtcaaatcactagtgaatggcaactgagactgaaatcaaagtcccctaggcctggctgtgtccagattgtacgagtgcctcatgatatctaagctacaaaaccatgatgggggatgaggggagagtcttgctagtgtctcacagtgcggctggatgacaagttaggaacaacagcaggactgaggcaccagagttgctaggctatgaaacacatcacgtggaaccatggaatcacgtgcaatattttatttattatttattattttatttttattttaatatttgcttaatatttttatatatttttattttaatatttgcttaactgttttttatttccatcaagttgctcatttcaatgtttaatgaacatttagggaacagagtccaagatctgggttcaaagacctgagcagcagagtgagatgaaatcaagaaacctttcataaatctaaaaaatgatctgtaggctgttgatacaactcacaatatcagattggcagcctggaaattagtatcttcagttgaggaatacattaaaatcttaaactaaggtctttcaagaaacttaaaacagcacggatagaagtgtgtttttaacgtataaaattatttgtgcctgggatttaatttctttaacacattccaaaattcctttagggcataggttttgttctgcacaccactgaaattctgcataaggcacagtgtctagaacccagaaagtattaaataattttttgaaaaaatatactcatgtatatattccttagtttttgtcaatagttatttgatatttagtaaaaattacattttttgtctatatatatatataaaagcatccaaaatgatagagaatagagtgatatctaatgctaactgcccaaattacacaattattcccagcgagtacctatcatatgctgaggaattaatctgtagattcagatacagtacagtggccaagattcaccaatagatttctatttttttcttatacacatttaacatcagaatttgaacatcatagaagtttcaaaacagtttgtagaagctacttaaaatttgtttcagatctcctgtaatatacattttattattttgaccctgcaaagcaaatatcatttttatttataaagccgatgacataaaagcttattatacagaaacttgcatttctcatttcctaaaacttgttttctcttcacatgttatgactttgtttcaacttaccataaattcaccttgctgttccagttaaacttgaaatttatcgtgtactccttgctgctaaccagtaagtcagtgaggaaaatattgtatgtcagatgcttttctcagctctattttcctctcttgttggaattgccttcttcatttttttgtgtgttgtatatgatattctactgcatttttaaagaagagagataacttcaatgcatttataattcaaaggtttactcatgttgttcttctgttccagatgatagattttgaaccattctttaacactgatttggccatcataccaaaaagaaatacagttgtccctcattatccgtgggggaattggttccatgaccccatagataacaagattcaaaatccaaaatcggatgcttcagttctttattttaaatggcatagtattttctataacctgcacacatcttcctgtatactttaaatcatctctagattacttgtaatacctaatacaatgtagatgctgtattgatagttgctatattgtattgctatttgcattattttttattattgtgattttaatggttttgtattttcaaatatgtattttcaatctgcagttggttgaattcccaaggatacagggtgaaagtgtgactgtgtatgtataaaagaaactacattttcaaaagttgatattctaatcataaaaaatagactgcactaatatataatcatagaccactaatagaaaagatattaattgggattgagaatggaaatcctatgctggctaaaaagtctctgatgagctaaatagactgattttgctaagagctactctttcaagagcccacgggaaataggtacttattcagtttagtcaaacattcaggaatccagacccttagtaatttgaaactgtgacagctacaaacttgaccaatgtcaaatttacctatttcccatcaaaataaatatttacataggaaataaatcataaaaacagaatatttggggatgaagcattattcttttcagttgtcattttattcgtttgcttattatttatagtgttttataattaactgcaaaaaacaaaaaacaagaaataaaatatatacatttaaattcattttaaaatttaaattttaaaccatgttttaaaaaatctaactttagattttgaaataactcagactattttgctaatttgtttgaactagtacagtctcatattataataagattaagtgacatttacttagtttgactaccctttcctatagcgaataaactgacatttaaaaagttgctgcttgctggcacttaagattgactgatgaggatgtgcagtcatggaggaagagccaggactgagaaagaaatataaatgaggaaaaggaagagagaaaaggagccagacaagacttgaggagagatgagagaaaggaaatactgtttgagggtagaaataggataaatgaagtcacagagaagaggctttcatttccacatctgttacttgaccatgtccatggtatgagagtttcatagttctttttctgtttttgcaggctgcatgctcaaatattctctataaaacataaacccatctccttaccctctcttcatttagcatttattttcaagatgctggctacattggtacattaatttcttatagatatttaatgagtcagttcacattaactggtgttcccttgcttaaaataataataataaagatgctggtagcttgtacctatgattttggtcaccaaaatacaggatgtttttccattacccagtactaataaaaggtgaggtacagaggtacagtaggtgagacaaattcataggctggcagcagcttagtttttcctatatttgaccccaactggagaaatgtgtattattatttttcaaggctgggtatagagctatatattgttgagctgttttattaatataaatatatagagagttaaaattgttttcaaaaagcatgttaggagttcacctaatgggagtgactgagaagaagaaaatgcacagaatttagtataaagaaatcccaaataataacaataaaaaagcataaagtatatctgaagatttatgttcaacaacctagttcaaaatctataagaaggaatgatgatattatcacacagaaaattatcttatgtgaggttctagaactgactgtaggtgtcacacaaaatttagacaacagagattctgaggaaatcaacatatcctacatcaaggaaatagattaaaatgtggtatggtctaaaggtaagaggtctgaaccaatattttaaactacataatgcaagatatactaatattagattctaaatatttttaaatatttgtgatgttacttgtacttgaacaaatgaattttgaacatgcttcataattctgaaactctgccattacttaatgatgctaaaatatgcataatatcctctcctcaaggaatctcgatgtgttttccaaaattaaaactgtgtccaaactgagttttccaaaatccttaattttgagtaatgctgttatctttcacctctggagtgttcacaaaatctatttttattttctgaaggagtacagcgtgtatatattaaacacagctaaatgaaccgagaaagaaatccagatgtttaaccatgaaatctaaattttgaaagagtcttttgaaaatatgctgaaatgttttcaaaatatcatgatgatcaaaacaaattgttattggaatgaccttcactgtaagcagtattaacaatccggtattatacagaaagcatacatctttttttgaaaaatctttgtaattttaccattcagtgataaatataaattcctgaaaatgccattcttaccagaaaaccagtcaatatggttttacattagagcttttaaaaacttagtttgtggccaggcacggtggctcacgcctgtaatcccggcactttgggaggccgagacgggcagatgacgaggtcaggagatcgagaccatcctggctaacacggtgaaaccctgtctctactaaaaaatacaaaaacaactagccaggcgttgtggcgggggcctgtagtcccagctacttgggaggctgaggcaggagaatggcgtgaacccgggaggcggagcttgcagtgagccgagatagcgccactgcactccagcctgggcaacagagcaagactctgtctcaaaaaaacaccaacaacttggtttgaaacatgtatatataaatgtatatatttaaatatacattgtggctatacacctctaccttctctgtattacttatctatgtttatagctatttatatacatgtatatgtatgtgcatatatatacatatgcatatatatgtgtagagaatagaactgtagttactagcagcttggaagagtagagggtaatagggagagattggttaacagacgtaaaattttagctagagagcgggaataacttctagtgttctatagcacgttagggtgactgtagttaaaaataatttagtctatattttcaaatagctagaagagaggatttcgaacgttcccaacattaagagatgataaatgttccaagtgacagatatgctacttactctgatttgatcattacctattgtataagtgcactgaaatatcactttgtacaccctaaatgtgtacaattattataggtcaattacaagccaaaataaaaaaaccacacaaataactcataagaatacaatataacaattattcatatggcatgtatattgtattagtaatctggaaatggtttatagtatgagggaggatgtggataggttatatgcaaacactgggccgtttgacataagggatttgagcattcctggagtttcatatggagcagggtcctggaactaatcttctgcggataccaaaggataattgtataagaatcttggcagcaaaattgtggcagttcagaactataaaaaaaagtcaaagacaatgggaaaaaaagactcagtcaggtgtccttattctctgcttttgatggggcactgagacattgcctgtgaggatttgaggattgattatttccttgtgctaagtgttttcctgaactatgtgttttacctgaacattgaaaacctaccaccacatctgagggaagaactgttgttatttacctatctttcatgaggcaactgacacaagtagatattaactaacttgactgttagttgctgctactaaagggcagagatgattcagagtgaggcagctgcactccagggttccagctctcaaccgctgtgctgcactgcctcccaggaaatactgaagtgctaagcatggttgcgggtctacggatgatgcattacagtttatggacagaaaaataatcaaatgcttcatctgaagaaataaaggattaagaacaatagaacatagattcttcagaaactggatcatatgagtaaggtcacagaaaagtaaaaaagtaacattgttgagttttctgccttttcaataaattaatgactttaggaaatatctattagagatatataattttaaaatatacacacatatatatatataaacttttattcaggtatgttagagagaaccagtagagggagcttttagccgtaagtttactttctattgtgaaaggaattaatcaaataatgtgtgaagaaaaataaattctaaatatgattattatttacgtgatacttcaaagcatccaaaaaataaattaagaatgttatttttttcagttactttggaactcagttacaagacatatttttatttatagtaacaggcaaaatgtatttattgtgtacaacatgatgttttgatatatatgtacattgtgaaatgactaaatctggctaactattctatgcattacctcacatagttatcttttttgtagtgagaaaacttcacttcaactcagtatttttgaaggacctagtatattattaattatagtcaccatgttatacaatagaactcttgaatttataacttctgttaactgaaattttgtatcctttaatgaatacctcctcattccccaccagaaaccctagcccctggtaaccagcattttatttattttatttctatgggatgaactttcttagattccacatatgaatgagatggaacaggtataacgggttatgcataaagtgccttatgtacaggttatacataacgtaccttattatacgcttataacttatgtgtaacaagtataaggtgagatctcattgggttttaatttgcatttatctgataatcagtgatgatgaacatttttttcatatacctgttggccatttgtatgccttcttttgagaaatgcctattcagatattttgtcttttgtctttctgtgcctgatttattttacttaacataatgtccttcaggttcatccatgttactgcaaatgataacacttcgttcttttttaatgggtgaattgtattctattgtgtgtgtgcgtgcatatagatagatatacaaacacacataccacatttgctttatccattcatcctttgatagatgcttaagctgattcaatatcttagctattgtgaataatgctgcaataaacatgggagtgcagatatgttttcaaaatactgatttcacttcctttggaatatgcctagtagtgggatttctgtatcatatggtaattctattttcaatttgttgaggagcctccatcctgtttttcacaattgtactaatttatattcccacaaatagtgtgcatgggttctttttctccacatcctcaccaatacttacactttctcattttgataatagccattctaacaggtataaggtgatatctcattgggttttaatttgcatttatctgataatagtgatgttcaacattttttttcatatacctgttggctatttctatgctttcttttgagaaatgcctattcagatattttgcccatttttaaatcaggctattttattgttgctgttgacttgtttgagtaccttatgtattttgaatgttaaccttttatcagacatatagtttgcaaatagtgtcttccattcagtagattttctcttcgttttgtttattgttcctttacctctgcagaagcttttatgtttcatgcgttcccatttgtatatttttacttttgctgcctgtgcttttgatgtcatatctaaaaagttttattgccctgaccaatataaaaatgctttcttctatgtatttatctagtagtctcaaagttgtgggtcttagatttaagtatttaatccattttgagttgatttttgtatatggtgtgagatggggatgtaatttcatcatttcacatgtgaatattcaattttccaaacagctatcaggttctgggctcttctttgacggtagacattttattactgatttaatctccttacttgttattggtctgttaagattttctgttttttttttttcataattcactcttggtagatggtgtatatcaaggaattaatccagttaagctaggttatccaattttttggtgtataatttttcataatagtctttgatgatcctttgtatttctgttgcatcagttataacgtctcgtctctttgtttctgacttagtctttctctttctgcctttcttaggctaactaaagatttgttgattttgtttatctttctaaaaaaatcaactcttagttttgttgatcttttctatcacttttctagtctctattttattgatttctgccctggtccttattattttcatctttctactaactttggacttagtttgtttttgtttttcaagtttcttgaggtgcaatgttaggtcatttacttgagatcttcttttttgatataggcatttattgctataaaacttcttagaatggataaagtaattcttagaattgcttttgctctcccaggggttttggtattttgtgtttccattttcactggtctcaagaaattttttaaagttttcatgaacattttttcacagactcattgattgttcagaagcacgttctttaatttccatgcatttgtaaattttctgaagtttcccctgttcaatcaaactattgatttctagttttatattattatagtcataaaagatacttggtatcatttcaaaattctgattttttatgaattgtggcctaccatatgatctattttagagaatgaatatgcatagaataatgcttattctgtagttgttggatggaatgttatttatatgtctgttacatacatttgatctagaatgtagttcaagtgtaagtttctttgttttctgcctgggtgatctgtccattgctgtaaatgggttgtaaatctcctactattgttttattgcagtctatatctctttttaagtatattaatacttggtttgtatatttaggtgctccagttatgggtacatacgtatttacaattgttatatcctcttgctgaattaacccctttattattaaataatgacttatttttacctttttacagtttttgacttggagtccatttaatcttatataaatatagctacttctattctcttttggtttctacttgcatggaatatatttttctatttattcaatttcagtctatgtgtatttttacaggcaaagtgagtttcccatagacataccatttaaatcctgtgatatgaaaatttgcctttttgatgctgtcacataagtttcataagctttttttcagtccttgtcattctttatttttttcttctgactttatattttcaaataacctgtctgtaagttcacaaatattgttttctgcttgttcagtttttcttttgatgctctctattgtattgtttgtctttcattgtatttttcagctccaggatttctgtttttttttttaatttaatccctctaatgaatttctcatttttttacttattattattattgttttattttgttcacttctctgtattttttgaagttctccgagcttctttaaaatggttattttatattattttcaggcacttcatgtattgctatttctgtatgatgtcactggcaccttaaaatatctgtttggtgttgtcatgattctcattgttctgatctttgtacttctatgtcaaagcctgtgcatgggaagtcattgcttattccaatttttatagtcttgctttttctaggaaagccttgtggcaggcatagttctggggcgcatcagactcctgagccagtgttgaccagtgtagcactgccagaatcctgggtcctgctttagctggtacaatgctggggcatgccagaatccctggacagctgtgactggcatgacactgccaaaagcctggaacccactacagcaggctaggtgttgtgtttggctggaagcccacagcctctgagaattgcttgctcctgagggctacccaaagcctgggaccactgatgtcaatatggcagttgtgtaggccagagataaatttcactaagcaagcttaaagtgtgaggctatgtggtctcacctggtgagacctggtgtcctggtgggtctataggctcagtctgctggtactggttcggaatatggagctatgaggggtctgctggtgcagagttttcctgtgagtacccagtgttgtgtccaggaaaaatcctgtgctcacatccctttcattctatctagtggatggcatctctttccatactgtgctgcctggggttgggagaggggtgatgtgggtattgtaaaactgtgattcctaccctttcaatgtgtcttttcttattattgtactacaacgaggcactgtgatctctcacgtggtaaaaagatcctagcccttgtgacgttatttttgtgcatagatagctgttcagattgatgtttctgtgaagggatgcttgctggagagtcctactccactgtctggctcccacaaggcatttttgactgctcatctgttgctgtgctggatattatcatccacaggagaattgcaaagatgggtgcctagacacaacgagcttataattttgctggtaaaattgttagcttattagaaatgtattgtgaatgaaatttatacataatagtgtattggcaataagcttgacaaagaagataagcaaacaggagttagaaagaccagagcacagagaataatagctgttcccgaaaagacaaaggatatgaatttatggtgaagactgtgaagggaattttcgatgggaaaatattatgagcaacatggctgatttaggaatgggcatggagggtgaggaatcatatacatacaaccaaaataaaaggttaatatgaaggatataagacacagatttgaatattgcatgaggccgcaagtgctggcaaggagatgaaagtgatccagatggtagtaggaaataagaatacattctataatgagattgcagcaggaatggagagggtaccgaaggatggagctagaggataattaggaaatataaaaaattggaaggaaaaaaccctaacaagaggcaatagcaataatccaggcatgaagtgattaactttgttagatgtgatgtgctgtttttcaagccatataataaactctccttactgaacaaaacaataattatgtgctttcattctcttgcttctccttttagactgtgttaaaaaaaaaaaaagaaaatttaagctagttttggcagtgttccagtgagccagtttgtggcatttttgtccatctgcctttactttcatggtttactgattgcttattttgcagtcttttgtttattttatttatttcttcataaactaaataaataacatttatctaaagtatcagctggatataatggggatagatgtccagggtaattttccatcatacttaaagtcttctttaggagtacttttcacattccactgccaaccactgaccaccagtatgttcacctttagccttcagaactcacggaagaataggcaagattaatcggatcataaggatcatatagaaaacttataaaaatggtaagggtaaaaaatataaattggggtcttcaatgccagtccagagtgtaataatgaacaactgtaaagtttatgtatgaggtgataattttaagtcaactcttttgagagattagcatggggttgtccttagaacggactgaagagcggaagattagcagcagagagagaaatcagaaggctgtacaataggataagtatgaattgatttcagagggaatgaagaagatttaagtaggtaatgagagaagagtaaaaaatcaatgatttactagatgtaaagactggagaaaaaatgtcaaagatgactgatatacacagtttaaacgattagtactgtaatagatatattcgggaaacgagctagtatttagttgaaaattgtgtgtcatttttaggcacattgatttttggtactcacagttgatataggcatatgtacaaatattttaaagctatttctcatattctcatagattccataaagaagactaaaattctaaaggttgaatagccttcatttttttaaaaaaagtatagaactcattagaaattagatttttttcagaaaaatatttggctaaaaatagtgaaatctttttttttaattttattttagatgtctgcatcgaaaccctgataggtatttcatgctatttcttttctggaatgtgaaatccagtattaagtttgatacatcaatcagtatgctatccactctgacatagtgaaattgattagtaaaaaaacaatgcttgtgttgtagaattaaaatttcctttttcttattattatggagaacacatgtcagagtccataggaggtacaaacaggtattctatgacaagggacttgaaaaggtggtgtgtttgtgtcccttaaagttaaaccatcagtggacctaattagcataagttatagatgccttttttcctgaggttgacaccatggagttatttgtcagggatatttttcatccctggaatttgtctttgaatgcatcttattacaaactagtgattcgaccaaattatggatgtacatcatttgtgtttagctaaatagtcacttattgtgtaaagacattttttggaagctctagagtaattcactcttctatgcactcctgcctatgcagtgacttttttttttttaatgtgtcttaagtacttgcctgaaaatcataaccatgcacagtacaagtgtctgagtaaagttacacaaataatattgtaatatgacaatacacatccctcaattagtagcaccaagaataatgcccttgcagtagacctgacaatttcaaacaccatacaatagggaacagcatccaagacagccaaaccctctgtcatggcagaaacagaaacagcctgggaaatgttacctccatattcacttgtggtagtaatcataactgtttattgcttaaattagagagaaagtccaggaaaaaaatttcttatttagctgagtagttttctcattcaaaaatgcatttaactttaggccaggagtggtggctcatgcctgtaatggctcccagcactttgggaggctgaagcgggcagatcacttgaggtaaggagtttgagaccagccttgccaacatggtgaaactctgtcgctactaaaaaatacaaaaaatagccagatgtggttgcacgtccctgtaatcccagctaattgggaggctgaggcaggagaatcgctggaacctggggggaagaggttgcagtgaacagagatcgcactattgcactccagcctgggtgacaaagtgacactctgtctcaaaaaaaaaaaaaaaaaaaaaaaagcatttagatttaaataacatttaatgagaaaatgaacaacctggttaaatatcaaatgattaaacttacattagatgtatagaagctaccatcaaaattaagccttatttactgggatgatttcaaaggtttctattcttatgctgattattctgtgattatttaaaattggtagaaagatctgattctggctcactcacttctgcttcttccatttaattagcaagtatttgccaagtagttattatataattagcattgtgctagagtctttacgatgccaacatttcaaggagcaaattgcttctctcaatgtctgcattgcttgaaaatggagttgttaagtcaaaactcttaagctgccagtaactttctccctctgtttaatagtttaccaagacctccaatgttggaactatcttgcatgtcacaccaattaaataaaatgggtgaatattttcaaattcagtggtggtaaatgtttctagaggaacacagctgtgtgagtgggtgcaatagaactggatttgatatcaagtggccttctacaagtatgattttccacaaaaaaaacacaaagcttaagttaagccctgttattcctactttctctaccttcagatttgagtgataaagacaatagaataaaatatatcctctaagtagaatatttgcattatgtaagctaaaaagattggctttttaaaacaatcaagtggtgaatattcaactccctaatccaatcctttttctttcagaacaactttggaatttcaagatttcaaggttgtgtgctctagggctttgaaaggcagagtaactgaggataattctttgcaaaccataacaatattaatagaatcatcccatcatggttttagaaaacaacaacaaccaccaccaatccattactaaattttacacccaataacattattaaggaccaaaatggatttaagttttttcactttatttacaaacatctaatgctaggcacccagaattagtcctaattgtgctaggtattgctcctagagctttaaatttattatctcatttgatcctcacgataaccctataagtttggtatcattatcttttattgaagaaaagaagtctaaggcaaaggtaagttaaatgacttgcagaggatcacaaagtcagtgggtgattgaaccaagatataaacaaagacaagatataaacaaaggtatactgactttgccatcttaaaagtctgttaaggcggctgggcgcggtaatcccagcactttgggaggccaaggtgggtgtatcaggaggccaggagatcgagaccatcctggccaacatgatgaaaccccgtctctactaaaaatgcaaaaattagccaagcgtggtggtgcacacctgtaatcccagctactcaggaggctgagacaggagaatcgcttgaccctggaggtggagattgcagtaaactgagattgtgccactgtactccagcctggcgacagagcaagactccatctgaaaaaaaaaaaaaaaaagaggtctgttaagggtaacatttgccattggtagataaggtttcccttcacaaaagaagagaaactatggcatatgtgcagtctatgccttctgccacccactaaatagaaagggtgcatgtatcttggaagagactcgttaatcaaacagatgtgctttcaataatggtgaaatctcttcattaagcactggcagtaagtcattacaatatcttctctagccttttggctgtgatcaagggtagactatcttctcattaggataatggggttcaataaaagagtgttccatcgttctccaaaagggagtagagtggaactttttgttaactataatcatttagtgattcattttatcttttttagatcttgttaattcattgttgcacaaggttaatcctttatccacttaggctatggttttgacaaaatgtgttggtcataaaagttaacttcttaaaagacgttaaagacagtttcaatgaacatcagtaacataatgtgtggaaataagaaaagtattttgtttctatttgcttgcccagagtgatattaattaaagcatgatttatatattttaaatgaaataattgaggacatttttgacatatgttttcattttttgtggcaaacaagatcaggagaaaattataaatatttgagttaaacatgtatttggcagtaatattgtttgtgactaaggtcagtccttagtctcacaagattatattatcatgtaaaagttataacaataatagatccatcaaaaattggaaaatatgaaaatgagtctctccctttgagttttttaatgcaattttaccaatcaaatatgacaatgatgaataattttgcacatttacttttagtatcttccccctatgaaaatgcttgtattataaaattttacctactggtaattacagttaactcacaaacttccatcctgattatgcctacttaccattagatcaaaagcatttgccaatcatatccttttaaataatcatttgaatggttctgatatttcaatgataaaattctgtgatttagttttatgcttatagttggatatttgaattatcccagatgtttttgctattataggtaacctagcaacaaagaagttttttcctattatcttttttccatatttggggatatttctgtagaaaataatccccagaattgaatttattgaatcaaagagtataaagctcttgatacggagtccctgaattcttaaggaatatgtttaatccatctatgtagctctggaaactggcttactacctagtatgctcgttacttacatttttgaatgtgttaaacttttaagaaaacctattaaatgactactttatgtgcatggctatctgataataatcttttgtacttataatagattttcctaatatctaataaattttcacatacattatctgaccttatacctacaaaatacttgcaaggggcacaaggcagacattttgatcatcacttttcagagaaaaaataaaaaaggacctaagagagattaaggatatggcgtagaatttagtcttcttacctggaacagcagtggctccattacatcctatctctgtgtacatgtgctttactacggaaagaatttgaaataagttgattttgttttcttttcagtgaataattgcttttattcttaaggaggaaaaatgtctgtcagaatgattttgtctgttttatagtgaaaaatgcataccactccttaatcatcatcatacaatttttctaaatgttcagtgcaaacatcaatatatgttaaagcattattttatacgtttaaacagaaatgaaaggcaaagatcaaagtaacccattaaactctatttatggtacttaaaacattagttagggcatttttaaatgtactatgtgtgttatgtaagtgtgagctctgaattacaaagtaatttaaacaaatacggattcctaaaaatttctcccaggcaagtccttacatatagatcccctataatggtttaagataattatggactgaatatttcttagttttttaaatttagagcattgattgaacattgatgaaattttttcaactttaaaaatgtattttataatatctatccaatatgattgaatattaaattattcacgggatgaaactgcctgctataggcttaatgaacacaatgtacaaaatatactagttttccgtcttttctcctttttttaaaaatttttatttactttttgaatcaggaaatgatcaacctgatttcagagatgagaatattaaagcccagagagtaaagtagtttgtccagatctatgtggtgttttcttttcttttcttttcttttttttttttttttttttgagaaggcgtcttgctctgtcacccaggctggagtacagtggtcgaatctcagctcactgcaagctctgcttcccgggttcacgccattctcccgcctcagcctccggagtaactgggactacaggcgccagccaccacgcccagctaattttttgtatttttgttagagacggggtttcaccgtgttagccaggatggtctggatctcctgacctcatgatccgccctccttggcctcccaaagtgctgggattacaggcgtgacccaccgcgcccggccccaaatctatatggtttttaaggatctttgctggggattcaaagcctattttgttcacttcaaacctcagctcttctcgctgaacaaaaaggcaattaaaagaatgatgatagacaaagttgaaagttcactagtttataatttttaaaaatcctatgccaccatttttctttcagtagtttagacttaatacgtttttgaagattttaactcaatgtaatggaaaacatttataatatgatggaaacatttttaatgaagcttttcaacaaggagttcttaaaataaataaactttgtggtcaaacagagattaaatggctatctattaagaacactatggaatttctattcaaattgggtagcagactaaatgacttctaagatacaatcagtttgtgatttaattggttcttgaatggatctgcctctggcttgtagtctttatactgtaagcatttatacaacaagtctgcaattcaaccatttgactacaaattgccgtaagtttttggaaagctattaaagctcctctaatttttacaaaactctcttgctaaagttattgtgtagcgagggcataccatgtgtcaggtattatgaaagttttccttccttctttctctttgcaattgctctatctacctatttatctaaaatcacacacatatataacatatacatatatacataggtatacatgtacatggatacatgtatgcgtatgtgtatctttactaaatatgtatctatacatatatgtgtatgtatctatatgtatatgtatatatttgtatctatacatatatgtgtatgtgtatctttactaaacctaacagcagttttctaaagtaaacacttttattacctacactttgctagtgaacgtaaagaaagtgaaacaaattgccaaagattacataactggcaagtggcaaagctaggactcaatctcatggacaagtgacatctaagcctttattcttaactactagattatcttatgataatttaaacttgtgtgtatgttttatctttttgttaatcatcagagtcaatgatattcagcatcttctgcagtacagaccaaggaaaacaaagccaagctgtcttaggcagccaaaaaatgactatccatgcaaattaaatgtcactatgttttacaaatttgtctttactattagacatcaactaaagtagttcagaaaagagatgataaaaccctgaatgagtgaagctatagaggaaaatgtgaatgaaaaattaaaaagaaatactaagtttaaacaaatttaattgtggtagaaatttaaatatagaagatggatttcaggggttgtagtattaccacctcaatatttggaggatctgtttacatgtcttctcctaccactggcagaagagccttggggttagaactttttctgtcccttgttatcttctcagtatctcacctggaccaatgctatggcatgttttcaaagataacctagtagtggtgatgaaaggcacagtttcttcatgtttaaagatgagccatgggtttccttttatattttctcacatagactcccagatctgtgaggtcctggaatgtacaagtggttatcctcataaattagctaacaccagaattcatctagtagcatagagcaaaggattgctctgccaacatctgaacaatcaaatcctggcccaaacaagccaaattatctcaacatcaactcatattcttaccacatcctgatgttcctatgctgatattgcttgatcatacagattccattttgttctcctatttgagagtttgagaatctgcttctcttctctttccacccctacctcaccctcctcccttggaattagagattgaatgatctcggacatcttgataatctctcctctctgctctgtatgctcagctactcgtcttacaatcattaatttttaaaatttaactacatgagtgtgccatttgtttttcccacctccagggaaaagagatgaacttgactcatgattttgatcccatgattcatcctcagcccttgctgttggatgtggcggaacactcactagtcctttaataaagatcagatgctgtgtggatactggtgggcttcttgagcaggttgctattgcctacctagaagcatttgccgaggattttcttttcttttgtcgtcagtgctataatatgccacagtctttaaattgacctcagtagtgtctcattgaacttaatatttagttcatttttctgctgacttttgagaggtggcatggccagaaatgtatatagtgattgtatcttttctctttttgccttatgaaatttacttaactatatggcttactaaatatataactggagaaattaaatagcaaaaattttactactttttccatgaaaagttaagtgtttatgtagtaattaattgcttagtccagcttcctgagatataaaaataatgctgataggcattaacaggcgatatgattcactacttttactcattcattcaattttatattccaaagaacatgttttctaataagaggataattaaatgtttacaagtgttatcttggaagtaaatccaacaataatttataataataaaatggtgtttgggttatacatgtggcactgtctcaaagagtcttaatagcatgggaaaattagttttattgtgcagatatattaataaatttaaagataatcaggataacttttgaacatttacaaatgctcaaattcgagcatacaaatttgagtatacaaatttgagcatacacatttgagcatacaaatttgagcatacaaatttaattaaagtatttttacctttttgccaacctaacatccttacgtgagaatagcatataattacatatcactataaagagcacattgtaagttatttacatattgttagactgttagaatgttacctgctaaattggagtgggaactaaacacacatacacacccactgactgagtctggcacatttctgggtcttcctttccttacaggaattaaagttcttgactaagtgattcctaagtttttcccaagtataacatgggtatacatttatgtttctaattttaaagaggctactaaatcttacattttatcatgctctctaattcctcttttttttatttttaaattttactctaagttctgggatacatgtgcagaatgtgcaggtttgttacacagttatacatgtgccatggtggtttgctgcacccatcaatccgtcatgtaggttttaagccccacatgcgttaggtatttctcctaatgctctccctctccttgcccccaacccccgacaggccttggtgtatgttgttcccctcgctgtgtccttgtgttctcattgttcacctcccacttatgagtgacaacatgcagtgtttggttttcggttcttgtgttagtttgctgagaatgacggcttccagcttcatccatgtctcttcaaaggacatgagctcattcttttttaggcctgcataatattccatggtgtatatgtgccaccttttctttatgcagtctatcgttgatgggcatttctgttggttccaggtctttgttattgtaaatagtgctgcaataaacatacgtgtgcatgtgtctttatggtagaatgatttatcatcctttgggtacgtacccagtaatgggattgctgggtcaaatggtatttctgattctagatccttgaggaattgccacactgtcttccacagtgattgaactaatttacactcccaccaacggtgtaaatgcattcctatttttccacagccttgccagcatctattgttacctgactttttaataattgccattctgactggcatgaggtggcatctcattgtggttttgatttgcatttctctaatgatcagtgatgataagctttttttcctatgtttcttggccgcataaatgtcttattttgagaagtctctgttcatatcctttgcccacttgacggggttgttttttgcttttaatttgtttaagtttcttgtagattctggatattagacctttgtcagatgggtagattgcaaaaattttctcccattctataggttgctgattcactctgatgctagtttcttttgctgtgcagaagctctttagtttaattagatcctatttatcaattttggcttttgttgccattgcttttggtgttacagacataaagtctttgcccatgcctataacctgaatggtaatgtctagattttcttccagagtttttatagtttggggttttacatgaaagtctttaatccatcttgagttaatttttgtatgaggtgtaaggaaggggtccagtttcagttttcagcatatggctagccagttattctagcaccaaattcccaattagccaaaaattggtttaagtgattcataaatctcaagtaaatctggatgttaaaggttgaaccttaataataattacagagtaaatggaaagtgagtgaatctcactggacttgtttctttagagccaagggttgaggcagagttcatagagcctgacttttatggattcaagttgtgcaggattttctgaccaaagcttcatcctgtgatttcatcttggtcagttaaatctaaataaattctactgtcatttactaaaatatttagggcattgttatgcaatctaagattatttacactttaataaatacatgaaaattctaattgtatttattgtgtcaagttttccattgcaaacactgatttatttttttcagtcaaataataactcaggaaaaaaaatagaccaggtgaggtttccttacacattatccatgctaccatttatttaagaaacatattattgatcttttatgtttttgcaaattccatgtaattaaaaaaaaaatgtaagaatggtcaatatctgaacttgcttctgtgttttccatgatgacctatttatgttgcattatagaatttaaccaactgtgtatgaaagtttagatgatattaacatgtgagtcaataagaaaagaactgttatacagaaatattggaatgatttgactttcaatattctatactcaattgtatgcaagttagataaaatcatgttgaattttatctcatgtacgttaccaaagcaatacaaattccttagaagttatataagtaaaaatagatttatttttaaattatcctggaaaacattgtcttggtattcaaaccattttcacctgtgtttatcatcagaggtttccatcttttagaacatttatttaccagttctcttgtatttttctcagctgtctgtttgccatatggtgttactttcagaattctctgtaatactgagaggttgtgcttgtggtaacataggataaaattccatgcagacttgaatatttgaaatcttactatatgaagattcaacctatacgaaaatagaagcttaaccataatttataggtattatgttagaaaaatcccagctatttctacatctattttttattcttttgtggacatgtagatacattcttagcaggcagatctggcctaaggcaagctagtggtatagcaacattggctttcctgctttcaataagacacaagttttattccccctgaagtttaatgcctcatatcttaatattctcttttgattcccttaaggcaaccacccatgaaagttgcattcagactcttcattctcagaaggtatactcaaatgctatttcttccagagacattttaattctagtaggagtcaaactcgtaaagaaaatggttgaaactctgagacaaattgataggtagcatgtatagttaagcctgctataaacagtaaaagaagcaacataaggtagaacattttcccctccaaggagaaaaaatcatgtccgttaagtatattttgattcattttttattgtaatttttgttatccctggaaatagaacaaaaacatgtgtcagctgactaccattgaacctgtacacaccctgcttcagcttttatccaatgagaaataaaattaagtcatgtaggttgttagagtctctctctctctctctctgtctctctctctctctctctctctctttttaactgaacctggctgcaataataatactgaccttgactgtgacctctctgtgtgatagttccattgctgtgccttagagtcgaatggtatctctacagttttttcagaattcttgggtaaaaaatgtagcaggtgttgtcaggggttaggaaagagaggctatttattctttccctgtagttttggatggaaataaatactttttaggtgatctgtttctaagaagtgcagttttccggaaaccacacaccgtattctcaaaactattttcctgtttcttccttagcatttagtctaatcatctcaaagtaaaggattattcttaataaaagaaaatacggctgctcacattaaatttgcttcaagtccaggagaaaacctgcttcaaattttttaaagacatttttgcctccattgtatatggattattagcccaatttataagagtaagtgccagaatacagtctttggtggtattttagggtgatactctcctgcaatgggattgattttagaatttgtagggtatatactagttgaggatgtaattggaatttgtgcctgtaaacctataagctccaatcctaaaagacacatgtttattcattcaaaaatatatatctagcattggtgttgtcggttactttgctgggcataaaaactcagagatgaatcagacacagtagagaatgtctgcaatctataggaaattatattctgaacagggacggactcaaaagtgtatgtgtgaatatatgtgctcttttaaatccaagaaaaatattttccacatcaccaattgtgccactgaaaaataaattgttattggtatacagtggcatttgaagatattagaaaactcaaatcaaaaagggaacattgctctgccatgaataaatgatgtttatacttctctttgcaaactgctatgtcacctccaggataacttgtcaagtgcattttcatattatgtttcaaataacactacccaataagtggaacttagaaaaatgtatcagtgtgcatattcttatgttctgaataataagaaatgtgaaatgtcaagtgatgaactaatagcaaacaaataattcaaacctctctaggttagcttgcaacacagagtcagaaagtgcatcaagaaaatgtaacagtgtgcagaatgaatttgtaaactgatttattgacacattcaaatgatacagtgctatttataggacactgtactatagatgttcctgcagttactggagaagaaactcttgtcctgtggggtctacagtgactgccttgcttcaataacatatgtttatttgccatatcgttgtccattttctaaaatagaatatactttgtaaggattttcaataagtttatgaatatgaaacgaaagtggatgactgaaggaattttctaggcttcattagttgacatgcactctttttgagttaaataatatgatattctagaatctaaattgattttctatgaaaatagaaacaaaaataggaaaaaataatattttgatctactccgttggtttacatgaatgcctgcaaaaaataagtaattttgactacctacaaaattgtatttttgcacataccttatagtgtctcttgttttaactaagatgaatttatgataaaaacatgaaaaaaaatcaagtggttaactctaatttgtttattaagctatgttagtaaaagcaactaatactggcctatgactttccaatttaaaaagaattttgtgtcatttcattgaactctccattagcatagtggtatgcttgataacattatcttctgggcaaaattagttgtactactataagtacccatatcactttcttgcggcattgacatctctagtatagcacttgatagtatatggtaggtatcttttcatatcttttctagactctcaagtctcattaagcaaaagatgtttattatctgcgccagtcacacacttcccaaattcaatatatacacacgggcttcctattggtagtaagactttattaactttgattgagttattgtttcaccaaatcgaaaactgaggttccaagatgttaataaatgtacccaagaatgcatatgaatgagaagtagaccaaaatgcaaaggtaggtcctctaattctaaatatcagttctttctaaaatcttgatcttccaacctttcctgttcttagcgcatttgaaattataggtctacacagtataagaaacattattaaaatgaatacagacatattttaaatagtactaaacatttgtgttataacacgtatatatgtaatttttcagaactgcttcctatatacaggtcacagggcactgcctcgtggttatttctaatccaccccacagttcaataactcagaattgtaaaatgtgatcaaataaagtaatcatgatgccaaattcccttaaggatgcatcatttttaaaagtttcttaatatgaacatttcgagtcagtgatttagacagctttgaatatcaatttttcatgaaaaagaacaaatgcgatgacataagcagacagtgatccacttgtgttatgaaggtagcagtaaatgggtgacaatttcttgaaatccagatatgttcaaatgagcagagttggcagcgtgtcctaggcttttttgacaaaggaatgcagtgtcattatctattactttgatgatttatctacgtcacagtaactgcttcaaacctagaaaaaggtaaaggggcaaaaagaattatttttcattgttctgctatgaatccatatcagcatttaggggtttgttttataatgttccttaaataagtttaatttctttacataagcaagtgataattaagtaagcacttttttgatagtaaggaataagctcacttttaaaattctgttctctcacaaacatttcatgacattatagaatccagaaatgtcagctataaaagagatcccaaggatgatgttcatttctcctgctttacaaatggagaaactgagattccacatgaatatgtcacttgatcaagagagttgacaactaaatggaaattagaacttaagttttctaaattcaggttcagaggccggcttcagtaaaaatataggtgttgggaaaatagtacagtgatttccatgagattgcagccatctcttcattattatggtcatgaatatacatatctcatttatttttcactgctatggctctatttcttatttcaaaatgtaaaaacagcaacttttctcatctcttggtggctatatgaacttcagcaatacagaattcagtggattgggccttctccatttcctatttacttctgattacattgttttctcatgatgcattttgttttcccatctggaattcattctctgggaatctcctctctgagaaagcttcaaaaccaaacagtgtttattttttgtaatgacattgcttgcactttcattctgtaatatctccattcagaaatctttaattgttcccaattcctttctagatgagatcgcaaattctctgcttagctttcaaggatcagcacactttcaatcactttttcttaacacttcccaaaacccacctggcgtattaatcaaactgactttttgtagcctctgattagtttcatttctgtacctttgcttgtttctgttttccttttttcctgcccacaaaagatgtaagatctcctttaaattgtgaaaatctctagattgtagtgcttctcttctcatgcactcctggctgtgtgaacataaaacatggaagaggttatcccaggtgtggtgctcaactgtctgggtgaggctttgatctcctgagttctggtctctgtttgccgctgtattggtgattttcatgctgctgataaagtcataccagagactgggcaatttacagaagtaagaactttaatggactcacagttccacgtggctggggaggctttgcaatcatggcagaaggtgaaaggcacatctcacatggtggcaggcaagagaagagagcttgtgcagggaaactctcctttctaaaaccatcagatcttgtgatagttattatgatcaaaagaataatgcgggaaagacccaccccatgattcaactactttccacagggtccctcccacaacaagtggaaattgtgagagttaaaattcaaaatgagatttgggtggggacacagcgaaatcatatcaccgcctacacctgacttcctttctgattcttctttcctgattagaactttcaggacttgaatctctcctctccttccctttttaagaccagagttaagcttcaacttgcttatttcaaaaacctcctactgagaagcactatcaatttgctacttatcactggtgatgatggcaaaatgatccaatcaattttcttccttcagttccatctaaaatgagtgcacacccacatatatgtgttgaaatgacttactttttgttttcttttggattggtatagtttttttatttttcataaaatctgtctgaaaacaattttatttagaaattaaacattatcaatactatatgtcaaggcaagcaactttctttggaatataatatatcctagaaatcaatgcaacatatttttacgtttagattacccccagatgcccagagcatttctttactggtgaaatacagaattcttggacttgacactgagaggaagtgtcagcagtgatctaaaaagtatttcttcttaaaataagggaaatgtgtgtgcttaaagacagagacattagaaaggggaggatgaacagattatattttttaaaaaatggttaggccgggcacggtggctcacgcctgtaatcccaacactttgggaggccgagatgggcagatcgccaggtcagagatcaagaccatcctggccaacatggtgaaaccccatctctactaaaaatacaaaaaaaattagctaggtgtggtggcacatgcctgtaatcccagctactcaggaggccgaggcaggagaatagcttgaacctgggagtcagaggagctgagatcacgccacagcactccatcctggcaacacagtgagactgtcaaaaaaaaaaaaaaaaaaaaaaaaaaaaaaggtgggtggggtggggtggggtgtgagagcaaggtccctcagaagttataaatggatgggcattagtgcatagctatctttattttccaggttaccccttatggaaaaaggttcgcagttaccataacaccaattaataaagccatatttgctggaaaaatcttattcaacagcaaagtatcacagtaagagaaaggacgtttagtaatttaatatataaaaataaaccttcggtagttttgcctgaaagaaggccagtaagtatcttaaacatcttagggagcttttacaagtgctgtagcccttgctttctgttttctagttaagcaaactttattgctttcaccaatgagttacagaatctatgactggtaattttagtcaaaaacatgagttcaattagatgtgaagatacaatcttggcatatgttcttaaatgagccaaacctcctattttaataaataaggtaaatgagcccaaatccatattttatggccattgctcagtgaatgactacacacactattcagtcacccacataagaaatcagtaatttttgtcattcttcttcctattacttctcacatctggttgaaaaacaaattcagtcaccttctaaaatatctttcaccactttcttctcttgtcattccactgccactgccttcattcacctctgtatcatctccaatttacctttttttttttttttttttttttttttttttttgagacagggtctggctctgttgcccaagctggaatgcagtggcataatctcgactcattacaacatctgcctcctgggttcaagccatcctcccaccttagcctcctaagtagctggcactacaggcacacaccatcacgcctggctaatttttgtattttttgtagagatgggttttcaccatgatgcccaggctggtctcaaactcctgagctcaagctatctgcctgacttgtcctcccaaagtgctgtgattacaggtgtgagccaccacacctggagactactaatttatactggtgtataatagtgtccaagtttctagaacattcgtccaataatggctgtaccacccagatatcaatgttttgtttcttctaaaatatagatataaccatatcatataactacactcaatgaaggagccgtttcagtggtttctcaaggcctacagaatataattcacatttactgcatgacatttactaacctgtgaagtcttgaatcaaagatacctagattcaaacataataggtatccaatacagatttgttgatagaaaaatgagagtatgccaaacagggtcaaatgaataagattattcagtttgccctcggcattcctttttgctcatctgttctgtagattcaatgatcgccaccttccatacatccactgtgcattcattctgacactggtcactgtcccatatgccaagaatacagaagcaaacaacacaacccttacgtccaccctaatagggttaataactcatagtagagtcagatattaaacaagttaatacgcagatgaatgcagaattactaattgtcataattgctggaaggaaggaaggaaggaaggaaggaaggaaggaaggaaggaaggaaggaaaataggaaagtgtgttccctgaaaagagagggaagcagactaaatttagtgtaagtgatggtgaactcagggaagcacttgcctcctgagatttgatgtaggacatgatcatttatccaagagaaaatgtgaagaagagcactttaggcagcgagaacaagtgtgtttgttctgttgttgttgctgtttttaagtttgtttgtttttgtctctttcttgaagatgctatacattcccatatttacactttattgtgatattgactctgttgcctggagtgctcttctctgtcattttatgtgtagtgaaattgttcttatcataccatctttttttttaaatattaaaactgtccttaccccttcaggcagaacttaccttgcctcctccctttgttcactcctttcaattgcgattatcccattgcttatagctaactgggtaatttatttttctctagaagacaagccttctagaaggggatacaacttctttattcaatggtaggtcctccgtgttattgaagacatgaggagaaatgaattcagattactgggagacaaaggggaatatttttcaaatcgccacttcaaaggatagtatgcgactcaaaatctaaatatatttaagaaagatatagttaattaatgccagattaacagaaattaaaataaatgaatattattttaacatagatccttacattgtttaagataaattcatacccaggggactaaatattctccaacttattttccttgttcattagagacaaaaagttgatttggattacttagaattaaaacctgttgtgagagcccttatatagaaattttaatagaatcatgtctagatagaaaataacacagtttacattaaacgtctactttcattacagcatacttggcaaaatatcacattttgtcttgttgtgggcttccattctttgaatgttactgaagcccagttcctaagaatccctggccaggtgtggtggctcacacctgtaatcccagcactttgggaggccgaggcgggaggatgacaaagtcaagagtttgagaccagcctggccaacatggtgaaaccctgtctctactaagaatacaaaaattagccggacgtggtggcacatgactgtaatcccagctacttgggaggctgaggcaggagaattgcttgaacccaggaaacagaggttgcagtgagctgagatcgtgccagtacactccagcctgagtgacagaacaagactccatctagggaaaacaaaaaacaaacaaaaaaagaatccctgtagtagtctgttctcacactgctaacagagacatgcctgtgcctgggtaactcataaagcaaaaagatttaatgggctcacagttccacgtggctggggaggcctcataatcatggtggaaggcagaggaggagcaaagtcatgtcttacatggtggcaggcaaggtagcatgtacaggggaactcccctttataaaacctgcagatttcatgagacttatttactatcataagaacagcacaggaaagacctgcccccatgattcaattacctccaactgggtccctcccatgacatgtgggaattatgggagctacaattcagatgcgatttgggtggggacactgctaaaccatatcaatcccctacaaagcccacaacatgtgggaattatgggagctacaattcagatgcgatttgggttgggacactgctaaaccatatcgatcccctacaaagcccagcaaagttggcttccatcccagtcttctgcagtctctctggccactttccgtcctgtttacctcatgcttctgctccatcctcactggcctcctaggacctctgaacatacccaccttgttcctgctccgagccttttgactggggtttgttgtgctagaattactactccacagatatcagataaccctatggcttgttctctcttttccattaagttctgctaaaaatgataccttatcagtaaggccttctgaaacctctaatttcaaggatgcttatccattcacccatactcctcatcttcctgtcatgccctattttccctataattaacaccatctgaaatactgtgtattttttttattatttactataatatgaaactctaggttgttcactgttgtcccccaactgtaggcactctataaattgtcattgaaggaaatgcatattaactttgcactcagcgtcactgggtagttaatactatttttcaaatgttataaaatcaatatatgttaattgaagaacatttccaagctgtagaaaatagaagaaaatgaaagtcaacaattatctagcaatcagtacagtaccatgattgacattttggtttacatattctttcagtcatttctttacctataaatatctatttcataaaatgaagatcatattataaatactgttttatagactacttttttagcctatcatgccataaacatttgtcaattgattaaggatttttctacagcttcacccttactggctctatagcgctccatttttcactctgtacctcttgattgcatggcctaatctgaagttacttaagccaagtacactgggaaaatgcttacctacagcacttagttatttaaagctaagtgggttaagtagtctaggaaatagacttggttttcagtaagtacattgcttattgctaaatgctaactttcagttaaccagttaatgaaaccagagggtcaaaaattgcaacatttaccagtggaccaataaattacaattcaaatgagcccagcccttaggaagattgtcaatcaaagctttaagagtactcaagttcatttagtcatattgtgattgaccttgacggtcttcagattattggtttattaaaagttctaggtagctcgaccttcttacgagactgtagaatttgagttaaaaaaagaaaagtctactgtcaccactgtgttagagattaaaacctctgcctagctcctgggtggtgattcagtttttgaatactatttccttttgttgcatgaagttataaaattaaaacttcaatttgttttccagattacagctagggtaaaaattgttttttattattttgtgttgtagagtttttttttttcttttaaattagaagatcaagttcgaggagtcaaaagcttaatttaaaaaaaaagcctcacaaatctatttcatttctagtacattacagttcagtagataatttgaaactgattcatctgttataccatctgttggaaatatgctacagctgttaaatgtccagcaaaatttgaactacttctcgaagtaatttgcccttggtacatgcagaccagacaattttttatttgatttacaaccaagatttctccaaacatgaccgattttctagctatactacttttatttcattattatttttaaacatagctattagacaaaccaaaatagaaaatgaaagaaatctgaactaatttttaagattaaaaataatgaatttattcattgccataagctattaaaattgcattgattgtgttcaatatttttcaaaatatatgaagacttcctatggtgtgccctacattctgcatattgggaaagaaaagaagttcccttcctcagaagaggattattggcagagaaatcaacatataaaccaatattgatcataatagattttcaatgatacagaatgaaaatattatattaggaacaccaaagtcttatgttctttttaagactaaaagtagatgtaaaagagctaactgacagtagtcaatagtttcaagtctcaaaaaactcatttgctggagccaagatatttaaaaagtcctaaagtcatgtactgtactgatgagttagacaaaccctctatataattcaggggttccaaattacaagtcattttaagttgttgaagatcagagatgatatttcttatgtgggatacagtgaagtagatctatgtgtaagatcatgggatgaagccatttctcttttgcaatgcagattttaaaatggaaaatacaaaaatacatcttagaagctaaacagatgaagtgaatacatctcaatagtcaaaactaggaagcactttgccttgcttgcttttagatggatttatttcttatcattgtcagtaattcattgattcaacagctctctgcaaggttgtgttatgctgcatgacagattttgaggctctgggaatagagagtggacacatcaggcacctgccttcctctcatggtatttacagtccattcaacaagaaaagtaataaagaaattaaaaacaaaccagataatttcagattgtggtgagtgctgtgaaacaaaacaagacagtgtgatagaatagtaagcaatgtctcaatgaagacagaaattgagttggttaatttagatgaactgatcagaaaaagtgaaggtagtatttgcgtcagaatcagagtggaaaggaaccagctcttttaaacctggtagagagaattttagctggacagcggagaggatggaaaggcctttgagcaagggtgtgcttggtgtgtatgagagagagaggagagtgaatctagagcttagtgacccagagaaggagtgaaataaaatagcgccagagatatcttcagggccagaccatcttgggcccagtggagcttcgattttatactaaataagaggggaagccatcaggaagccttcagggcatggcaaaatctgatgcccagttttaaaaaatccatctggcaactgtgaagaaaatggattgtaaggagataaagatcgaagcaggaaataagtgcccaataaatatttattgaatgaataaatgaaataaagttgatgtcttttgctgaggctattcaatgtaggcatatccattaaattgctgattatatatgggtttctctgagaacatctatttaaaactgcagaaacctctttcagttaaaagatgtgggtctgatttggcacacaaaatattgaaattcctgcaatattattatatagggtaacatttcatgtaaattcttagaatcaaaatgagaggtggtgagaacaatttgacaatttcaatattattaggtctgtgtagcccagtgcaacatatatgattttacctgaagtcactatagaaaccatttgtcccagaaaactagacttcaaaagcacaggccttagaatcaggtacaatttggcctttgtcctgactttaatatcctttagctgtgagatctgaagcctcctcatctataaaatggtaatactacccatctcaatgggttactgtgataactcaatgagatgacccactcaaaatatttacttggctatcacgtaagtgttcaataaatgattgctattactatcaattgattcgttgattgtggtttaatgatctctgccatctgtatattcatcaaggtccaaattggaaggattgagatgggaggtgggaaggctgcctcattcgggctcacccctataacactgggctttgtctcattaaatggaaaatgaaataaaagagtaaattaggtcacctccatctagtaggaaacaagagagatatagtaaaaagaaaaaaggaaggcagatgaatttattgtattcacttagcaattttcgctgtgtgtcagataagttatgtccaatcagttgatttcattccaattccattatctttagctttttcctaaattagcaattgatgacaaactaattgtacttctcttcatggtccttctgtttgataagttcttttgtgaacttatttgtagactctatgagaaaataattaattctcaatgcaattttatgacctgttttagcaatgacctagcactctagtattttctgtgcaaagttagttgcttctgccatgcagagcctaatataaataataaaagatctctaatataaaatgaaatacataaaatgaggctatatttgtatgggaatttctatgatagatcagtaagtgaaaaggtatgttaaagaccagattgtaaatgttttttgtttgtttatttgcgtgcatatctaaatatctgttacgttaaatgttgcatctgtgtatatgtactatgaagagtaataatagcaatgacttctatggattattagggttctttctttaactgtattgtatgaaattctacaggagcaagagaaagatgtatcttattttcaatagcaaagagtagtccagggaagctggagcaagagatacacaaaagcaatgtatgaaccataaaaatgggaggaaaatatggtataagtgaagatatataagctagattgagtagtagtcaatgagttctttgccctaagaaggagcatacatttttatagcatacttctataactctgaatgtttaaccatttattttatgttgttatgatttaaaaatctagaacgactgggtcaaaacaggaaaaggacttttgaaataatggaaaaactaaggaaactgtgggtaagacaggattaaacaagctgccccaatttatgttgctaggaataaaatctaaatattttgactctaaggagcatgctgctacctctgaaagtcacgcctttcaccaaaaagtattaattatacaaagttaagttaaacttgaccctcaactatgtctaaaaattattataaaaattggaagagaatatcatattctgtttcctgtactttccacatattattaaagaaaaatgtgatatgtgaaaattagaaaatgtaaaatataaattaaatttagacaaaatttggcttgcagacatcaggagtaatttaagaagctctggccaaacctcccaacaaacttgccttctgcttcccatcctgccttgttccttatgactaaaactatcttgaattacaagctgaacgaaaagctcttctatggcttcccaagcagcacagcagttcctcaagaggtcttttgtcttcccccgatgtccatttcagggtctggtgtcccaactcagtgctccaggactgcaccttgccttctgctcctgagtgtcccgatgttgtgtgcccccccacatttctgaccatcattagttattgcattaactaatgaccctgaaatggacatcagggggtagataaaagacctcttggaggaactgctgtgctactgatgatggaaaggaatagtcataacacgtgatgcagggtaaatgtgcaggtataggtagagtagctcgaacttcaaaaggcagaagttgaatgtacacgtaagaccacagagtgatgtgttcaactcagaatgtgccttttgccatggaatttttcctaatataaaagtgaggatgttattgctagaatttctgttcagctagcactgtctcattcttgagtcatttgttgtttttagttgttttcctccattaggcttatgttaccaaatgggtcatataaaacatctatttgaagtgttatagtttaaacatatattgttttgtgaaacattttcagacattatatttcagcagagatgcatttgaaaaccatacttttgtgtcaattacgtatattctgaagtcctttaatcttgtaaactcctgccagtatcccttgccaatagccaaacctctcagccgtatcttttaggtaaagggcaacagctatttcatgtctatttgccaataatttcctctgctccagcttgagttagtacaggattcatatagctagtctgccttcatgattgactgaaattgtgtgaaaataaaactcaaggcccatctgcttttctaattttcatccaagattccctggaagggaagtacgctggagaccaaatatttgccattgctgtgtatggctgtagttttggaagacatcccagtatgggaaaacacaatactggattatttcaaatgttagttctctttttctttcgctccttccctcctttactattatataaaaattctaaatttctccagggatttgactgatttcctagtatttaatgtctgcaggagattgagatacatgttttagtacaacaaaaaagcagactttttagaatgcataatgagtgataaccattattacagttggaaataaaaatggatagtatattgtaatagtcagtatggcaatatgtgcttgcatggagtgctgctacaaccatctctgggaaatttcaaattcattgtgggctctttcatgttgcttgaggtgttccctctttctaaaatttcctttctacctatctgtagtctctaatttcttcagattctattcattaattatatggcatctgacactctaatcattaatcattctgattcctaagttccttcatatttgttatactggataagaggtttggaaactcactctgtaaaagctcagatagtaaatagtttagtttcgtgggccatatgatatccattgcaatattctactgctgtgtgaaagccatcagagacaatacataaatgcatgatgtgtaactgtgctccaataaaactttacttacaaaagcaatctgtgggctgggttgggcctgcaggccatagttttctaactcttggtggttaacactattttggggttttcagagcttgagagaaacttaaacttcctcatattacttgtgtatcacctgtaggaaaggggttcattgacatattcagggtcacacgtttatgatggagccaggtctaatgagcaactcaactaacaacaaccctacatttctaatttatttgtggctttttgtatttgattttattctatttagcattgaattttaaaccatttttattactcttttgttgcttcatgtttaattactttttgtggattcatttattactgccacttatggaggaatatgccatatctttgtatgtatgtgtgtgtgtgcatatatacaaatggaatgtagcgaaatggaattatatatatatatgtgtgtgtatacacacacacacacacacacacacacacacacatatacatataatctgcctgaagtagtgaaaacagcaaaatgcagtgtaagatctcaataaataatcgtgattaatgtcctccagggaaaaatatagtaattgttgcattttttagcttataatatgattatagattatgttttaatttggaagaatgtgagattgctggtgctttacattctgataataattttgcagtcacctttaaaaaaaattgcttattggccctgatctttactaagctcaatttaattctaattattgttattctgaataattatataattttttcaaattattactttaatttttaaatttttaaaaattgatttgattttttaaattagtaaaaaatgtaaaatttggtactcagatgatgaattagttacagaagccaatttgtttaatgtaataactctaaactatattatggttttataaatgctacatataaattctaaatttaaattagctattggatcatttaatcagttatcaacttagtttaattacattcaacgcaaccatatctatccattggatattcactcttagaaaatgtgtcatgcattattatcaagtatgagctagcctgattgagcaggtatggactagaaaaatttctcctagcatgatcctgcagatttataacgtggctttcttcctcattttcttcatatttctactcaaatgctacctgatcattttgtcaaaactttccttgagaaggcagcataaaatagcaattctcttcctctccacctcacccccaaactccctgcccactgtttcatatttaatgttccttcttagtattaattaccatagcatactataaatttacattttttcgttggcatgtttcttcccacaaaaacataagctctacaagggcagggcattgttaatttcaccttcagctgcacttcagtgcttggcagttgatgcatatttaaatgaatgaaatgaacatgagtgaatgttagcacatttctaatataacgggaacattagaaggaatgtttactccaattaaaggcaacacttatctcaaaaattataaaaagttataatcaaatgtatcagaaagtaggaaaatcaaggatgtatgtttgtgctcacagctaaacagaagtagatgttttcgattaatatgaaacccattactttagatgatagctttgtgaattgatacttttaaaacaaattttaagttcttttcattcttttacatttaactttctggggaacttatttatacacacatgccatatttcacagaggcacgcagtataactaagaaaaataagcaattttacaaatattatatgaagacggatttgttgattttaatttccaatttgtatacaattgagtggtgagataataaataataattcatttctccagtatcattggggacttaagtgaatttacaagaaaattagtttattctttctgttgctaaaatattttttgcttataaatttgagagagaaacatttttgaatatatagagaaacattttctgttttattaaacagagttctgagcataaacatttgtggggaatttaagaccactactctaaaaattaagtgttgtggcatgttataatatgagatcttgcttccagactctttgaggttcattgggtttagtacattcattcatttatcctacaaatgtttttagagtacgtgccaagtaccattgttcagatcactggagagtaagcattaggccaactaaaacttcatttcagatagagctttctatctagtgggagagaaagacaacaaaacaattaaatgagtaacaacataacatatatgtattatgacagaaaatcaagcaggatgtggatacagagactgatggcaacaaaatgctgggtgaactagcaaaccctgtcctcagtggcaaaggtcacattgagcagagacctgtgacaagagaggatacttggagtagtagttgcaaaggcttacagcaggggtaggattgtttttaaaggaagaggaggggccaggtgcggtggctcacacctttaatcccagcactttgggaggccgaggcgagcagatcacgaggtcaggagatctagaccatcctggctaacatggtgaaaccccgtctctactgaaaatacaaaaaaaaaaaaaaaaaatagctgtacttggtggcacacgcctgtaatcccagctactcaggaggctgaggcaggtgaatcgcttgaacccgggagacagaggttgcagtgagccgagctggcgccactgcactccagcctgggcaacagagtgacactcggtctcaaataaaaataaaaaagaaaaaagaggaaaggggccatggtggctagacaggaatagacaagaacatggggaaagagataagactagtgttgtggccatcataggccactgggtggcggggtagcaggggttgggcaggggtactttgaacagtaggccaagttgagagcaggagccagagagcattttgagtacagcagccacaagttcacttacagtttgaaaagtgtttcttcagctgctgccggcaaaactatagcagagtgagaggggaagcagggagaccacacagtcttttgtaacagtgatctctggaagctgtatgtgccctatctgtagctatggagttgaagtgaggcagtaggatttggaacatcccagtatcagaagacttagccctccatgccatttcccagagacccagagagggacggtagactcagaacagtcctggccacgttaacattagaagcacttaggcgttggcaaaatgagaaagatccatcaaaggaatcagagagcaagcagctaatgagaaaaaagagaaaaaaaaatcttaatgacattataaaagccaagtgcagaaagtgttacaaatagaattgaggtattgcctggtttcagtgcagttgattggttgagcatgatgggaactgattaatttttctgtcagtaataattttcaagttgatggttattctgtctttacttgctgatgtctagttctttctttctttgatttttgagacggagttttgctgttgttgcccaggctggagtgcagtggcacgatcttggctcaccgcaacctctgcctgccaggttcaagcaattctcctgcctcagcctcccgaatacctgggatcacaggcatgcaccaccatgaccggttaatttatcatttttagtagagatggggtttctcctgttggtcaggctggtcttgaactcccgacctcaggtgatcaacccgccttggcctcccaaagtgctgggattacaggcatgagtcaccactcccagcctcttttttctattctagtgagaacatgtaacatgagatctgccttgataagtgtgcaatatcatctagaggtataatatttcacaccagatctccagaacttagtcatctcacataactgaaattttatacgtgttggttagcaactccccatttcttggtcttttggctttggtaggagtcctctttgtctttcctcctccaacattagtaattctagttccctgttcctataatgtataaatacctgaagatttccaggagatgccagataccaaagcttattacaggaacaagctcaattttactcatgattctcagatagcaagactgaggtgaagtcctttggagtaatgtgctttgctatggttttccatttgaatatcagggttatataaacagctcctgtgttatattatatttaggataacagaattgcctaaattcctttgctaaatattgtttcaaagatacataaaagacatatcagattcaatgattttttaaccaacacataccaatcgttatttcgaaatcgttgttgagtgtctctctccctctctgtcttttgttttcagaaaaatgtgatgagccacttgtctctggactcccccatgtggctttcagcagctcctcctccatctctggtagctattctcccggctatgccaagataaacaagagaggaggtaagccaaattttgattcttttatcaataaacatgttaaataagaacatgttatatttatagccatatatatatataatcacacaacagatgttggcagacaccagaaatcactcctgccacttctattaaaagatccatagatgccattaacctctcatgtaatctccacattgaaataacataggaaaacttaggctggaagttagagatagtacgtcaaaaaggaagacattttgaagttgcctgggataataaagtcaaaatggcataaacgtttagagttaaaattcctattaatcagaaaatcatttagaaagatgtaaaaaagaattgactcccaaaatgcgtacggtgtattaaaaaaagcactttgtatttactgtatattaatgtaaaaagttagttcctattgaaaatgcaaatgccccttgtaatttttcctccggtacccagaatgtagctctattataaaatctgtgtaaaaaatcgttagatgtgtgcaactacaatgtgagttcttgaccttaaatcatggtatttgttagtaactggcagtttcaaattttctagcaattcactgagagtaaaagaacataattaaggacagaggcaaaaaactcttttgcttcaaaggaacactggtacaaacatcagtgaatggcaacttaaaaaggaaagaaacaatattatctcagataaatatgaatcaacaaacagagaccatgatgtttaattcagtaaaacaggaatggtggtggttgacaggggcttcggtggagagggagaaaaaattgagatatctgttaaaaggtacaaagttttagttagacaagatgaataagttttggatatctattgtgtagcatggtgactatagttaataatatgttgcatccttgaaaattgctaaagtaacagcttttaagtggcctcaccatttatgaaaaataactgtgttgtgatggatatgttaattatcttgagttaattatttcacaatacatatgtcaaaacaccatgttgtatactataaatatataaattttttgtgactgcaccttaatacagctaaaggaaaataagaaatgtgaaatcataaaacaatctagaatcaaccaattctataaataaaaaaatgaaagggaatgaatataggaggaagtaagaaagggaagaagggagggaaggagaaagggagggagggagagaggaaggaagaaaggaaggaaggaaggaaggaaacaaagatgaaaaaagaaagcaggaggaaacccaaaagaagaacaagaagaagaaaataaagagagggagaaaaaatattgtatcagaaaagaaaggcatatcagatttagaaagaccaaaaaagagaagaaaatagataggaaaaagctagcctagtgtatacagaataatatataaggtattcacagatctatgaagaggtctcagtcagtaaaaagacttggtgaaagagtgatacacaagcaaaggtagaggaacataacaaaaatgcagttttaatgtaatattagtataaattagctcatttttataacctgatattcatcaggctatggacatgagagagttgttgagttactataagttatcaaaaattctgcataaagatgttgaagtaatataaattttaatatatttctctctcataaaagtcattgaaaacaactaaaacaatgaatatagacagaaaaacatgaaacaagggactggccatacccaaatggtaattatgatacagaccttcccattactaggaaatctaggacaaaatatgaaaaagaaataccatataattctaggtcccaagagagtgtactgttccctaaaagaagtgccataatgccgagagacataaagcacctgtgaggaatggaagcagagtcagaaaatgttactttcaaaagttttgagtgaaaatacgactgaagaagatgatttgctcagtaaatttgggcaagtcaggttctgtcatgcaaacagcacttcaggaatacaaatgagacaatctagtcaccaatgagaaaattgaaagtgcacaataaagaaattgtggccacatgactggtgttgagcaaggaacccatttccatataagacctcgactaaacgatgtaggagctatagttgtaggagagagtataaatgttataggcacagaaatgtaaaagtgtcaattatgggaattagagagatgtgggtgttttttcttcctaacctttcagagcagcaggttaccagatgctgaaactttaggtacaaatttattctgcctttggttttttaatgggaattaacatcttttacaagaaaaaatatataggttttttgctctcatttaattctagaaaagttaaattattttttctttgttttaacataatacaagataccactttacaccatttagagctgcttatgtatttatctactcatacagagagagtcaggtatctgatattaagcttccaaagtgttaatatatttcttaacttggacacttggatttgaggagtatctttactttccttatagtagttttgtctgtagtttgtagaatatatatttatatctacctagatgattgacaggtaggtaggtaggtagatagagagaaatagaatgcatttccagaaagacagatgtttcaaaagcaaaaaaactataaaacaaaagttacagtttcttaactgtgtgacccacagttcatctctttttgaccattgatatactggattgtcatacattagggtgaaattatcacgttgggaaagaaagtgttgtctgtcctatagatatagatctacacttcattgtagcccattttatcatttgttatgtggggatgtgcagctacgtactttttggcttctaaagactgctttgcttatcagcgttatgctgtccataatgacatataactcgccctccccaacgctctcatttttgctccctaatttttacggatggtgaggtaactaagctatatcttcaccctttatgctgctctgcccctgcaggtacagcaagaaacatacatgtagggcttcacccttgttggccacgtaaatgtgggtcaagggaactagcatgagaaagaaaggttatatcctctccaaggaaaaacaaaaagaaagtcatacatagttgttacaatacaaaactttttttttttttttaagacagggtcttgctctgttgcctgggctggagtgcagtggcatgatctcagctcactacaagctccacctcctgggttcaagtgattcttctgcctcagccacacaagtagctgggattacaggagagtgcccaccatgcctggctgatttttgcattttttaatagaaatggggttttgccatgttggccaggttggacaacaaaatattttcttccactctaaaatttatatgcaaatgcccttgggagaagagccatgtagggtgaaattcttgaaaacatatatgtggctaatagccagcattgagagaaaagagatttttttttttaagtatagcatgatgttatatatctggaagatataaagaagacagacaattccaagcagaaaaaatatatgaacattatagaatccaggaatgttggagatacattttcttaatttacaagtggcaagagtcatctgatacagacactatataagtatctgaaagtgagaagatcatatactaacagaaaaatatcagaatgtaacctactaattatacaaatgcagaaaagaacaaattcagttgagcattatgttgataaacattggcttcaagttttattatttacttaaatgatattcctaaagtacattttggagagaaagtttataaatacataggaaagcaccatataaatgcatatattcaaatgacagattgtcacatatttatgaaattgaatttagtttatggttctccacaatacaaatccatctgctataatcttgatgtcagggaccagtacatggcaaaagtatggaggaaatgagatgtttaaatgaaaaatccatgcgtaattctgacatgtcttttggagctcattgtttttagtttattggtgctgttgttttcttatcaacaccttattcctgtgatctgtgttctgatttatccccacatttttaatccatcgaaggcttcccagtcttgtgtcattctgagttagtagcacttagatgtgttactctttccaaggttagcacagatacaaaacctttgaaagtttcaaacagcatatcccttaccttacttttaatatagaattttacagattataaactgctttcatctgtgctctaattgtttctcaatcttcataacaacctggttagaaagaatggtcagttagagatgccaatcaattcttctgccaaactttcaaccttgtacttcatatgccttttgtagaaatcagtccttttcttctgccagagagacagccatccaccacgtggtccaggtctctctccactaccacagaggcttagtgagaacacctgatctcaacggttgctattagaatccctctgctttgttacctgacatcgttttgggaacccaggggactactggggaaacgataacaggctatgtgtaaactagagagaagaggagagcaggtgctggggaagaagtgaagacatgaggccagggtacctgcacagagaaggatgaatcaagctctggtttcactcacaggctctttcagacccctgtttccaacttgcttaacctctgactgaacttcagcttgagtctctcagatgtatcattccagttctaatggtcacctccccctgtctgagctcattaaagtaagtttttcttcctagttactaaaggacttttggttttaaagaaaaacacaaacaaaaactagttattatccccgttttacaaattcaaataatacatatagaaaccccaaaatacatcattaggttctaaagtagcatagctagggaacagtggcacagggagagggacacaaatccatatcttctgctggaacccaacactctttatatgtaattacaccagatgaggtaatatcagtgctgcctttttgaattagcccaatgatggtgcctaaaatgagtttgaagatttgagtcaagttcaatttatttatgctgttatagccagagaaacccagtcatgcaatctcagtatttcccaactaatgtagatcctgaataattttctttcttttcaccttcctgccactgatttttacttagtagatatgtctaagaatcttgtttgttgcctcctcaaagatgtttcctcctatgtattttccctgagtaatttctcccattttaagaatgcgtcatcttctctatcacaccagagggcagaaggttgtggtggtgatgttgttttcacattagttttcctctatttccttcagcagggaaaacacattgcacttgcggtcacataattaataatcacttatcaaaggagtatgtgaataacagatgtttggagagactgctagaatagatctcttgaagtttctacgtgtatctcaaagagaaccacagtccttacctttccttaaaagacaccactttatactagaatgatttataatcctttgggtgtgtacccagtaatgggattgctgggtcaaatggtatttctggttctagatccttgaggaattaccacactgtcttccacaatggttcaacgaatttacactcctaccaacagtgtaaaagtgttcctatttctccacatcctcgccagcatctgttgtttcctgactgttttttttttgagacggagtctctctctgttgcccaggctggagtgcagtggtgcgatctcggctcactgcaagctctgcctccgaggttcatgccattctcccccttcagcctcctgagtagctgggactgcaggcgcccgccaccatgcctggctaattttttttttgtatttttagtggagacagggtttcaccatgttagccaggatcgtctcaatctcctgaccttgtgatccacccgcctcggcctcccaaagtcctgggattacaggcgtgagccactgtgcccggccggtttcctgactttttaatgatcaccattctaactggtgtgaaatagaatctcattgtggtttgatttgcatttctctaatgaccagtgatgatgagcttttttttaacatgtttgttggccgcaatccaacccaaatggccaccaatgatggactggataaagaaaatgtgggacatatacaccacggaacactatgcagctatagaaaagaataagttcatgtcctttgcagggacatggatgaagctggaagccatcattctcagcaaactaacacagaaacagaaaaccaacactgcatgttctcacttataaatgggagctgaacaatgagaacacatggacacagggacgggaacataacacaccgtggcctttcatagggtgaagggcaaggagaaggagagcattaggagaaatacctagtgcatgtggggcttaaaacctagatgacagggccgggcgcggtggctcacgcctgtaatcccagcactttgggaggccgaggcaggtggatcacgaggtcaggagatccagaccatcctggctaacgtggtgaaatcccgtctctactaaaaatacagagaattagccgggcgtggtggctggcgcctgtagtcccagctactcgggaggctgagacaggagaatggcctgaacccgggaggcggagcttgcactgagcccagatcgcgccactacactccagcctgggtgacagagcgagactccatctcaaaaaaaaaaaaacaaaaaaaaaacaccctaggtgacaggttgataggtgcagtaagccaccgtggcacatgtgtacctatgtaacaaacctacacattctgcccatgtattccagaacttaaaaaaaaaaaatcactaaagccatagtttccagtttaatttttaaaaattaacataaaaagacacaaaagacaccactgaagttcataattgccacgatgcctttataccacagcttgctcagataatcactgtaggctggtgtcattttccacttcctgttggccaggaggaagttctagtgataagcatgacgccaacctcttccctagctcacacttacatacacatgtccccctccggaaacgcgctgggctgcctcttacaggctcccaggcagttcagcaaacagtaaaaccttattctactcttgagaaatctattattcctgctactcctagaaagaaaatttttccctttttcccactctcaattctcttgtctctgagttgcatttataaaacaccttctttccctctgctttttctttgctctcctctttttgcctttaaatattagaaggatctgtcacaactaattaaatctagaactgcagctgatatactataaactgggaacggaaccacagcgcgtccatgagggcattgtctgtctgtgtggcctagctcctcctgctggtactcttctgctgtctctagtccgtgatgtactcctttgttacacatggcccactcatgaccgcccgaatcagccacagtaggcggtattcttaaccttaattaggaagctttattcttagaatataacatcaaggcttaaattatgaagtagactcaagttcccaattgatgagattctgccctatttttgcagcttccattccaatatttttcctctttccctttgccagcctctaccatgtagtactttttaaaattttctccttttctcactcacaggtaattcattattacttaagtatgaagtaatcggtgaagtgatacctctcaggacgatttgccttataaaagcacatccttgggagcagaaaaattcaaagaactggtttcctaatggggcatttcaggatatttgacattcctattttggctggtcatacttcttcatcttcaattggctctcctggaaacacctgctgattttgtcggctctgaggcagtgctgagcagtaaaaggagagtggcttgtcttcatgcctaactaagttccagtactgagctgaccaaggacaagcatgggattagcaaattatttaaatgtattatatcttggtttcctgatttctatgattactatatctgaaccaggatataataatgataaaggatataatatggaataatttgtcatctgagtcaggaacttttgacagtgaaagagagtatcattaatagttacacaaggataatcctgaaagtatggtccctctacttgtagtttaaaataaaatcagttatactgtttagcagagctaccgtgaaggttaaaagaaacaatttacacaaactatgttgcattgaaatattagtctctttcccataagttactcccagcttctaaaaacaacactatagataccaacattttaaaacgaggattgaattaaatacctttgtcattacaaagacgatgcctccttaaaaatttattgtttaaatttgtgtatttgccaatgtatgtgtgttttcccccattatcatctaagacaaaatattatcataataatttaaaaattagtaaaataacatttttaaaactttcagtatttttggggtgttaagacttacagtgacttaaatattctgcaggacttttcacctcaaactcctttcaatttaagtgaaagagattatgccagtgatttttaagtgttgttttgttcttattatcttaatgttgtttgaatttgatctcttagaatctatatatcttatagaaactaacatgtagttataagcctcatataaaaaattgttctggacattagggcgaataaaaagtatcacctttgttttccttagcccaatatattctatcttttaaatacaacttttcaaagatttcttctgaagacctcacagatttcatatccacctccccaaatgaatgagagtttccatctaactggtattgtgaattttaatgtattcttttttacttaattctcaaagataaaccaaaattttggcttgactgggagttttataaaattaaatgtgtaatacaggaatatgtgtatcattgacacttgttataaatgatagaatgttgaaagcaaactcaccaggcaatgactcatacattttgtttgggcatacctttttaaattttaaaatagtattgttatttttcaaccattacactcaattttaaaatgttggtatttcaacaccttgtttttgttttcttcatagaaatctgtgctaggttttgttgcaatttccatagagcaatgcgtcccaaagtgcatgatgttaatatgtgtggtgaacacacgtatatacatacaagtttccataatcaaatcagactggacagatcttgtgctctgggatcttcttttggagaatcacagatcgtctttatcacagaacatctttaaggccagcagaatacatttccactttgggatttgcttttataaaatttagctaaacattgtgcggatcacgggctttcaatggggtttctttaatgtacttagaaatatagtcgtatctcccatggtttcactactgtgtttctgaaaatactgattataaaagttctttgataataagtctagtgatttttagtttaacagaatgaactagacttaattagagaaaggggaataaagataaaagagtttttcaattttggacttttgagatgaagaattttttagttaattatttttaggaagttactattttcccctttgtgtaccaaattctatatatcttaatatttgctattgagaaaatcatgtactggcttaacatcaatgctatcacattgatccctgctgccgcctttgaaatggctctggaatattaattttctaacactctctttagatcacaacattaatagctgactgtctaaaagagggggaagtttgcgaataattcattattataatatgtttggtaattttagtttaaacacaatactgaaaactatcctatttggtactggccctataaagtttaggacatatgggatgggataaccacatctgaattagcaaatcaatgtatttaaacaaacaaacaaaaatttaagaagatgtgaagaatacatatacctttgtaagattgttgatatggatctagatttttcgttacccataggagacatcttgggccacttcctacttgtgttcaattgccaaaattcctcactcacttctataatgagaaattttgagtggacactctctaggaccctgtcgtcactgaacgcccgttgtgtagccaagaaagatcataattccttggtcttgatcttactgggctcttacagattcttagtggtctggaccacacctccctctgtgcgtagatatcgtttctatgaaatttctggagaatggtcaggatatctaggcaaaaagctttatcaaatatttacacactgaatttttctttctaaaccattcaagaatataggcaaaatgtgtttacgagaataatcatttaatattcctttatccctttgctttttttttttttttcttttaagacaaggtttgtcacccaggctagagtgcagtggcatgatcagggctcgctacagcctccacatccttgtgctcaggtgatcctcccatctcagcctcctgagtagctaagactatagactcgcaccaccatgccctgctaattttttttttaatgtttgtacagacagggttttgccatgtgtgtcaggctggtctcgaactcctgcactcaagtgatctacccaccttggcctcccaaagtgctaggattacaggcatgagccacagagcgcagcctatatgctaactttattcatagagagtctttagtatttttcacatctcaaataaggaggtggagaatttttgtgaatgatttctaccatcagaaatattcattttaaaaataaaattcttcacagcctgaaagcactttcatgctgtacttatgcaggtttgactctcagagaatattttctaaatgtgtgaacaagtacataaaatattatttactgcatatattattctactaattgtaaatttcaaatactcattgcttatatgtaggaatcatttgttaaatcaagagttaatatttgctggtacttttcttgttccaaaaaactatctcacaaattgtttggtcactgtcgtagccaattggaatctagactataatagcagatgagtaacaacaaccaacgcaattatcatcataaataaactagaaatttaaatctcatttttaaaaatgaatattcagagtcattagagaatggccctctcatatcaacattctttcaacacttccaatattgtagaacagagaccatgaggataatgttgagctgataaagcatgcctttcttatctcaagatattatttcacatacatggctttcgacttgtgctggcttttgggtaacagaatacattgtatcggtccttaacactgtatctggctcataagaaatacattctgtaacccagtagaagcagtgtagcctacaagaagaaatgaaggccaggaaagaatagggcaagtccacaagtagccgtttgggaagctcacatcagctggttggtgagtggcattgaacagagttcattcaatagacaagtttaggccataaaaaaactgcacctgtaaaaactatagttcaaacctgaaaattacaattcctctataccaaatgagtgactgtatttttcaatatctactctcctgtgattaaattccatgcttttgtgactatttatccctttttctttattttacttattaagaggcagaccaaattatttccaagacaattgggaggacttaatctaataatgactctgttagcaaccggctcaggtcatacttattaaaatgaacagacccttctcttaatacccttagcaaattagtgactttttcacatttttttctttcagaattaagaaatatagaattgttcttttatatgcatgccttgcaaaagtaattctaaaaaaattgtcactaataagaattcaaagcagtgtagcctttgttagctgccttttctatacaccaagaatgagcaatcaacattgtttactcatcctcttgctttaaaactcagatatatgcttgacgcgaatattgctgacaataaaacatgacatttaagacagtctatttttattgttcttgcctctttaacatcaaaatgtaaacacaaaatgtagaaagatttcttccccaggttttcacccaaaggtcattttattttatttcccttagctattatgattttcttagcaaggtaaggaattcatgttgcttttattttgcttggttttcattctcagcaacttttgcaatgtatttcctttgcatctgtcttctgctttaaaattgatagacaatggtatctgtttgaactgcgggtccttgtctgcaatatgtctgtaaccaccacctcaccagacatccacaaccggaaagactcttctgcctccaggatgaattattttgcattacaaggtttgtgcctgagcatatgtatgaataatgcataattaagcgtgttctataattttctctagccagtgtctggcacatacatatttggatggataacgaattgggttttgttttgttttcaaccctctgcttagaccaccaaataagtcttataaggatctactcttaagatgatgaaaagtattgttgacttccttactcttcctccctgagtgttctagagggtggaagttaaaatcacgtgcttctgaggtgtacaggcttctatggtactgtgtgcggaattggtgggtttttggtctcgctgacttcaagaatgaagctacggacccttgcggtgagggttacagttcttaaagagggtatatccggagtttgttccttcagacgtccagatgtgtctggagtttcttccttctggcgggttcgtggtctcgctgacttcaggaatgaagctgcagacctttgcggtgttacagctcttaaaggctgcacgtctggagttgttccttccttctggtgggttcgtggtctccctggcctcaggagtgaaggtgcagaccttcacggtgagtgttacagctcataaatgccgcacggacacaaagagtgagcagcagcaagatttattgtgaaaagcgaaagaacaaaccttcccccgcgcatgagggtacccgagcaggttgtcactgctggctggggtggcctgcttttcttcccttatctggccccacccacatcctgctgattggtccattttacagagagccgattggtccgttttgacagagtgctgattggtgcatttacagtcctttagctagaaacaaaagttctccaagtccccaccagattagctagacatagagcactgattggtgcatttacaaacctttagctagacacagagtgctgattggtgcgttcacagtcctttagctagacacaaaagttctccaagtccccaccagattagctagacacagagggctgattggtgcttttacaaacctttaactagacggaaaagttctccaggtccccaccctaccgagaagcccagctggcttcacctctcaatggcactggccacgggactttgtggcacctagcccaggcactccagcagcccagagggagcttgtcccccaaacaagcccagcaggcgcgggctggccaccaagccggcgcccacctggaacccgtgtggcctgagagcagagggagcggactcttgcctctgccagccccagagggggacccccacagcacagcagcgggctgaagggctcctggagtgcggccagagtggacgccgaggccgaggaggcaccaagagccaggaagggctgctagcacattgtcatttctcagtactagagtcatagggattgctagagactcttctcgtattatggtaaggtcatatgttctcataggatcatatagaattcccagaggaggatgattaaatttattccaacaagaggctaataaagcagaaatgatgacttctttactgttgaagggctggcagtccacaaaaacaagtgccaagaaggccaaaatagcaaaggatgttaccactgcccccaccacatttatattcccaaaccttccacacacctacattcacattcaaatagtattaaagtataagcacttctcattggtcttcaggtttttttttaattagatagatcagtcttcttaaacagcattaacatgtttaagcttcctgtcctttggtagtgacttaagttgtcaacttccttaaaagtcattactgacggcaaagtatttctttttggtcatttcaagacatccacgtgtttttttgttttgttttgttttgttttgttttttcgtctatctctatctcagaacttataatgaagtattgtattgtagacttatttttctgaccccaagagactgggtgggtgtcacctgaagacatgtcctgtgtatcaagtatccatgaatacttgacatacaggatgatgccaagaacagagctgatattcacaaatgtagaaataaatgcttgtatgtacatattattttatctgatccttacaaaaccctaggaagaaattcagaagttacaaaactcagtttgatgaataagaaaactgagattcaccaagtttagattcttgcctaaggtcacagctaacagaaactggatctgagtatttgaaattaagtcttctgacttcaaaataattcactattctgtcctccacttgtcttccctgactttgtgagaacttttcttttggaaaaatttgaataatatttgagttggttataaagcataactaaagttttcccactggtgttttagaacacaaaaagagacatttctctttcatttctgagaagcgtatattgagtagattttcattcagaatgcctttgtgatttctttgcatgttttttaatctgttttaaataatctgaaagtaaaagaagttattttaaatatttgcatataatgatgtatttgttaaaagcatatctttttttcactatactaaaagcctagccaaaattgaaatcaatttagtctaatttttgaacttgtattatgtggggtggcaggcaaaaaaaaaaaagacaaacctgtactctaaatattatatatgtgggaaccagtaaagatttgaacagaacaatgagaccaacattctctctaccagaaaagaatttaaataagaaaaaactactgatatgcagcaccaatacgctagaatctgacagaagctgtatttttaaagtcactaacactcttaatattcaaaacacacctgggaaaaagcagtaagtcagtacaaagtgaaagaaaatgaataacaggagtaaacctcaaccacaaaatataaagtatgtgaggcctactagatatgccgtaagtggatctacatttagtgtgagatgagaacaatctggcatcaataataacaatatcccattgtatgatcattatcaatcactaaatgctttcttccctttcaaataaaggattcagcattgtgacattttgcctttcattttgttgttgtttagtagaatgaccatacttcctggaaaactagaaactcccaagggaattgattcattcttttctcccaaacttctttctatcaagtattaaataaagtaaagcaaagactcatttgaccaaatctttcaaagttaccattatctaccttctctatagattatttaagacaatcattgatgatggaaaataattttctaaagactgtttccaagaagcacaaaatacttttggtttttaattcaaaatcctgtatttgaatttcaacaattcaaacaagaaattggaaaccaaatattggtattttgtacaccaaactgtgtttgttggtttcattcccaaagaaatagcactaactaggaagagaagtatgagttttaggctttcaaatcgtggccatcaggacttgagaggaaatatgcaggtgccccagttttagggatgtttattggatacgtccaaatgatgcaacttcagcaaaactatcttatcttcgtgatttggtcagtgatttttttttttttttttgtaagacggagtctcgctctgtcgcccaggctggagtgcagtggcgcgatctcagctcactgcaagctccgcctcccgggttcacgccattctcctgcctcagcctccggagtagctgggactacaggctcccgccaccacgcctggctaattttttgtatttttagtagaggcagggtttcaccgtgttagccaggatggtctcaatctcctgaccttgtgatccgcccacctcggcctcccaaagtgctgggattacaggcgtgagccaccacgcctggccgatttggtcagtgatttctatgcaggggcctggagacaggctttgagtacctcagtcttttttttttttaactttaagttctggggtacacgtgtggaatgtgcaggtttgttacacaggtatacatgtgccacggtggtttgctgcacccatcaacccgttatctacaatagatgtttctcctaatgctatccatcccccagcccctaccccctgacaggccccagtgtgtgatgtccccctccctgtgtccgatgttcccctccctgtgtccatgtgttctcattgttcaactcccacttatgggtgacaacacgtggtgtttggttttctgttcctgccttagtttgctgagaatggcggtttccagcttcatccatgtccctgcaaaggacatgaattcatctttttttatggctacatagtattgcatggtgtatatgtgccacattttctttatccagtctatcagtgatgggcatttgggttgattccaagtccttgctattgtgaacagtgccgcaataaacatacatgtgcatgtgtctttatagtagaatgatttataatcctttgggtatcagtcttaatttagcatcttgtggttccaagtgagaagtttaggtagacagacccagagatgccaatcagaactcaacatgctccttgcagcactgggaaagaaaacgcagggtggaggaagcacacagtcagtggttatgacagagataaagaatgctgatgctttgttacagcttcactttcatgtatttgtgagctctttctaacttttccttccactgatatgacatacatttggaaattatcagttctcctcagcaatttatcaatgaaatggcaaggattcactaaggagtgataaacaggcaggatgttttgtcaacagcctgaaatacgttaatcagcttctggaatgccaacaatttaaattcaaatagatttctcactgagcctgagatctaaaaccctgtgatgctgtttctgtttattggattaatgtagattttaggttcctttgtcctcaactcttgggaatcccccctactatttttttctttgtttggatggcttagttggaatagaaaaaagtgtggttgatttcttcagaagtgttatctgtgtgacctcatactcaactgcgggaataacagaaaggcagaaatcgggaaataaaaatcctgttgccgaatgagaattctacatctcactgccgtttggaatggtacagtgattcatatttcaggcacctcaattagacattcattattcataaacacttatgtaactctgagttattcaggctgggagagaacattgcaatctttctttttccttttctttattatatgacatcttatatcaaaaaaaaagaaaaagctaaaaaaaaaacactctgctacatgtaaatctgaactatttattttaggcaaaatggcatgaataaaacaaagctgatctacatttggctttgtcttgtcaaagaagcaatctgaacaaataggctaagatcaattctattagaggtgaaatacggaccaagataccaacattgatcccttcagccatggcccttgcatatagttccaatgtacaataatacaggtcaggacctggaaaggcctaaatgataagactaagtgtcaaaatcagtgttgaaaggctgctcaaactacagaaaatgaggtatccaggcatttaataagcatgcattgagctaagcacataccaccactaaagattcatttgcatgtgggattaaaacatctgaaaagttgacaagggaacgttttagagactctgagatggtgacatcattatgacacaaggcactgttggtctgaagcacactggtgagtgtccccaaccataaatttggagatagttcaggtggcatctgagtattaatcaaaagaaaatagatacttgtcttactcgatgaaaataataattattttttttgaaggggcatcaataatttaacaaatatttgtggtttactttgtgttcagaacatgttgtagtctatgtcagcactgtctggtaaaatacatggtgagccatatatgtaattttcaattatctaatacctgcatggaaaaaaactaaaaagaaacaggtgaaatacattttatatgttttagttaaactaaaatattgaaatattgtcattttgttatgtaatcaatataaaaattatcaatttgctactttacatttttcatactaaatttttaaaatctggtgtgtatgttacacttatcttgattcagaaactaaatttccatcagaaatacttcatctatatttaaatttcacaacatttatggtttaaacactggactcacatagccaaattgctcccaaaatatctaaaatgttctcctataaatgaattatcagttttaaaatatacatttaaattatttaaaataaaatagcaaatttagatctgcagtctctcaggcatgtgttagtccttctagcaacatgccaagtctgagtagccacaggtattgacacctgcacctgtgggaatggtgaccctggggatgtgcagggtgtaatcatatgcagtggcattaatctttggggagagtcagaattcatttatagcctggtggtggctaagagatggcagaattataataactgaggaggctaagtacttaacatcaatttgcagggcagtctcattttatcaggaaaagcaagaatggcagaggcaagaatgcgatagctgttccttgacattggaaaaccttcagcaaaacccagggtttgggggttccccctgggtgtctgaaatgtagcattcagcactagctccagcctttgggcagctgtgggggccagagaccaagtgtggtccctggcccagggtgggattagacagcataagtggtgtcaagaagtatatgttagagttaatgaagagtaggcagtatgtggatcacaactctagggaccatcaaataaaacttctttcagttaaggcattttgtttactgttaaagaagacaggactctaggatgtgtcttacttttccagaacatgttacaaactgatgtttcttgagattatgttggggtatgctcagccagtctctctcaccgggttctagagacagctgctgctgattttgagggtaaaaatctagtattcattgatctgaacagctgaaagcaaatcccttttgatgcaatcagattgactcaaagcattagacattttctctctgtgcagactaggctaaatgcccttggatagtctgtttcatgggcttagccttagcaatatggacctggattaattactctggcattgtgtaaactctgtaactatgtagaaatagtattatctcctatcatatctctatgtctgaacattatatgcaaccttctgtttattatcacagtaaaaaagtctgtccaaatcattgtatatgcataatttctattatgtttagagggattgatgattagaagttgataggaagacattatttaataattacaagagaatgcattctttaacaaggataatatacctcattaaaaataaaaatcattgaattatttctctactgaaacatatcagtgtcagaaataacatgaccctaaaggatatcagttgtgaataaaagccccaaagtggggattaaagtattaatagtcatgggggtaggtatgattttgcagaggtagaaactgaaatacagataaataactttcccatggtgtctgttgtatgtagtgaagccaggattaaaaaactaaggcctatctaactgtgttttttcataatgaggtactaactatgatacgaatgctccaaagctgtcaaaccacgagaggaataatgtattataccgattattcattcagaaaaacaatacaagtacttcaaagtagcaagaatctactctaaacaccattttcacaggtataaagcaaaaataggatttgatctttgaaaatatctattttaaagaatttagtatattgtgcttttatatcaattatgtactgccttaaacattcatcaagttctgctctaaaatgcagcatctctgaatatgacctgcagcttcatatgctatagacagagtagtcagagaaagtagaaagcaggggcacccattgcctttgaagagttttcagtgaaaaatttaaagaaaaaacgctaatcacagacataatgtaagtatatgaatataactattttcccctaaatctgaacatagataatgcaacataaatctcatgataaagagcaatctctaccttatatagcttagtggagaattagaatataattagtaaatgttgaaaataaagatcaactatgttgatggtattttaaaccattcagttctgtatatcgacattttgccaacactatgctaattctatggctctctttttggccctgagtttacttagtattctccacagtatactctgacctcgcaaatcaacattcatggtacaaaacattaaaagtacagaatatattattgttaagaagaggattcacatgtaaagatgacaatgaaagtgttcctggggaaaactagcaagggagtggaaagtgggatggagaagtaaagtcagtgtgccaaatgtcatggaatgtaaccttggctcagatcccacagggaagctcttgagataagtcacatgtcacagctgtctgaagcaggggctagaagctggagactttatatgcctacatctatcagacgttggttacttttcccaatttcccaactacccttatgttcaggcaagatgggttctggcagcctgagggttgtccgcagacaaaatcttatggattctagctattatttgataaaattgacatgttcacaccttatgccccagcaatttcaatgataggaagacatcccagaaaaatgcctgctcatgtttatgggaagatgtgtattaaaaatatgcagagaagcagtgtgtattgtataataacccgaaaatgaaaacaacttaaatgtccataaacatcatcactgttcaaagcatatgctacattttatataaagaaatacaatttgaaattcaaagggaatacacttcaagtaaatacacatgaaagaaaaatcataatgttgattaaaataagtcatagaagaatacatacaatgtcatttcacttacataaaatccaaaaacaggttaacagtatatactttaggaatatatgcatatatgataaaaccagaaagaaacagaaaggcatgctttattgaaagtgaaggctatcggttacttctaagttgcagggagggagatggtgtcacaggaccaccagatttgtatgcttgctgtgcagtaacagacaaacacactgagacagcagggtttgcaacagagaaagactttaatgattatagggcagctaagcaaggacatgagaacgaccgtcacatccatctccctgaggagttctgggctggagtttttaaggggattgtggagggtgagcggctgtaaaattggggttttgattggttagggtaagagtgatgaaatcatcttgatgcggaaactgaattttttgtcagcttctcctggggtactttggaccagctggtgtcagtaattccacccatatgtaggagctattgtagatcaagatatgaagataaagaagatctagcttctgaaacgcagttctataattaaagaagtgatataacggtatagggacttagagggccgactatgacttcctaggttagaaacatagcttggccacttaaaaactgaataacctcagtagaacctcattgatttcactgaaaatcaacttccttatctataccatggaggtaataatgctgactaccttattcactttgtggggattacataagttaatacatgtaatgcatttcaagcagagctcagaggcaagtgaagcactcattaagaaaacattcttggccgggcgcggtggctcacacctgtaatctcagcactttgggaagctgaggcaggcagatcacgaggtcaggagatcgagaccattctgtctaagaccgtgaaaccctgtctctactaaaaatacaaaaacttagccaggcatggtggcgggcgcctgtagtcccagctactctggtggctgaggcaggagaatggtgtgaacccgggaggtggagcttgcagtgagccaagatcgcgctactgcactccagcctgggcaacagagcgagactccatctagaaaaaaaaattctttttaattatacatgattttgattgcactgaaaaagggtgggccagttgcacctgtaagaaaaatcttattagttttctgttgggactactgagggacacaggatggaaaagcactctgaacagacaaattggcatgtgtgcaaagcattgaattacaaaataacaagggaaaaggtgttcaagggaaagtgatggagaagattgtatgggaggtggcaggagacaccttgatatcatgtggggctgtctgataaatttgcattttgtcttagagctatctgtaattcttaggagattttaaacatggaaatagcatacagactatttcactaataaccaagtatgccttgtggaggatgaactgaattaggacaaagttgttagcaaaagaccactaatagctgtttcaagtgaaaaatgttgatggatttaagtaaagcagggtagaagaaaaagaaagcagattaaacagatatttctgtagaattaactatactccataactgactgacttcagagatagaaagatgctaaattatgctgcagaacaagctaccaccaaaatctcactgatttacaaaaaggaaggtttagttctcactaagatacgtcctggcagctgcagcattcaaaatgtatttgtttgttcattaccatttatcatctctttctctgtcactgttgacaagatagagatacaaagttgttcaaaaatatttcaggtgtaactatgtatacatttgttacatgaattatcacaaccttaaatcttttatttctattgtcttaaccatttttgccacacagaagctattcatatgacaattaagttgatatttttggccgagtgtggtggcttacagctgtaatcccagcactttgggaggctgaggtgggaggatcacttgagcctaggagtttgagaccagctgggacaacatggcaaaaactgtctctctaaaaatacaaaagttagccaggtatcctagcacacgcctgcggtcccagttactcaggaggcagaggcacaaggatcacttgagccggggatggggaggcagaggctgcagtgagtggtgatcgtgccactgcattccagcctaggtgatagagccagaccctgtctccaaaaaaaaaaaaagactttttttgtggcagtgtctcaaacagacacaatctgacataatttagcatgttttctttatttttgacacagggtctggctctgttgcccaagctggagtgcagtggtgtgatcttggctcactatagcctctgccttcttggctcaaacaatcctcatgcctcagcctcctgggtagctgggattacaggtgtgcaccatcagtacctagctatattttttggtacttttagtagagatggggttttgccatgttgcccagaatggttttgaactcctgggctcaagcaatcctcctccctcagcctccaaaatgttgtgattccaggcatgagccactgtgcctggcccataatttagcacttctatcaaatgcaattatgacatgaaatatttctggttaacaactgacaatgtaactaatacaataagttttatttacattttatgggcagattttttttggtgcattctgtagtcatgaacaaattaaatggtcattatcctcatggagattctagcaaaaagcaaattataattacccacattttcatacccagctaagagtcctagaaagcctccaacctgttctagccattttctcatatttgtacagctgcaaaaaaaatatttttgagtacattatgtgagctaaattgtatttcaggtggtagagactatagataaatatcctctttcatacaaactaatcctttcattttgatgcattatttttgaggttcatatgaaccacaaccacatcacttgaattgatgtattggaaatgtgataaacattgtgtccagactgtatttgctatttattagaacttacctctccttgtatgaaattaagtatttgttttagatcaatttctttgagttgctttcttttttcttttttaagtgaaatagaaaatgaagtctgtagaatctggggaccttcccttgactaaaaatgagtttccatagtattaccataaaatctatggtaacccatttcatactgaaagattcttgattgcttacctgttgatgtcattccctaggtgacgtctccttaaagacattattgtatcccatttttatttgtatacacagcatctaacatcatgtccagcatagaatatgtgtctaataaatgttggttggttgaaagataattttcatctgcagtttctttatgcacattcgagtttagtatcttctgaattattgttttgttttatatatgacttacatgcacattaaagtaagaaattttccaaagagcttgagtagcgctaagattggtcattttcaagcatatcaaaagacaatgagtgaaaatactgtagctatactttattactctgcaagcgtatgactaaatgcagctgactcctccacacaaaattaccatagtggttaagagtgagattttagcctaatacctaagtctgaacctttctctgctgctaactcattgtgtgatttttgtgcaaattacctacatttctggacctctatctcttcacttttaaaatggggatcactttgataattgcacctatctcacagagacattttcaagatcgaaggagtttaatagtgtataaaatttagtaaaattcctggtacatcataattgctatgaaagattggttatgggactcaacaaaatctgttaaataaaaaaagtatgaaaatatgaaaatatataataacatagtaacatactacaattatgaatatggactcagttctaattctgaatagtagggaatgcatttggaattattagtaactaatatgatatattcttttgtaataactatatttttccatgcttaggtactgatcactcaggattctagttgtgaatgatagcagcaacactagctattcaaacagaaagagatttattaaagggacttttttactgaagtttctagacagctacaatcagatttgaaatgccaccaccaagaacaacacctacatctccccagagctcctcagtgaagccagcactgctatacccactgctgtagatgcctgatgattctggcactgcgtgccaagctgcccggggtggcctgggaagaccagctggctctgaccctagccttgtcagaaaatcagtttggcacagaaattgctttatctctctagaaccaaagtcttgtgtttttctttctgttgggcatttaagtcaaatacctctactctagctgcaagggaagctgagaaaatgaacttctgaaattccccaaaatatgcaggttgttcaaagctgctccctggccaccaaggtgtcctcaggcacagagacattaactagaagaggattccttgagcgccacaaataagaacttatggggccttatttagttgacaggggtgaacagtacctggaatatcagttgtaaatgtaaggagaattctcacatagagtttaaattgcttaactatattcaattatttcaaaaacatgaaacgaattatactagatataatctcccataggatttactgaggaatacagagaagagtaaaacaccctgctctgattcttacagtgagcaaagaaggtgtcaggagtagagaattttttcccacatgcaatgtgggaaaagtataaagtaccctacagatgcattgaaggaaactcctctctttaggaagaataaggagagtctgaattgatttgctggttaagtgtattggtctgttttgcattgttataaagaaatacctgaggctgggtaatttataaagaaaagagatttatctatacaagcatggcaccagcatcttctcagcttctggtggagccttaggaagtctttacccttcatggaggatgaaggggtgcaggtacatcacatgatgacagaaggagcaggaaaaaggaggaagtttcaggctcttttaaacaactagctctgacatgaactaatagagtgagaactcactcagtaccaagaggacagcaccaagccattcatgagggatccacccccatgatccaaacatctctcactagacgtctgagaccatctccaacatttgtggccacatttccagatgagatttgcaggggtcacacatccaaaccatatcattgaccaaacatttattgaatttcatattaccaatgaaggtacaaattaagtaatatatgttccatggaattattaaactttctccacatgttgaaagatttattcaggcataaaaagtttctatttccaagaaaggtacgtaagtggaaatatatagagaattttcagggaaaaatatgctttttaatttgactaaaaagttggttagatccagaaatatggtgggttctttgtgaatgccataataaagaactgaggcatgacactcattttattatttttaattgtttttccagagaagaggctgacatggttaaagtgtgttgttaggagatttccattgtcaatgtggtacagatcaaataaaagtgagaaagctcttttattataccaaatagcagatacggtgaattttaaatgcttcatggtaaagagaatagagtggaaagtgagatgcagatgacatagattctatggttctagaataaaattattaattttaatgaatgtgtggagcaagacagatatgaatctcagtgaccatgctggaaggactgtggtgttatttacatctatagaaacatgatggaaaacacattctggaatttagaaaaaaatttagatagaattgttgtgttgaatgaattatatttgttttctgttgctggataaaaaattaccataaattcagcagcttaaaacaacacccacttatcaactcacagttctataggtcagaagtccatgtggaccggactgcattctctgatatgggtatcatgaggtggaagtggatgtgttggccggactaaggtacttggaagctctggaaacagtctccttttagcgcattcagattgttgacagatcagtttcttgcagctgtagaaatgaggtctcagttttcttcagcaatggaaaaccccccttacatcaaatccctgtcttgatttcagtctttctgatttctgcttttgctggcagtttagaaaatcactgcttattttattagattagggatatgatttggctatgtgttcgcacccaaatctcatgttaaattgtaattcccaacgttgggggagggacctggtaggagatgatcatggggggcaagatttccaccttgctgcttttacgatagtgagtgagttctcaggagatcaggttgtttagaagtgtgtagcacatccttctttgtttcctgtctcctgctccaccatggtaaaacacgcatgcctcaccttcaccatccgccatgattgtaagtttcctgaggcctcccagccctggttcctgtatagcctggggaactgtgagtcaattaaacctcttttcttcataaattacccagtcataggtagtttgtttacaggagattgagaacagactaatataaataggctcttcagaatactttctctatcataaggtcaattgattactagacttagacaaatagtgtgcagctggaagtgctctctggaacttggaagaggattgaagtaagagatatactctgaagagtgaattattccagtagtgctatgaagagaagtgactgacataatcaatgaagattatattgagaagcaaaagtgaaaaatctgagatcttgcaggtaaaaaataaataaataaataagtcttagtgaaaagatctcaatttcatttatgggagtaaatgccaggaattgagagcgggaggtaaaatatgtattgttagacttgaggaggtcatgattcttgaagtggaatgaacgtgcacgtctaaaacacctaaaagtaacgggaaaataaaagaaatgaagaaagaaaagaataacttcccagatatctagcaaaagggaagcaatagaatacaccagctgagggacttgtaaggaacacatcatctgaggaaacgttcattgcagtaaaatgagaagatggaatgtgaataagataaaaatgcaaattatgtagaaagcatagttgcaagaacacagggtggactagagacaaaaagggcttaggaggtaaagaacaatcccctagtgcacataatctcttgttttcatctctttgccttggatcacgggccaatcatgacagcaatggtgcattttcatctttgaatccatgacacattgttggccctcaataaatttgcattaaacaaatgaaaagcaggtaaccagaagcgatctgtgcctacaagaggagctgtgtgtgccaggaattagtctagcaggagcttggtagattatacttcctggaaatatagatgcatataattttaaagatataatcatgaaatattaaaagaattgtaaaagtggcagtgaattatttagaaacagtgtccctgcatgcatgatacaatattcagatgtgtgttaaaatgtatgctccaaggaaagtcttggtatagttttatgtgcgctgcatattttcaaataatgctggaaagcagtttaaagcttttgaatttcttcatcccgttttcctgtctccttgtagagctccctttgatttcaaaggtgcttcattgctagaatgagaaataggtggtaggaaagtttaattctttgaggctaaagtttgaaacagtttttcatttacagataaaaattctacctttggacttcagcattgttcagttttccccgagataaatccgtagaagtagcctacacctgcctacaccttgtgactacatcttcagattatatatatgcaggcacagttttagaaatgggctggcaaaggaagcaagagggaacagaagataagatgctcccctcctctgtaaaagagatactgtaatcatatgattgtgtttttagccaccgaaagcaaaaaccgactgatattacctttagatgctaatgatttatttgatagaaatacatttttgctttaagcttattgatcatgctcatttataaatgtaaatttattctgtcatcaggattccaaatcatttaaaacctacaaatatttattgaatgtttcttgctaaactctgtggttggttttgggaggatgtgtaaaatccaacacttgatctccagggattttcatcacctaggaaggagagataaatacattttctttttgaatggaaaactaacatagcaaaagaaacaaaaatgctataaatattcaaagtatgagatgttagtcctatcacatcctttgttgtatgaggataaatataagtaaatataaaaacacttatatacatggcagatatcacttggtattaattctccttcagctcttggaaaaataaatcttattgaagagccctataaacaccacttctcactacacttactgcataattttagaaagaggtttaattaacatgaaatagctacactcaactggtctaaagcagctgtgtagcgtgaaagtcacacaaagccccagtctcaatgatgtattcctcttcccacctcaatcatcataatccactttctgtggtactccagtaagttcagggaggctttctttcaatactgcaagtcctcattgtcctcctcttaattctcataccttttcatttcagaattctctcttggatctttgatagtacttgtaccacctactggctcaaacatttattttagttgctctgaaagcacaggaggcgaacaagaggcaaaagtggagactttgggcatagtggccattgggtttgtggcagatttttctggcccatctcagtaaagaaaggaatcatagtgtttggggtcttaaggagaggacaaggaagatatgagccaggtatcagcatcagagagaccatatggccactgaaatctcaaactggatcatagcatactgacagtgcttacatggcccgcattccttgaattctgaaccctcaagatgatgaaacatggagaaatagctgatgtaaacttataaatacataaatcattaggcatagggtaggcctctataaaattgatagttgaattgtgactcatcacttgggattggtgggttacaaatgtgtaaagcctcaggatttgctctctgttttcaccttaatttgcttatttattaaatatgtagagagcagggatgaggaaccactagcctgggagcaggatccaattctcaagaagaagtaattgtttattatagagaagtaaagtagcagaatgaaagaggaaagaaggaaggaacagcaagagggagggatggatgttaatttgccccacttgggtcaagtctaccactctctactccatgtctataatattaatctctgtgtcataagggaaggttctgtgactggcagccacaccgtaactagttggaagagttgtccaaagcaagttagtttgctccttctgaaaaaaggagagcagttgtagaaagtttgcacaatgaaaaaagtttatatttatttgaactgttgtattagtcttcctattattaacagagactagccaggcagcaatatttaactatgtgaataataaagaccagaagtcaattttttttaaagaaaccatagctggccagaataattaaagctgcatgttttcacagtttgaggttctgttaagtcaggaattaagtcattgtcgacacaagataggtcaatctcatttagtagcatgccattgtaaattaggtgatttctcatcactccttgctgctccatgatagtacaaatgcttgtcaaaagctttaatggtcataggtaaaacactaattatgtatcccacaatagttgttacagtaaggtaattctttgtgtctctagggtaggtaaatgtttcagttatatatttgcaatgaaaactgaggacagttacagtggctcatgcctgtaatcccagcactttgggcagctgaggtgggtggatcaccaaggtcaggagttcaagaccaacctgatcaacattgtgaaaccctgtctctactaaatacaaaaaaaaaaaaatagctgggcatggtggcatgtgcctgtaatcccagctacttgggaggctgaggcaggagaatcacttgaacccaggaggcgggggttgcagtgagccaagattgcaccattgcactccagcttaggcaacaagagcaaaattccatcaaaaaaaaaaaagaaagaaagaaaatcgggtaccatcctatcttgatgaacacaaatgtgtagaacctcaggatttactctctgttttcaccttaatttgcctatttatcaaatacctgtagagcaggaatgaggaaccacttctctgggagcaggatccagttctcaagtttgattttatctaatctatagagagttggtattctgccatgaaaagtaagtctttcaaattaatgtccttaaaatgcccttcatctggtccaatcagaacagagtaggagaaaacagtgctagagacacagattctcagttagactttctgatttaaaggcccaactccaccacatgatggagtgtaacctgaatgacttagtctctctgtgtgtgtttctgttttatctgtaaaagtggtataatactaggacctacctcatatagttcttatgaggattaatttggataatatttttaaaaatgtttggaacaatgcttggcaaacgaaagcaacataagactgccccttaaatgaaaaaatgaataaataaacaaagttcctcaagttttaagtacatgtaaaaagcttttgtgagctaatattttatagctattaaaattatacaaatggtacacatttattataaaacattcaagttgaataactgaaataaattactcataatcttacaatctggtattgatagtattttagcgtatttttaaaatttttgtacatcaaattagaatcttacagtttaactgtatattctcatttgtaatggtattgtcttatgtggaattctataagcattattccatagtcttacatattttaataatatattttttaactaattccttgttgctagattatgagctttgttacatatttagataggttccaattttgtcactttttatgatgctgtaataaacattctttatgaaagtctttgcccacttttggggtgatgagagcacctggaaatgaaactgagaaaaagagaggaacatgtaaattatttgatcagtaaatctataaatattatgccaatttacatttgcagtatcattattacctctcatggtgacaatgtaaccgaattttaccaaggtcaattttccttacctaacccacgctttggaaccagctgagccttctctcctccaggtctcttcccatgacctcttttccctccctctacttgtctttagtcttctctcctttgtctctccatctctgtattttcttcttttcagtcctttttatctgattctagttgctgctaaaaaaatatatatgtctcatgaggtatgttcttcccaacactcatagactttattctaacttcagagtaatggctgtctgcccactccttcctttgtaagtaagaatctgtgacttgaagaatcacattttttcactctggcatagtacatttgctagtggtcttaataatagtgggccactagaaaagtaagttttaattgtgtttttaactgtggagaaatgataagagatgtcttcgaaaatagcaaaattattgataggatgtttctgctgcagcctacaaagttagttacttttcactggagactgagtttattacatgagcggcctgtcttaagtttcttgccatctctcaagcacattctctaatataatttattcattgaagcatacaactgtgtttctgccttagggctttattttcatctcctcacaatatacaaaattaaaccccaaagacaatagcattatatgtttcaaataattcttcaatagatatttgtaatttatatttcatgcaatataacaagatgctgtgcattgattgagagcactgtagagaatgtaaactaaactgtaaaatgtgtccagaatatatttcaactaagatggttttatcagtctaaacttaaaatgtgtttcaaaaatcctgcaataccaggattctgcatctattgtgctgattttgctcacttctgactttgtaactttttctgaaggaatcacatttttaaaaatttttaaatatgtaattaacaaaaattgaatatactcaaggagtacaatgtaatgatttgatatttgtatgtacgtttgcaaggattatcaaaatcaagttaatacattcattaccactcatgctgtacattagattcagacttgttaatctaattggaagtatacatgatttgaccaacatctccccactttcctagccccttgaaactatcattctactttctgcatctatgactttgacagttttagattccacttataagtgagattgattgtacagtatttttctttgtttatcaagcttatattcataaaatgtccctccagttcattcacgttgtcacgaatgacagaatttccttctttttatggctaatattacagtgcgtgtgaatgtgtttgtgcttgtgtgcatacatgtcacatttttgttatctatacacctgttgatggacacttatgttgtttccatatcttggctattgggaataatgttgcaaaaagcataaaaatgcagatatcccttcaacatactgatttcagtttttttagatttgtacccagaagtgtgactgctggatcatacagtagttctatttttaattttttgaggaatctccaaactggtttccataataattgtatcagtttaaattcctaccaacagaggagtataagcattcccttttctctacagcctcccaaacgttgttgtttcttgtcttttgataatagccattctaacaggtgtaatgtgattgtcttgatttgcatttctctgataattagcaatattgaacacttgttcatgtatctgctggccatttggtttttcatttgtttgttttgttttgtttttgagatggagcctcactctgtcacccaggctggagtgcagtggtgcggtgtcggctcactgcaaactcaacctctcaggttcaagcgattctctttcctcagcctccagggtagctgggattacaggcacccaccaccacatctggctgatttttttgtatttttagtagagacggggttttaccatgttggccaggctggtctcgaactcctgacctcaagtgatttgcccgcctcagcctcccatggtactaggattataggcttgagccactgcacttggtctctgctggccatttgtaagtcttctttgaaaatgtgtcttcactttttagaaattgttttgtaattgagttccttatatattctagacattaaccctttatcaggtttaaaaatattttcttccattccgtaggttgccttttcattttgttgattgtttcctttgctgtacagaagtttttagtttgatacagtcccacttgtttatttttgcttttatttcctgtgattttggtgtcttatccaaaaaatcattgccaagaccaatggcaagaagcttttcccctaagttgtttcctagttgtgttacaatttcagctcttacatttaagtctttcatacatttggagttaatttttgtatatggtataagacgagggccaatttcactcttttgcatgtggatatccagtttttcaaacccatttattgtggagacatctttttcctcattgtgtattattaatggcattatcaaagagtagttgatcagaaatgcatgggtgggtgtttttctgtgctctgtattttgtttcattggtttatgtgtctattctatgccagtaccatgctcttttgattactacagttttataacatagtttgaaattcggaagtgtggttcctctagctttcttttttttttttttttcaagattgctttggtattttcatttatttggggcttcttcaatatttaatctgtaccttatagtttttagtgtatggacctttcacctcctaggttaaatttattcctgagcattttattgtttagatgctattatcatgggaacattttcttagtttatgtagattttatatgtagatttcgtatctgcaactttactgatttagttttctagttataaaaggtaaagtctttagggttttctgtatatggtattatgtcctccacagagattatttaacttattttccaattaggatgctttctatctgttttttttttaaacccaactgctctaacttggacttccatactaggttgaatagaagtgacaagagtgtgcacctttgtcttgttcttaatcttagagaaaacgaattaagctgttcaccattaagagtaatgttagctgcaggtttgccatgtatagcctttgttatgttgaagtatattcattctacaactattttgttgagaatttttatgataaaagaacttttaattttgttaaatgctttgttgcatctattgagatgatcatatgatttttagccttcattctattaatatagtatatcacactttctgttttgcatatgttgaaccatccttgcatctcaaggataaattccagttgatcacagtgtagaccttttaaatgaactgtttagttcactttttcagtgttttgttgaggagttttacatctgtgtttattagaagtattggccagtgattttcttttcttgtagcatccttatctggctttgatatgaacgttactggccttgaaaaattacattggaagtgttcccatctcaatttttgggggggagattttgagaagaattggtgttaattgtttgttcttaaatacttcataaaattcaccagtgatgccatgtgttttaggctttctttgtttttaatgggaagttttaattactgatttaatctctttacttgttattgatctcaaatagcctatttctttatgattcaatcttggtatattgttcatgtctaggaatttatctgtttctttgaacttatctaatttgttggcatataagagttcatagtgatttcttatgatactttgtatttccgtggtatcggttgtaatgttttctttttcatttataattttatttactttgttagtctttttttctttgttagtctagctaaaggtatataaattttgtttatgttttcaaaaaaactcagtttcattgatcttttctataggcttttctttatttctagtttttatcttattatccaatctttttcccctttatcaaggaaaacttctgataaggtttagctgtgtctgcacccaaatcctatcttaaattgtagtttccataatcctcatgtgttgtgggaggaagccagtgggaggtaattcaattttgggggtggttactcccatgctgctgttctcatgatagtgactgagttctcatgagatctgatggttttacaagaggcttttttctctttgctggtcttctctctcttgctgccctgtgaagaaggatgtgttgtttccccttctgccatgattgtaagtttcttgaggcctcctcagccttgtggaactgtgaggcaattaaacctctttcctttataaatcacccagtctcaggtatgtctttattggcagcatgaaaatggactaatacagtaaattggtactgggagaatggggtgttgctgtatagatacctgaaaatgtggaagcgactttggaactgggtaacagacagagcttggaacagtttagagggctcagaagaagacaggaaaatgtgggaaagctcagaacttcctagaggcttgttgaatggctttgaccaaaatgctgacggttatatggacaataaagtccaggttgagttggtctcagatggagatgaggaactcgctgggaactagaacaaaggtgacacttgttatgctttagcaaagagactggacgcattttgcccctgccctagagatttctggaactttgaacttaaaagagatgagttagggtatctggcagaagaaatttcttttatatgtatatatatataaaaaatatatatatatatatatttatactttaagttctagggtacatgtgcacaacatgccagtttgttacatatgtatacatgtgccatgttggtgtgctgcacccattaactgctgaagaaatttctaagtggcaaagctctcaaggaagcagagcataaaagtttggaaaacttgcagccccacagtgtgatagaaaagaaaaacccgttttccagggagaaattcaggctcactacagaaatttgcataagtaacatggagccaaatgttaatcactaagacaatggggaaaatatatctagaacatgtcagagaccttcatggcagtgcctcccatcacagacccagaggcctagaagggaaatattgtttcctggactggacccagggtccccctgctctgtgcagcctcgggagatggtgccctatgtctcagctgcttcagcaccagctatggctaaaaagggccaaagtacaccttaggccatagcttcagacagtgcaaatcccaatccttggtggcttccaggtaatgttggtgcacagaaggcaagaactgaggtttgagaacctctgcctagatttcagaggatgtgtggaaatgcctggatgtctaggcagaagtttgctgcaggggtggagcagtcatgaagaaccactgccagatcagtgtggaaggaaaatgtagggtcagagcccccacacagagtccccactggggcactgcctagtggagttgtgagaagaggaccactgtcctctagaccagagaatggtggatccactgacagcttgctttgggcacctgcaacagccacagtcactcaatgccagcctatgaaagcagccaacagaagggctataccctgcaaagtcacaggggcggagctcctgaaggttgtgggagcccaactcttgcatcaatgtgacctagatgtgagacatggagtcaaaggagataactttggaattttaaggtttaatgactgccctattggatttcagagttgcatagggcctatagcccctttgttttggccaatttctctcccacttggaatgggtgtatttacccaatgcctgtacctccattgtaactagaaagtaactaacttgtttttgattttacaggcttataggtggaagggacttgccttgtctcagatgagatgttagacttggacttttgggttaatgctggaatgagttaagactttgggagactgttggaaatggatgattgtgtttcgaaatgtgaggacttgagattttggaggggtaaggagagtggaatgatatggtttggctctgtctccacccaaatgtcatcttgaattgtaattcccataatccccatgtgtcatgggagagacccggtgggaagtaattgaatcatggggatggttacctgcacactgctgttcttatggtagtgagtgagttctcatgagatctgatggttttatgaagggcattttcccctttgcttggcacttctctctccttccaccttgtgaagaaggatgtgtttacttccccttccatcataattgtaagtttcctgggtcctctcagccctgcagaactgtgagtcaattaaacctctttcttttattaattacccagtctcaggcagttctttatagcagcataagaactgactaacacaacttcttcccagaatatacccagatataaatgaaatagataataaatcaaagtcagctgtactgagtttgaatgagactgatggtctcttgagcccagagtttagtttctaacagatctggaattgaatctaggcttcttccctagccatttcttggaggtagcccctttggaagtatgactagacctttccaatcattaatctctttgtctctaaagtaagcataatatctacttttttagggctgtgttttagtattaaggaaataacctgtttagctcaatgccaatcacactgtaaatattaagttaatggaaaaaatgctaaaaataaaattgataacaataatatagagaaccttttggcatggttgtctaaataagagaatagataaaaaaagaagtgcaaactatagaccaaatgtttggatctcatattagtttagcatttggaaactggctatagaactagacaattaatattctttgctaataatctataacatttgttaaacagttcgaattacagtagaaccaccaagaattctgaaaacccagtaagttaagttgatgacatgactggctgtctggatgctacggggcatgagctttagccatactcattaactttgataccccaaagtcaccccaaagaaatacaaatacagtgtattaggtatgcaatatccgcttcaagacaaaacttacagtcatttctggtatgatcaaattgattcccctaagtccttgttataggaaaaattatgacacacccacttatcagtaagacacgaatgtaacatttcctgagatttataatagttattgagaaaaggaaaagaaaatttatgaataatagaaataattttcctttatgttttgaaaaattaactcttatttttcagttatcgaacatgtaccttcaattcttcaatttagagtttatttatgataactaactttgatatcctctgagagcatgtctagaagatggcaaatgcttttcaccatgaattagtgctgaatgcagttttaaaaatcttaccttgttaatctgttagaagatagtagcaaataacaataccacattgcttatttgttgaatagcaacaatttcaataattcagtagaagacataagttatatgacagatatatataatcataaatctaatatatttgtaatgaagacaaatattagcttatatgtatgatgtttaatcttactttagactctaaataactgtgtgatattggaaatttactgaaattcgtaatgattatattttatttctttgtaaaatatagtaatttgacttaatgatctctatgattacattattctctaaatctggtaaaggtgaaactttagaaattgtgtgtgtgtctatatatatacatgaatacatgtgaatatattcatagacacatacacatatgtacacatacacaaacatatattcacatccatatatattttttaattgggtagaatatggagtgaggaaacttattgtattcacaaattgagtacttagtaaatatttcatagatttattaaataattttactttatgatatatattagcaagttccctgtgcttccctgtgcacgttttgaagattaaatgtagtaaaggatatagagcactttttttttattatactttaagttctagggtagatgtgcacaacgtgcaggtttgttacatatgtatacatgtgccatgttggtgtgctgcacccatcaactcgtcatttacattaggtatttctcttaatgatatccctctctgctcccccaaccccacaacgggccctgatgtgcatgatgatccccgccctgtgtccaagtgttctcattgttcaattcccacctatgagtgagaacatgtggtgtttggttttctgtccttgtgatagtttgctcagaatgatagttgccagcttcatccatgtctctacaaaggactttaactcatccttttttatggctgcatagtattccatggtgtatatgtgccacgttttcttaatccagtctatcattgatagacatttgggttggttccaagtactttttatatgtctggtactcatggtatgtgctcaaagattcagagaagttatagcacttcaatgtgagtctgatagtcacagatgcatcattatgaggatagtgtgcctgggatgaagggaaaggtagagaggaggcagagaagaaatgccctgagggtccagattggaagaggattcggtggagagaacttttcatttcaagaacaagagaaaaagagtagaaggaactcagcctgaaagtattcccaatcgaggacctcaccaactgactgcccatgccgggaacagttggccatcccacagtctaagagaaactaatgggcacacactgtaaaatgtaataggagtttaatgtaaatgggtatctagactttggaacttgggcgtataccactaaagatgttaacctaaggaaagtatagagttatcagtaataacatgtcagtttgtttcttgtttggttggtttgcttttaaacagtaggatagactgcttgctatacacatgttagaagctttgtagttgctaactggcaggcagtaaagcacggtggttaaaagtcatgccctgggtcaacatactagctgcttttcttactatccatgtgatctgtggcaacttacccaacctgtctatgcttaagtttctttaattgtataaaacatgtgcaatagcacttgtctcctacagctgtttcaaggattagctgagtttacctgaggaaaatatcatagataataagttcccaataaaagctgttactttaaaatcatttaattcaggtctggagaaaaacaaacttggaaaataccaaaattgagaggggaaaggcaggatgaaaatctcacagaaaataaatggttagagttgatggacgaccaggataacacagtgtctctgatccccagatagtatagaatagaaaggaaaaccctgttacataaacagtgtcaaatactgtattagactgttctcacactgctataaagaaatacctgggccaggtgcggtgactcacccctgtaatcccagcactttgggagactgaggcaggcagatcacgtgaggccaggagttcaagaccagcctggctaacatggagaaaccctgcttctactaaaaaaacaaaaaattagccaggttggtggcacatgcctgtaatcccagctactcaggaggctgaggcaggagaattgcttgaacccgggaggcggaagttgcagtgagccgagatcgtgccactgcactccagcttgggcaacatgagcgaaactccatcaaaaaaaaaaaaaatctgaaactgggtaatttatataaaataaaaagaggttttattggccatggttctgtaggctgtacagaaagcatgatgctggcatctgctcagcttccaaagaggcttcaggacacttacaatcatggaagaagacaaagagggagctgacacgtcttatttggcaggaacaagagcaagaggaagggcagggagatgctactcacttttaaacaaccagatctcgtgagaactccctcatcatgatgagaacagcaccaagaggatggtgctaaaccattaatgaaaaaccacccccatgatccaatcacctctcaccaggcttcacctccaacattgcggattacaagtcgacatgagatttggtgggacaaagattaaaaccatatcaaatactaaaatttaaagattaaaaactgaaatcagaaaaaataagccaactagaaatttgttaaaaaaagaatataagatattgattgaaaagtaagttattattctgtgtcacttccatataaaacattttttaattggcatgaatatttagagttaaataaatactagtagtgtggttaagggtttctgtactttatatttttcctcatttgtttatagtgttttttctcaaattttctttcttttctattaactttaaagattctattgattcttgtaccaatagagagttttaataggtttatgaattggcaagttctctactaatggatggtgagaatgattcatctttaaccccaaattcaaataatatcaagagactgttaaaatggtgcatgacgattttagcctttgtttcagtattaaactagtggcacttcattaatttttaacgggattcaatttgcctgttaagtagtttatagaatcatcttacttttggtttcctaagaaggccaaagtattttgcatactcctttctgtttagcatattttttccatgtctctccatgaaataaaaccacatttgacaataacttaagattggtattgtcaagtgtttgcaacctttaggggtcttttgttttaaatacctccatggaaaaagaaagcacacgatgcggaatcggactcatcagaactcaaactgatttctgttactagctctctgtggcctgggcaagtcacctaaactctggaagattttgtttttagcatgtgtaaaataggaaatttgataaatgtaacatttaagtgtattatgacatgtgaccactaaatgaaaacttttgttacaagtattttatgggaataatgactaaggattagcattcttgatatttaaaaagctcacaaattggataagaaaaacgatatcacaaaagctaaaaagagattattcagttaataattttattattagtgtatgtatgtaaaatatttaacatcactacttaacatttaaaaagtaaaaaccacagtgatattcattaaggtaggtaaatttttaaataatgataaatataatacaaaaaatgtggagttttattctataccaatcctgaatcatattatttataattttacctacttttaatcaatgtatattcagattcatattctgctttttaaaaataatttgaaaataatacatattatttatatcagctataaagtattctatatgatcattctatctcaagttacccaactttcccttactgatgaaaatttaaaagtttccagttgtagttgattatgaatagtggtagatggaagcaatgaacatattggtgcacattatttcctcatttaagggaagtgatgacaatggtagttatttctatagtaatgcagattccatgactgggaaattggagtttgtgaatcaaagacattattctatttttacttgaaaagagtgtgttgccacattatctcacaaaatgatacagtgaccacttcctccatctagaaaacttttctccttggctaccacaatgccacacactctcacagttttctttctctctcacttggcattccttttctttttcctctaaatagttattagacattggcacgtcccatcaagtcttggacagcacttctttcactagatcatcccatctaatctcatctttcaataccattcagctactgatgactcctaaatttatgtcttaatttcatcttcctgagacccaaactcatctttaaaaccgatatgggaacttgacacctcaagttaagactaaaacacagctcctaattttcatccccaaatctctttctctaatcgtttttttccgtttcaggaattgctactaactcacttcaagtttctcaactcagaatgtctagaagtcagccttgattccttcttttcacttgccatagtcgccaggagctctcaccctgaaatacaggctgtcaggatgttctgagaatactctcatatatccacttcttgatacatccacctcaggccaactcactcactatttttacttttccctgttattgttggaatatccatacaacttattcttgatgtagcagttatagtggtattttcttcaccaaataaaacaatgtttacattgtaatttgatcagaagatgctaaatagatatttcgagcagtgctcattgaggtatgtagagcatctcatgctttctgaattaaaagaacatgtacagtgtacataatatttggtcagggaccctaagactggtgagttttatgttttttcagagtggtaaattagttaatgcaaagcaggtgttcatttatagcttcaagtaggaaaattcactgtcctataaaaataaattttataagcactgtagctatcacaaagttaatattatgttttgaggaattaataaaaaaattatatagttagcaattgaatatttaatctcttgttcctgtagtatatataagtaaatataaaggaaaatggaaaaaatagacaaaacatacagacttttaaaacctcagacatttgtcagtttccatgtagttgagcggttttgagtgagtttcttagtcctgagttctagtttgattgcactgtggtctgagagacagtttgttataatttctgttcttttacatttgctgaggagtgctttacttccaactatgtggtcaattttggagtaggtgtggtgtggtgctgaaaagaatgtatattctgttgatttggggtggagagttctgtagatgtctattaggtctgcttggtgcagagctgagttcaattcctgggtatccttgttaactttgtgtctcgctgatctgtctaatgttgacagtggggtgttaaagtctcccattattattgtgtgggagtctcagtctctgtaggtcactaaggacttcctttatgaatctgggtgctcctgtattgggtgcatatatatttagaatagttagctcttcttgttgaattgatccctttaccattatgtaatggccttctttgtctcttttgatctttgttggtttaaagtctgttttatcagagactaggattgcaacccctgccttttcttgttttccatttgcttggtagatcttcctccatccctttattttgagcctatgtgtgtgtctgcacgtgagatgggtttcctgaatacagcacactgatgggtcttgactctttatccaatttgccagtctgtgtcttttaattggagcatttaccccatttacatttaaagttaatattgttatgtgtgaatttggtcctgtcattatgatgttagctggttattttgctcgttagttgatgcagtttcttcctagccttgatggtctttacattttggcatgtttttgcagtggctggtaccagttgttcctttctatgcttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatgttggagcttctgcacagcaaaagaaactaccatcagagtgaacaggcaacctacgaaatgggagaaaatgttcgcaacctactcatctgacaaagggctaatatccagaatctacaatgaactccaacaaatttacaagaaaaaaacaaacaaccccatcaaaaagtgggcgaaggatgtgaacagacacttctcaaaagaagacatttaggcagccaaaaaacacatgaaaaaatgctcatcatcactggccatcagagaaatgcaaatcaaaaccacaatgagataccatctcacaccagttagaatggcaatcattaaaaagtcaggaaaaaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgcggcactattcacagtagcaaagacttggaaccaacccaaatgtccagcaacgatagactggattaagaaaatgtggcacatatacactatggaatactatgcagccataaaaatgatgagttcatgtcctttgtagggacatggatgaaactggaaaccatcattctcagcaaactatcgcaaggacaaaaaacccaacaccacatgttctcactcatatgtgggaattgaacaatgagatcacatggacacaggaaggggaacatcacactctggggcctgttgtggcgtgggggcaggggggagtgatagcattaggagatatacctaatgctaaatgacgagttaatgggtgcagcacaccaacatggcacatgtatacatatgtaacaaacctgcacattgttcacatgtaccttcaaacttaaagtgtaataataatacaaaaatttaaaaaaaaaaaactcagacatttgtcccaccttcccctgtttttaataatgctcgttgttttgttcctacagtgtctgagtattaagtattttctaatgagaccttttgtgaattagatggttaacgaaagagtgaaaacattacttatcaaaatactaataaatatttaaatataaatatacttattcttaagcatatttatatataaatattcttaagtatacacttaaatatatatacttaagtatatatatttaagtgtatacttaagaatatttataaatatactcattcttcagcatatttaaatataaatatactcattcttcagcatatttaaatataaatatactcgttcttcagcatatttaaatgtaaatatactcattcttcagcatatttacatggaaatatactcattcttcagcatatttacatggaaatatactcattcttcagcatatttacatggaaatatactcattcttcagcatatttacatggaaatatactcattcttcagcatatttacatggaaatatactcattcttcagcatatttacatggaaatatactcattcttcagcatatttacatggaaatatactcattcttcagcatatttacatggaaatatactcattcttcagcatatttacatggaaatatactcattcttcagcatatttacatggaaatatactcattcttcagtatatttaaatatgagtatactcattcttcagtatatttaaatgtaaatatactcattcttcagtataattacatgtaaatatactcattcttcagtataattacatgtaaatatactcattcttcagtatatttccatgtaaatatactcattcttcagtatatttccatgtaaatatactcattcttcagtatatttccatgtaaatatactcattcttcagtatatttccatggaaatatactcattcttcagtatatttacatggaaatatactcattcttcagtatatttacatggaaatatactcattcttcagtatatttacatggaaatatactcattcttcagtatatttacatggaaatataccattcttcagtatatttacatggaaatatactcattcttcagtatatttacatggaaatatactcattcttcagtatatttaaatatgagtatactcattcttcagtatatttaaatatgagtatactcattcttcagtatatttaaatagttgagtcagtattatatcttctaattaggtttctaataataatttcaaaaactatgacatgttttcttcccatttttttatggctgaatcaaaatgttgagatttataacttggaccccgtattctataatgtcacacagacatatatttttttaaattttaccttaagttctgggatacatgtgcagaacatgcaggtttattacataggtacatgtgccatggtggtttgctgcaccaattaatatgtcatctgggttttaagccccacatgcattaggtatttctcctaatgctctccctcccccagccctccaacccctgacaggccctggtgtgtgatgttccccttcctgtgtccatctgttctcatttttcagctcccacttatgagtgagaacatgtggtgtttggttttctgttcctgtgttagtttgctgagagtgatggtttctggctttatccatgtccctgcaaaggacatgaactcattcttttttatggctgcatagtattccaaaaatgtatatgtgacacattttctttattcagtctatcattgatgggcatttgggttggatccaagtctttgctatcataaatagtgttgtaacaaacatatgtgtgcatgtgtctttacagtagaatgatttataatcctttgggtttatacctagtaatgggattgttgggtcaaatggtatttctggttctgcatccttgaggaatcgccacactgtgttccacaatggttgaactaattttcactcctaccaacagtgtgaaaacattcctatttctccacatccccttcagtatctgttgtttcctgactttttaatgattgccattctaactggtgtgagatgagatctcactgtggttttgattttcatttctctaatgaccagcgatcatgagctttttttcatatgacaaaaatatcttataactaggtttgattctagtccagtatgctttttgttataatatgttacttaaagctcagacaggaaatgcaattctattttggggaattaaaattagtgatgtggtggtcataaagatgtgggaaaacttttaggatagtagaagctattgtccttattaaggtgtacaaagaattttggacctgttttttttttttttatttgattttcaattattttctctacattgtcattttagcccattgctatgtcaaccagtttcagcttgccctatgggggaaaaaagcctattaaagaaattctttacatgaagaattgatatctctgtgtttatgaatgtaacactttcagaagattgcactgaaagcaactatatttacaaggcttatctgtcctgtgtgtgtgtgtgtacttatcctaatgttgttaatgttgtttctcattcagagccttgtgaagtgggactgctacacacattttaagttaatatcaaaacacacccacaatgcttttggtgaaattgtttcatgttgccaagtatacatatgccaaaaatctcccctctttatcaaaacagatacgatagttacagtagttagtcattgaagtagctggatatgtgtgccattcaccttcataggaatcagagggattgtaagaatgaacttgagaactgcattcttgccatccaggaactagggttaggattggaataagtaatgtgtgtagcaagtgccagccaaagagaagggaatcactcactatgcatgagtcctggggaagatcagagcactcataaaaggcatttgagttagatcttaaagaatttgtttactatatttaaccatattgatcttgagaacaattcctttgtatttcttcctcaaaaatgaactaaagcagataaagtctttataacctatgttttcaagtatatgaaattactatatcatagtctgagaccaagtgtacaaatatgaaaagtggagatacaaagcaattttccacttactgcaagtcagagcaatatctgtctcaattgtcatgagattttacttgaacatgacctcatctttttgtcctttcatgtgtggtcgacctagcttcaaaatcattgtatagacagtacattttccttatattgttgcacagatcactggcaattttgcatcattgaatgcaacattgtatatcaaaaattggcatatataaattatatcactgcacacagggcagacaaatttgtacacattgttttgcatctatttgtatataccattgacattattgcctgtttaataatagattttgttaatgcacagataataagtacatttcttttttgctattctgcatttttttccagtgatgtcttttagagctgagcctctgccccagaaaataatgaagcttcagtaagagtccctgaggcagatggcatggagatgttatttgcatccctaattatttggttaataaacaataaactatatttagttactagttagaagattttcattttgtaaatgtacctctgacccttttctttcttaagtgaatgaaacagtaataaataactaaagctgttttttgcacaaaatgctagatagagactaggatttgagaatctatttttaaattcacttattgttacccacttagctaaaagccactatgtgagttaaaggaatatcctgctgtaaacagttccatttaaattcttaacatttctactttgaattgtggatcctctcagccagcttcccgggtccctttgaagcaggcctgtgccaagattccccacctctcatggggaactaagcaagtccattcttattcccagctcatcagaataccctgtccactcactctgctgacccacataagctgattgctccctgatgtgtggagaagtgattgtgataatgttcacaggaggggatgtgctaatgcatgagtgataactggagcccggtaaaacttactgagacagaattctaagcagaattccacactcctttcctagtgtggtccactctgagtgctagagttttaatacaatccaaggatttctccaagataattgttaatgacttaattttatgaggattttatttatgtaaacaatcaaataatttttaagaatgaatgaatatatgtatatatatatatatatatatagagagagagagagagagagagacttgagtaagaatatctgcataaaataaattaagccaagaataaaatctagaataaatacagtaactgctctggagaagtctaattctgctctactggagatacaatgagaaccactaacatgattaaggagatttttttcaattacaattcaatttgccttacataatctctgtcgttcttatatgtatgcagctggacccaagaattttccctcctgtttcagggatgttatttccaggatataattaattaatatattcattttttactttattcttatattcattttgtagatattgagtgcctattatgtccagagaaccatgctaggcagtggttattaaataatgaatacaaataatttcttgacttaaaaacaatgggcaatcctaagagtttacttagtacttgttcagggtttgctacaaattccatgatttaactgattttcttattgatatccattctttgatcttccctctaatagaggggcaatttggtaacctatatcactattgtatgtttgagctttgaagcattttgtagtctatatacttactttctgcatcttcaccgagtaatattccttgtgatctgcgtggacaagaatgtttttacttttttttttttttatatcagagagaataacatcttgagaatgatgacattttctggacaattccagtgaatgggcacttagctagggaagccaagaaattatgcctaattaactatgctatttccaaaattctgcagacttttactaagaatgcatgccagggatgaaaaaatacaaagtaaagcagtagatttgcacccagaaaactgacataacttttcctttctttgcaacattgatatttgccttcaactgatgaaggcttcgatcttgatttcaattagaaatgcagtgaacaaagagattctagggaatacatacaacatgaagctcctcagtcttccttacaggggagaactacacagcagcttccaaatagttgcaaagacgaacatgacttcagtgactttgactagattatattatttttattgcctttatttttcacacataagacttcatttctgtgaataaaatatatgacatatctggttttccatatggtaaaatctttaaagattttttgtacattctctaaatgaataaattggattctcaagtataaaaacatcataaaaattgcttataaaatattctaaaagaaaccctgagtagctggcatatagacgtgctctacaaatatttgctgaatgaatgaaccaggagaggtatttatagtaaataaggaaatgaccagactcattaacaataaaaattatatacagtcaagtgttacttagctgaaataacatggtgtaaataaatggtgtaaataatatgccccctatattaataaaacagatgaagcaaaactgaaaataagccaataagaaataaaatccacttgatagttttgctaatgattgtaacataatagcttgcattttaacttacattttaaataaagaacgcagtccaatctctcaaattatggaagtttttcttctaaaataattctgataactagctttcatttgaatatctccagtagtgaagagctcattacttttatgggaatccattctattgttggtaatagttatcctaatgctttaaaaatattacattgacatctgactacctgcatgttccttttagaaaaagtttaatttagaaaaagaaaaatactactacctgagataacacacaaaggtgtattttctcttggccacagtattttcaggacattaaaaaaataagattatacatcatttatactgtttagtaagtgagctttcaaattacaggtcatgtaagtgttcaagatgttctaatcagacctaattgtcactattttacattaaacttgtatacatgtctaatgtaaaacaatgtgtttaaaataatgtaaaataagggtatgtttgtttttacactctggctcaggctagcctctgtgtatatcactgtggcttctgtgtggagcaagaacttaatcaaatttggatttgcattcacattagtttcaccactatctaggctttacgtagttgtaagcaactgtttagcttttgggtctggctttcatttttcttgtctcttataatcttagggtaatatttgacattttaaaaacaaattaacatccttaaatcaaagatcttaaaatataattgttgtgaaattccctgaaaataatttacatattttttaaatacatgaaactaaatgacttgctgtaagtctgtttctcacaactgacactctgcttttcctgtgaagaaatacataaacagaagcctcagctagacagattttcttttgtttgcctaattgccagaaggttaatgattttcataatgccatttatgtctggatattatcagcactgtaaaaaaaaaagttctaataacttttgttagtgtagtctgcagaaccattgaaggaacaaacatattgtataaggaaactttttgttttctcagcaaagtgtttcaaatatgttaaaatcagctcaatattcagtattattatttggttaaattccagaatggaaagaacttgtagtaaaatgattaggctatgaacagacaaatgcaactgacaatgttaagtcgaaaagtattttttttttacttaattgaagcaaaatattaattttaaaaatatgagttagagctgaataatctgtagacataaaagcacgtatacttttagaatgtgtgatgttattgttgcatcactggaaaaccttacgtgtttattcttttgaagagtggaagatggaatttaatttactctttaactttctgttataaagcttaaccgtctttagtctcttcagagcaatgttacgagattgagtttccacatcattctggttattcttcttgaacacccttagttttaaaattatctttcttaaaagattgatctcataagattgaataccttgtcctatgttttatagcttataatttttcttttgtggactacctgttaaagtcttttacccattttttattaggtttactgattgtttcttattgatttgtggggcttgtttatacattaacaaaaatgaatatttttgttataggtttagaaatatcttctcccaatctatagttagccgtttaactctctgattcctgccttttgataatcgatgtctaattttactataatcgaatttatattttcctgtttagctagtacattttgagtcctgtttaaaaaatctttcccaaccacaaaaagatgctgtatgttctcttccagaaacttttacaatttgatctacacgttttgaccttgatttttgagtatggtgtggggcagaatcacttctagaacaatttattgtgggggaaaaggacggtgatttttgaaaaaggaaacaagaagagcttgtggattgctggcaatgatttctttatagatctgggtggctgttacactgttatgttcattgtgtgataattcctgatactagctatttatatgtttgtaatttgttcatttatatatatatatgtaaagactttataaaaatgcatgaaaaacatatctaataatacattgtaaatataatattctacttagatgtcataattttaaccctgtatattatttcataaagtaaggttacataattctttctaagcattagatacctttaatcatgaaattgataatgcgtttcttcaaaatgagtagctttgtttattgttgatgttaaaacaaactgtactggtataggttcaggtttccagccagtgaaaaacatttacatcattattcagtttgttatcctattaggtttcttttccaggtttatataattggcaaatttcataagcatgtctttcatgccttagagaataaaaatattaaaaatgacagtatacaggatgaaagcctgtggaacatcattagagagcgctcttcaagctgacatcaccattaatcaacgtatttggggcacgataactagccattttttaatctacctaaaactgttatctcccagcccacattttactagtttacatttgccagatattttgtcaaatgctttgcaataattaaaattgaagatacatctatggaatttatgctgttctattaaacaaggactcaattttataaaaggaaatccttataacctaccactattgcctcctctatcaccagaccccattcatctttttcctaaatatttacaactcacatgctagactttaaagaggatctctcttgttatttttcccagatgtaccaacttcactgtttttaaaatttatggtttttatggtttttagtttttgactatctttctttttttggcagctcctttaataaatattcaagaaagctaagattacatttatggataatgccagtccttggggttataatctgaattcgaatgcttcaaaaagttaaaggaacaggccaggcgtggtggctcagcctgtaatctctgcactttgggaagccgaggtgggcggatcatgaggtcgagagatcgagaccagcttagtcaacatggtgaaaccgtgtctctactaaaaatacaaaaattaactgggcatggtggcatgtgcctgtaatcccagctacttgggaggctgaggcaggagaatcgcttgaacccaggaggcggaggttgcagtgagccaggatctcgccactgcactccagcctggcgacagagcaagacgccaaaaaaaaaaaaaaaaaaaaaaaaaaaaagttaaagccactttgtctgtcttattatgtcttagcttgtctgaggaggtatttgtctatactcagttagtagttttgctacttctagaattatttgaaactgttgtctttgttggtagaaatgggtgacaaacagtactattttcctgtcattaaataatatctgatagtattatatcttctttcttctgttttgcttaaaaaatagctttcaagctcttttgtttgaaccttatttatataagtattaatttatcgatattttaggaatgattgggccactgccaattttcctactctagtttataacagatgttgattaatggatatagccctcttccctggctactctaatcaacaaatatctgcacttggttgaagcctgtttatccacttctcatagatcacatgacctccttgcagatgtttatcccccactgcaaataaaatctgagctcattaacgagttcattttagcacttattaagatgcctgttactgtttttgtatcaattagataattctccattataggcttaaactcatgttacatattattttcaatgttcagaaggtcttaaaattcatggtgtcatgtcttttttagttttgaataaaaattagtttttcaaatgtttatattctgtgcattggtcttagtctagaacttctcttagacttaccctagaaacttccaatttatccccaatatcttttaactactgcaaattttaacaggtttactgatgtataattgatatacattaacatatatatttatataaagtataatttatatatagtggtaaattttatatatgtacatattaatatatatcaatatacattatactatgtttagatatttaatctaatatattaatattaacttcaatatatttattatatattatattttatatattataaatttatatgaatatatacactgtataatttataaatatgtacgtgtgtgtgtatatatatatatgtcaacatggaaatattaccttttagctcactaattatttcttttcaggctggagtacagtggtgcaatctcagctcactgcaacctctgcctcctgggttcaagcgattctcctgcctcagcctccctactagctgggattacgggcacccgccaccacgcctggcaaatttttgtatatttttttagtagagatggggttgcaccatgttaggctgatctcgaactcttgacctcaagtgatccacccgcctcggcctcccaaactgctgggattacaggtgtgagctaccatgcccagcttagctcactaattatttcttagattatatataattggtagcctttcctcagatgagtttattttcctatcaaccaacttttgcatttctaaaactacttcatagtttcttttagtatccatctataaatgttttatttttccctgttgtaactgataattactgctatttttaatgaatagcattacctattttatatttttgagaggataaagcctatttatctccactagccctcaattgctattacttatggaactaattggtgttgaacttttgactttgttgacttcgtggcattggatttcattcctgtcatttgaaattttcatttgcatgttcttcttgacagccagtctctctctttctggtctctctttctctttcttctctcttcctatctcctctcatctcccctgttttttgtgctttatcattttgggactttctctactcaagtcccagaatgtccagtctgaaagtgtaccttacattactcgcccgatgcctgtgcctggcagtgtttttagggaatcatgtgtctagtcaccaagccagtgaatgcctttactcagctcagatatgcctatttgctaacctctttgggcatacagcctcatataatccatatgtttaagtgagtaatcagctttcttcagtctcttttcacaaccaggttagccgagggccagtctcggtttgcaaccttaaagcaagctttctgtagctgatacacacagggaacttacattaccaatattccgtagtagtcaaatgcccaaatgcctttgtatgtccccagatccggactctgtctggcctcggcttcagccccactcattgctttgcatgtttgttgcatttcttgtgcatagagatgtttatcttattttttgatcctggctatgtcttttcaattttcttcttatctatcttatctaaaaatacagtgtatttgaagcagaagggggtctcaaagcctgaactcataatgcaattttgcctggagtctccttttcaatttatttttttcagctgatacttatttctcagccagttattaaaggtagttctaaccctaattgaatttttttttcaccttgtatttttgctaaattagaatccaggcatatagtctctggtggtgttaaaaccaccaacttgagtgccgcgtttcttcaggagccatttatcactacaacagaaactccatggcctctctaaaccacccactaaattcctcttttgtctgacttactgaattacaaattacaaagcaaaaataactcatattagtccagagtactagtttcttcaattattcagattctctattgtaatggatcactctaggagcccacatagaatggacacgtagaatacaaacactgtatatctttacagcatacgtgtgctcacaccatatactacacacacgcaaatacacagggggaggaatatctgtgtatgtgtgagaataaagagaagagtgaggaaggaaagacagatggaggatgggaggggtgggaaagggaagagagagcacagaagaagagagagaaggggaatgaagaaacagcattcttattgtttcgagactagcaagagttccataacaagtatacatctttcaagttacttcaacaatacactagttatttgctagatgttttaggcactattatctctaggcaagtgttcttcttaggaactaagagtttatgactgttcagcatctccacttcttctaactcctctttgacgtccaaccactttctttgagctgctacaatacattgggaacttttttgccctcttatataccacattccagaggtggttgtgatgaaagaggtatcattattaatcctcggatcaatagaggttacacatttcacaagccaagtaaacaaagtaataaacttccccgaattgcattgcttgatagaccaaagagaaaaagggaacttttcatcgatctttccaccatgttcctcatgaaagactgacttttgccctccccttgaggttaatcactacagtattctctccacatatatttctgctaagaaatacattttgacttatatttcttctgattttagatttttgctttccttaaagttaacaataaattctattttgctaaaagtaatgagataaatgggattaagcagctgtatgttagttgcttgcttgctgaaagactggaatgcagcaaacaataagtaactgaagaaaatttattctggagcattcattagcaaaacagaggaaatagtctaagtttcaccaatcaatcagacattttctcacctgttacctcattgtattaattgctcgttgacttgagttcactcaatcactctgttgcttttggtaatacatagaactctgtatgaaattggctataaaatttcttcaaggtttcgaactgtatatctaacaggtaagaaaatatatttgttaccccacaataactgagtatattgttgtccccaaaattaacctacagctctttcaaaattttatggaattctaggtaaaataggaagatgaatgatatatgacaataaggaatattatatattaacactacaataggaaaaaaataacatataaaaaacacactacaaagcaggtataagtaactcattgttagtaaacagattatcaggaagtggtcccaagaggtactgcagactagaatctccaggatacacatcctgagatgaaaaatagcatctaggaagttaattaggagtgttttggggatgaaaacctgtggaagagaaaggaatgaaacagaaattagttacagggaggagtttaggtgaaatgcagtttcaatgaagtctttgaccaatccctgcagggagctctgagactgtgaagacacctcagagtttctacaggttggggcagggtactggctttttatagccccaggttgaccagtcgttgcagttgcacaaccccatgaaggtataccatctacatgtgcctctttttaacccaggaaattcctgaagaggaattacagctaagtactgtatcatagaaaaaatattcttgtaaaagtgtgaattatatgataatagaaactgagaagtagttacatcgtttgcacatatattccatagatagcacccatataacctatgcaaacacatacactagatacttaaatttttccaaatgttttgtgagatatgatttcgatatagtgaaaggtacagattttaaatttgtatttttttttaagagattaatcttgggcagggatcaacaaacttcaaccctctgtccagctacaagcttttgttaataacacttcattataacatggccatactcttttgtgtatgtactgctcttcatactataatagaatttggcagttttaacagaggtagtatggtctacaaagccaaaaatacatagtatttaaccttttacagaaaatgtttgctgacccttgatctagggtttgctattttcaagtaataccacctcatatgtaaagttaagaccacagcataacatatttcctgtccagactcctatcctttgtactattgtagttgcatatctgacttccacatttattataaaccctgttattcatcattactgtttgtaagcactaaattatcttttaatgaaatttaaaaacatgaacaaatattttatatgtacttaacatgtttagcattttaagcactcatttcgtcatgtaaatatgagtttcaaaatggtaaacttcccttaaggtgaaaaacttatatttttatagtatacacataaaagtgatgaattctcccagcttttgtcttgaatattacgttatttttatatttaaaatatatttttgctggacatagaatttcaggttgccagctttttttttatctttccttttcatcatgtctgttaggttgtttcattgtcatttggcttgcattatttctgctgagaagttgtaaccctctgaatacctttaagattttctctttagcatcgtctttcagcaaataattataatgtgccttattgtattttcccttgtatatctcctgcctggaattcaataaacttctcacatatctgagtttatatatttcaaccattatttcttcaaacatattttattctgacccaatctctgtcatctctgcttgtagtactccacttgcatgattgttagggcagttatcaatgtctcacaacttactggaataactgtttattttttaagccttgtttttcctctctgagcttaatttagatgccttatatggccctacattctagtacaatgatgttttcttctgtgtctcatctgctgttaagcccatccattaaattttctatttcagatgtaattcttactcctaaaatttccattttgttctcgtttgttgcttttctccttcaacattttgcatttttaaaaaatgtttatatgttttattttagataatagaattaataattactgtttttaaagtcctggtctgctaatttcatcatttctgttattttggggatacatttccattgatttttttctctctggttctaagacatattttcctgcttgtccaaatgtctagtatatttttcagttgatatacttgacattatggatgcaatgttgttcagtttctaaatgtttatgactttccttaatggagtgtcaagttttgttccatcaaaaaattaatttttggtcagatttatctttttcagtaacctttgctcaggtgtgtccagactagccctcatattaggactaaaatatccctacatataatgcatgacttttatgggatgtctactgaatgcctggagggattcaacaaggtctctcaattttgtctagtctgaaatcaaatttttcccagctctgtgcaacctctggttattgttgacttcagaactccctttacctggtcttgtgcagtcttgatctaaaagtgcacagcatggtgtttcttctgagtccagattgcagagacacattcatgactcccttgtagatttctaaagcactttacacagctgtgccctctctgggactctgtcctgttaattccagcttctttagtagctttgaattgtaatatgtttccgtttcaatgacactactgcactgctgaactctgtttgggatcatcttccatatgccatgatccagaaagtgaagctagcagaaagccaggaagttggcagggctcaccttatttgtttatcttattttatggatcacgtactgcactgcccattgtccagtccctaaaacagtgattttttaaaattttattttattttattttttgagatggagtcccactctgtcactcaaactggagtgcaatggcaccatcttggctcactgcaacctctgcctcccaggttcaagcaattctcctgcctcagccttcccagtagctgggattacaggcacctgccaccacgcctggctaatttttgtatttttagaggaaatggggtttcagcatgttggccaggctgatctccaactactgacctcaggtgatccacctgccttggtctcccaaagtgctgggattacaggcgtgagccactgagcccagtcagttattttatatattttttagttttgtaattttaaaaaaagctattctatcatagttttaagcaaaaataggccatgtaaccattattatttgaatatctgtgatgatttatgaaatgattattatgaacgtcctcatagaataaattattttgccagcctttaaattccttatttaaaaaatagtacacacgttttgatatactgtacattggataatctattgaatatttttatatcattctctttagtagctgaactcactgtaaaaattatagtgcctcttagcactaacattatgccatattttctgtaacttattttgtgtacaaccctagttattttaaatattactgtaaattaagaatattgatctatatgagtgccatttttctaacaaatgtttttacattcttactatttgctgagcaattcttatattttgccaaaagagatttaactttgtttagtatctaatttttctagaaatatgacttacaagaggtattgactgtatatcttctaagtgttaaataaacattcttcctgatttcctatatacttccctgtacctctcagtggtacaggaaattaatgtaagattaggttcattttaagaattgcaaatatttttctactttacttcacaagaaaaatatattttagaattgtgtataattgcttgtttttaatttataatttattaaatgataaagtttacatgacagaaaaaattggatagttacatacatttttctcatgattttagctgaagagtttatggtaaattggtcaaccctcagccaattagactttgacatgtactaataagatctaattgaggaattatgaagacatttgctcaggagaaaatgagcacataattacaccataaagaggttaaagaatcaatgttaccagctggaagaatattagttgaagtcccaatggcatctataaaggatatttcataatatatctgtgaaatagagcactgccaagaccaattaagatatgtagaatattccattgtcagttgtacaagttcaaatttaaatattcattttcccatcttacctctgcccatcttcaggtgctgggggatggtctccatcagacagcgaccattatcaatggcttcaggttgactttggcaatcggaagcagatcagtgccattgcaacccaaggaaggtatagcagctcagattgggtgacccaataccggatgctctacagcgacacagggagaaactggaaaccctatcatcaagatgggaatatctgggtaagtcattggcaggaaagcaaagacacagaattggattggaaatattagaaaatggtacaggatttactaagcatatatagttatcaatatttatgtattcaaatcattgggaaactatttattcatcattgttgatggaagaaagtttcttcaggctgtaatttctatccaatggttaaagcaatgattctagatctggactatgaatttgaatcacctgaggaagttttaaagcacgtagatgaaaggcaaacccggatcaataagaccagaatcacgtaagttgaaatagtgattaatgatactgataacttttctgaagacagcgatcttcaattgaaggaaaatattgaaattatgaagaatataatttagagaagtaagagcagtgatagatgttaagaaaagaacttgtccattttataatagtgtcttaaacacttattacagatctatgttcactttattcctttattatgaaagaagagaataaagcttaacccatttgttcttaaaatgtctctattaacttaaaaagttgtatatattcaatcaaatattcaccacataataatttgaataaattatttaacagtaaaatttaagtgttctactttgtttaattattttaaaaagcaggcatgaccaaaatcaagtgctgtcatcaatattaaaccagaagaagaagaagaaaaagaagatgaggaggaggaaagggagaggatgaaagggaagggggaaaagaaggaagaggaaagggttcacttttaaaatcatgtccttcacagtattagttggagtgctggatatttttaactttatcatgaatcactcttgtagactttgtattttaaaagtccccaattattttttctaagtaacaagagtttataatttctagctaaagtggatgttcatttctacagcagtatgtgaaataaggatataatgtcctgataataaaaaatgtgtctacttaagtagaactttagaaataactcctttcaagtcataattatatggaaagaatatttgtgtattaggatgtataagttacggaaagcaagtagtgggaaaaatgcctctttctaaaatgtcttcatctcgcaattgagataattcaaatcctcaggcataatttatagaaaagtgcttatcaagcctgaatacacagtagaattagctagagaactttaaaacatatagacccttgtgtcccaaccccagagacttgaatttagttggtctaaggtgcagcctgggctttgggattttaaagctccgatggtgatgctaatgtacagtgaacaccgaatacatagtttagattggttttcagtctacagttaagaaggggatagaggaagtatatgctgaaaatgaagaggagaacagaaaatttgaaagagttgcccttaaaatttggcagagagagagaggggaagacggaggagtaagggggttgggtggggggaaggggagggagaaatcaagtggccaaccaaccaaacagcagaccaaacaactgagagtaaacagtgaaggcttggatcacagacccttctaacacccagagcactcattattttctaactttctatggtttctaaactaagatcaaatgagcatgttggtaaaattgcttgaggggtttactttctgtgatttctaaactaagatcaaattagcatgttggtaaaattacttgaggggttacaagtcagactctgaaatactgttctctatatcagaacagaaatactgttcacatttttgtatttgtaaagtcttcatctcaaaattaagagtgttcaaatctcctctcctctcataatgtgccaagatagtaataaagatagctgctaaaatacttgaactttaatgtatctgtcaaatactgaacagttaaggacggctaaatgcagagacataaggaaaaaaggctaaggaggataaaattgttcagcttgtcttggagtcttttttttttttgagacggaattttgctcttgttgcccaggctggaatgcagtggtgtgatcttggctcactgcaacctccgcctcctggattcaagccattctcctgcctcagcctcccgagtagctgggattgcaggcatccaccaccatgcctggctaatttttttttgtatttttagtagagacagggtttcaccaggttggtcagtctgctcttgaattcctgacctcaggtgatctacttgccttggcctctcaaagtgctgggattccaggcgtgagccactgcacctggccttggactcttgatattacatagaataataatggttgagtcggggagacaaggatgtcatgtagtgaaaacatcacaaattatgaagatatgctgggtctacttatagggctctccatcttaaggtgataaaggtgcatttctattgtcttctccctttctggtgttcactttgtttcttcctttcaaatattgtgtttcttattaaaaatcagtatgctacgtgatgagtgattattagtagtgagctcattataaaattttaaaaatcaaaacaagttggagactatgttagtctgttcttgcactgctgttaagaaatacctgagactgggtaatttacgaagaaaagagttttgattgactcacgtttccacaggctgtataggaagcatggctttggaggcctcaagaaacttactatcatggcagaaggcaaaggggaggcaggcatgtcttacatgccgggagcaggaggaagaaagagacgggggtgtcacatacttttttattttttctgagacggagtctcgctctttcgcccaggctggagtgcagtgacgcgatctcggctcactgcaagctccgcctcccggtttcacgccattctcctgcctcagcctcccaagtagctgggaccacaggcgcccgccaccacgcccggctaattttttgtatttttagtagagacggggtttcaccgagttagccaggatggtctccatctcctgaccttgtgatctgcctgcctcggcctcccaaagtgctgggattacaggcacgagccaccacgcccggcctgtcccacactttttttttttttttttttttttttttttgagacggagtctcgctctgtcgcccaggccggactgcggactgcagtggcgcaatctcggctcactgcaagctccgcttcccaggttcacgccattctcctgcctcagcctccccagtagctgggactacaggcgcccgccaccgcgcccagctaattttttgtatttttagtagagacggggtttcaccttgttagccaggatggtctcgatctcctgacctcatgatccacccgcctcggcctcccaaagtgctgggattacaggcgtgagccaccgcgcccggccctgtcccacacttttaaacaaccagatctcctgggatttcactcactgtcaggagatcaacaagcgggaagtccacccccgtgatccaatcacctactatcaggcccctcttccaacactggggattacaatttgacatgagattttggtggggacacagacccaaaccatatcagagacacaatctaaatattgcaaaatatatttaagtaccagtaagcctgccacataatgattacattatttaataatctgtgacagaaatgttttaatccttactaatacaaaaaaaaaaaaaaaagagtccaatcctttgacgtattctaaaagagttaaagttcgttgacttctaaaaattcttgaatattttagggctacgtcttatcattcattaagtgattaaaatttagcatttacaaatttcaaaaaaaagtactcttggggattaagtttattaaaaatgatattaaatactagagttttttaatccactactgcttaacattatgtatactggacttgaagagaattctgatatagagaagattggatggctttttgatggaaaacaccttacaagatgtaaaaatttatgtatttttgaaattgtttttactatccattttataatgattgtttacctgagaaatatagaagataatgtatattgaatcacatgaatataattttaaacaaatgtccatggttatgtttttctgattgttggggaaatggacaacataagtaattttttatagtattcttattaaatgttcatatggacattccgagttattttatcactgttggataatatattaaaataagcaaagaacaagtcatatataagcaaattatgacagtttcacaaggttttagagtcatgaatcttgcattagggagtgagaatggctcctgaaaagattcctaaagaatggtttatctgaatatttaatattcaaagatctgagtttctaaatgggcttaactagtcaaaccttccattcctctttgatgatactgagcataatagaattctttatattttacaatataatttccttctatttagaacctcttttccaatgtaataggtaaataaaattgcccaaaaaatcattacatctacatactccaccaactctaatttgcatgattatcttgagatgttttcaagtttcctaagtataatctgttagagagagagagaggaagtattctgtataagcattttgtatcagaagtccattaaacattatattaaataagaattccagcaggcttttgctaagaggcctgttttgcttgggaaattcaattactggattttgaatgcagatattcggagccaaaataggaaactggagtaaaagcagtggatgccttctttacacaccactattattttgtaggataggaacatactacaaatttaccagtcatatgagcgcagtttttgtttttctttaaaaaacacttcctaatcatgaaaacatgcttgtatattctcagttatttttaaaaacagttttgatccattttgttaattttaagtaggtgttagactgaaatttgttaccactgcatctattaaatggagaattctacagaacacagctgttttatcatatttaaattatatggttagatacttatcaagaatatagggataaacaaattcatattatctaagaagtattaaatagattacttattttcaaaacctagatctccttgtcacatatacgcttttcccatgtacaaatgcatacacataattgtttcaataaatttaaaacatttcaaaaatctagaagacaaatacaatagttggcagtttcatttatgaaacatttggattttctgaatagcaaggcataagctggaccacgtattccctactttctttttaattacatattccatcaaccagtatttataaaataaaagttctcaaaaacatccttttgagttagcctgtaattagccatcaggcaagtgaaagccaagatatggagtcgaaaggtctgaattcatgtatcttgtttcatttgtttgttttataaacttggagatctgactttatttctctgttcctgaaatcctaatctgagaagtagatataattcctattgggatatttaagtgagattatgtaagtaaagaaatttttcaagctattaagattagaaacatgtgtgtcatcaattcccaattttagaagcattctccaaatctagtgtagtatgttttttcagtgacaatagtcagtaatgacaattttcagaatttttagtcaccctctatgtttttcagattccctttacctctttttactcttattcatgattgaaaatatctgacaatattttagattaaggaaatgttacttaaagttggaggtagaatgtatgcaaatctctgtcataattttcgattaacacatggtaaatacatgtttagatagtgcagtgcaggctgggtcagtgaggcatgacaggtagacctagctctgtgccaggtgccattgcagtgcttgtaacaaattatctgttaccatcatgatggccttgtgtccaatgagccatttaaggggacactgtttagaaatgaatggattgttctgtcctttcttttcagccatttgttatagtggttgcactaattttccaaatcacttaaaaatctgttcccagtataaatataaaatataaatgccattctgttacagttcaatggtgtacttagattctttcaaaatatctagaattttgtctgcatgcgaaagtcaggatgacaaccatcctgtcgcctgcccctacatcttccatcggataataacttctacttcacttaggacatgaatgtgattcttttccccaaaagatgagtattacccttgcttctttatgtaaacatctacattcctgctgccatcagttatttgggtaaaggatcaggcagacatattcataataattttatagatagcttattgagaaataaaacacatcagaataatctgcatcaaacaaacactttctaaaattatctttgatataaatggggtaaaaatcttcagaacttgtatagaaaaaaaaacaatttccaaggcgatttcagaataagctccttatttctgtgaaatagatttttctgtttatactcctcttaggctggataatatttttaaagtctcatgaattttaataagttgagtggatattccagatccttttgcatatactgtaatgcatctactagtgaattttgatcacctttctaaatacacatttgtatggtgagattctcattttcaaaggtcatgaggtttcttgggacaatttctgagactcaatattgtacataaatagaactgttctaacaaatatggttatgtgtttaatatttttctaaaatttggaagataaaaataagatgctgttgataatattgaatatattattggcatatattatgagataaaggaaaatgttataatctcataagatttcttacaggctgtaaaataacagtatatagttcttcacagtataatgtatttttcatctatgagataaaataggatatatgtaattattcttctaatgtttaaagtatccatgaaacaagatttgttatcaattatactaatattttcaggtgttttattttacattgaactcaatgctaattttttttacgttgaactcaatgctaattttttttacattgaactcaatgctaattttttttatcgtgtcaaggttggatttaggttacctgaggctaaataactccaagtaaatacatagttatataatgtgttgataaatgggtacctacaaataatttgaataagatatcagttccttcttttaagatgtatgtttctactctgctcaagtggtaacttagaggaatactagtatgcttattttgggaaatttagggcacagtaaatcatgcttcttatgtgcctggagacgcctgagaggccgtggaatgagtaattctatgttacactctggaatcagaccacctaggcagattatacaattttggtaacatagatctgtgtatcttcacgcagattctttaagctttctgtgcctaaagttcccaacctgtaaaatgggtctagtcacttacctgaatagtatttacctcaatggaggttgtaggtattaagagaaaaagtcaaacaaagggtttagagcaatgtctggaacatattaatcactcaattattttatacatttgtgatttctaggtgcattaacatagtatattggctcttttcttgaaaatttaaaatagcctgttacttccactttataataacgtttttctattagtgtattggtgtgtgtactgtattacatacatctgtgtttcccagcctggaatgacaaatgactcatttggaagtataattgagaatgctaatttatgccattcaaatcttgggcctacttattatcacatcgagtcctatgccttgtcatatgaattgtgcctggaaagttttttcagatatatattttttaatgaaacttcagtgaaaatatgactaggatgttttcattagacttagtttaataaattcacttgataaagtgcgttaacttcggaaagaaataacccatttttgtctacagtacttctctgtgtcttcttaggccaactgaaaagggtaggataagaagacttgaaaataggcttataagtattaactaaaacagtttatgctggttagccatgaaaggacaaatcagctgcaccaggaacatccaggagcttgtcagagatgtagaatctcagaggcttaacccagatctactgatcagaatctacagtttaggaagactcacaagtgattcatatatacctccaagatagagtgtgttgcttttgatatttgaagaactctcacgagaaagaggaataagcatcagcatttgtgtttccaaaccagaaggtagaattagaataactggaatttacagtgcaaattgcagacagatttatcgtgaaaaaagagtgagctttgataaataggcactcactgagcacctactacttattgaggctagggataaacagaccaaaacacaagcataattgctgtcttctaggggtcaataaactggtgataaggctaaacatatacaattataagtatattgtatgactgttcaaatagagaggtgcttgcctaggttgttttgggaacactaggaaagtggtcttattcagagtggttgggtccagcaaaggcttctttggagctacctactattggctaaataggtaaggagttggtcactcagagaagaggggcaggaagtcattccaagcagatgaatcttctgctgaaataggtaggaatggagagtgggattctataaataactgcgtttttcctgactttctgacatgcaacaaaataaaaagctgacctttatctatttatttagagacagaatctcgctctgttgcccaggcttgagtgcagtagagcgatttcagctcattgcaacctctgcctcccaagttcaagggattctcctgcttcagcctctcgagtagctgggataacaggcatgcaccaccatcccatgctaatgattgtatttttagtagagacgtagagacggggtttcgccatgttggccaggctggccttgaactcctggcctcaagtgatacacccacctaggcctcccaaagtgctgggattataggggtgagccactgcacccagcaaaaagctgactttttaaaataaaaaaaactctgaaattatatcctgtgaatcagtaatgcttaatttatataatgtaaatatctaattttggaagaaccttggagtttatgcagtcgcctagggcacatttttatctctgtgccattcatcatatagagctcactgcagagcacaaaacagatgtttatgagtttacaactgaactgaagtatctcattctgtagatgaataagctgaggctgagaaccatgatgtcccttaaactggaaccttgaatccaggtatactgacctcactactgaatatggagccaaatacttattttggttcagcaagaagttccattactataatgaacccctgctcattttgagtaattgaaaatactattgaatacatacacgatatttatagaacaagatagcatgggctctggaccggacctcaaatatctgaactctgctccaacactttctcgtggtgtgtatttaactatgttaatcaacctactatgggtcttagttgccttaggtgtaaaagcgatataattgtatttaccttatgcgatttttgtgagaaataaattaatcaaaaataaattgtttagaacaatgccccataaatatagtctcttcttatcgtcctcttgtttcactttctcctatttatcagtattattacgaatgctatcattaatgtttctcaaatactatattcaaagtgatataaagaatgcaagtaagtagttaatagtaggtctagccttgagaataatatattttaattggaaggacagcaaaaatcactacaataactttaaacaaaagcccgggtcatcttgcacagctttcaggatgcttatgcccctggacaccgtgaagatacccattctatgtgtttcacttatgcatactgttttccaggtagctaatttagtcagtgttgactttgggagagaactactagaatgttaaaatgtcttggcaaataaatttggtttgcttgagttaaatagcttaattataggctgcagtgaaatgatcattctggcaaaaagatatagtgctgacaggctgtctgaaaggttcattcaccatctatgccttttcagaagtctagagcaagagtagagaatagactttggcttctagaaaaaattctgtccatttccaaatgaaaataatgtttgagataagtatctgcatttctccgatgaacttcaccaatatattttgatgagacagtgaatgggcctattgtaattgcaatttaaatgctttataatgatattaatatgcagcttggaagatgtctgtgaaaactcctgtgatttagcagagaaattcagaaaacttcagctgcacaaattaataaataataacagccaaccaacacttattgggggttccttaagtgtttaatgtgctttatatcatttaatcttaaaaacaactaatatgtgaggatatagattattatttttatgattaagccctatttttggctgcagaaattgaggattagagaaagtacaactttccctggggtacacggtgggactgggtaatggatgtgttaactaacttattatggtaatcatttcacaatatatctctgtatgaaagcaaaaaaaaattgtaatggttgaataaatatcacatttcctgttttaaggaacatacccgcaaaataaaatacaaataaaaataaaaaaaactaaactaaactaatcaaacagtggagctaggataggaaaccaaagctacctaactaaccagcctgtgttccttgccactatggccctggtcagccattcctttcacaggcaatgtgaaacttagtgatctctgcatttaaactgtaatatagcgcttgtatataagatgttggtattttatttattttttatttttatttttttgaaacagagtctcgctctgtcacccaggctggagtgcagtttcccaatctctgctcactgcaacctccgcctcccaagttcaagcgattctcctgcttcagcctcctgagtagcttggattacaggcacctgccaccacacccggctaatttttgtatgtttaatagaggtcgggttttgccatattggctaggctggtctcgaactcctgacctctggtgattcactagcctcggcctcccagagtgctggaattacaggcatgagccacggcacctgggcttttttctaattttcaatacaaaaattgaggttcaggatcttacctaaggtcacagagcttaaaagttagaagatcttggtctttaatgctattgttggtgttgctgttttcaatttttaaagaaagtactatttacctactgtattagtttgctagggctgccatcataaagtaccataaactgggtggctcaaacaacagaaatttactctctcacagttctggaggccagaagtccaatattgaggggttggcagggttgactcctcctctgagggaggtgagggaacagcctgctccaggactctctccttggctcgcaggtggttatcttctccctgtgttgctttatatcatctttcttctgtgtgtgtgtgtgtgtgtgtgtgtgtgtgtgtgtgtgtgtgtgtgtgtgttttgatggtattgctctgtcacccaggctagagtgcagtgatgtgatcatagcttactgcaaggtccaactcctgaacccatggatcctctgtctcagccttctgagtagctgggactacaggtgcatgtcaccatgcccagataattttaatttatttattttttgtagtgatgggtctcactttgttgtccaggtgggtcttgaactcctgagctcaagcagtcctcccacctcggcctcccaaagtgttaggattgtaggcatgagtcactgtggctggccttgtttttcattttatatggcattcattttacaaaaaatttatttgtttagaatccactttactctggtatgacctcatattaactatacatgtaaagaccctgtttccaaatatggtaacattctgagacattgggggttggaacatgaacatatgaattttggggggacaaaattaaattcataacaactagtaggcaagtactttataaagttatgacattaaaagttatttgctattgctagggtgttgataggggtgtgtctggtaagtaagaataaggatgatcttgtaagaaagacaatatcttctaggaagagttgtgcatcaaccttcattaactcagaaaatatgcttgaatcaaacgactacttatatatgactctctgcaatcatttatttacattcaaaactccaaggaaacattttcagaattattctatcctagatagcaaatgaaccaaagacactttaagaatcaatctcccaccccgtccccaaagaaatgtttggccttaaaaatcatgtcctactttcaaactccatacagtagtttattctgcactaggcaccatttaacactatcaacatcatgtaattctttgagatatagtaattatttattaaaaactggattccagcaaacatgcattctaaacaatgatggataatttttctatcagcaaagaaaagagctcgcccagagccaaaacagctttccccaattaaaagttgaggttgaattgctaatttcatttggattatactagtatctgcttgaaaatggcaggtttcattagttctcccagtattcttcagagaaggttaagaaacacattccctccacttcagatatgaaaactgagttgcccagggtgaagtcgttgtttatcttatgcacttagcaagcacaattgttcattctatacgcacagtgactgtctcgtttgtgtatttttcagctttgttacagtatacaaattggaaaacagagctgtgtatgacagcctagagcaagagaaaaagactgtgaatttatcataaagtcattcaggctctttacattcagcctggaacaaacaagtatttgataaaagaaaccagaccaatacaaaagaaacgtccagtccctttggaaagattttgtgattatgacatagcaggaatatccaatgagtttttcacatgatatgttaaataaaaaggtatgattacatatctttaatatgacagcattttcttgaaatattaatagaagtattgcactttagctttacttaatgtaagcaggaatgccaatgatgttggtttcaaattttaaaatcaaaaccaaaatatgattattcaggtatattttatgttaggatttgggataactgattgtgaaataagacacaggcacatgtacacacacactctctcaactcttactacacactaactattaatctccccccaaataatatcaaacctatggatatttaatggaatttaacctatttcttagcttattcaattgaagtgcagagatgtttggcatttttactaaaatcaaatatcattgccaatagtaatcaccatgcactgagtacttacctggtaagcactttttgtgtcaattactgtaacaagatcctgagaggtaagagaccaggctttttccttggctttatgtcccactagtctttgctttctctattataccatatttaagaagatatcatagtttttgattataggtgagttgtctgaggggtttattttgtcctgttaaatgctgggtctcatcagctaggaaagtgccttgactattgaatgtatttagtaagtacttgttaacagatccaccaaattgtggaatttagtgaacattggaatatgcagctataattaggtttacaatttataaacaataatgtttattatcttaatttatacttaataatattgagaaatactgcatgtacctacatctattagaagtcaaactgtccaaaatggcatgtgtgggaacacatgaaaagcctaggatttctataggagagaaaacaacagagtttgcagcaacagggagatgagaaggaggctgggaatactgactgtagcagcaaagcttatcctcccttcagacctggaggcagcttgatgctgctgagtgtaatggcaaggaactggtgccaaaggcatggatgtgtggcaatctccaatccaagctggaccagggtccatgtggttagtaatctagatggtggtttcctctgttgaagggtcatggctagaagaggatacaaagaaattttagaagtgttgataattctttgtttcttgacttaagtgcttcttacacttgtgcaaatgcatcaagctgtatgtttatgtgtgcttttttcctatgtgtattaaaattcagtgacaagttgtaaaaacaaattaatcagacttggaatcaaggtacacctctgatggaagaggaatgaaagaaaccaggaactgttattggaatagctctctagtaccaaagataattgtgggagaaaaccagtgggccaggtgaaatggtaaccagagagcttagcaaagggtctttaagagcctacttgcaacatatagggacattatgttactctttatgtaaattcagcatgatataagtacacgggatctactcacacttagtacatagatacttagtatagcacatagtattatttgctgatgaagagggtatttctaaagaaatatgtttggatgtcattgcctctggtttgaaaagaaatgaatgtatatgaaacaggcatcattgtgtgcagttggcatgcacagggaatgacaggtaaaccaagctgtggctactcctacttgcttttgattttgtgtttgttagtattatttttgttgttgttgttctatttgcaggatgaatgcctaaatttattaatcttatttttgtattataattgccatctatgtataattgatgctaacagagaaaatttccatgtctataatatctaccaattaaaattgagaaaatatagaaacaggcaaaaacatgaaaaggaaactcaaacaaaatatataaaattgtgtttacatgcatacaaatgtaaaatgaaaagagaaatacaaattaatcctctatggggatactatatctcaccaatcaggttggcaaagaccgaaaaggttgtttatacactcttttgggaagaatctggggaaacagcattctcatatactcctgatgagcatgtccaatagaacaatagctatagagggggattggcaatacccagcagaactaaaaatgcatttattcttcaacccaactatctcaatactaggaatttagtctaattatacagctccaataacataaaaagtcatacgcacaaagttatttcttgccattgtatttgtaattacaaaatattggaaactatctttatgatcaaatatagattggttgaataaactaggctacatatttgaaatagatacacagcagctgtgaagaaaaccgataaaatataagttgacatggggtggatttgctggatatattgtttagtgaaaaaaagaaaagtacaaagagcgtttattgtatgttaacttttgtttaagaaagaagaaatgaggaaacgtatatatggttgaagcatttctgaacatatttaaatgtactgtaaattgagcaaatgagtgatatgtcaattgtgttgggggccaaggttctcaccatgaaggaaataagaaacatacgtggaatgagagaagacaagaatgaagcctacttaaaaatatatgtgtgtgttaatgagtatatatatatatatatatatatatatatatatatatatatatatacacacttacatactacatgctaagtagctctgacagctggatggatctagaaacaaaaatattgcagtaacactaagcacacctaagatagactttaattattaatacaattatcatctaaaagaaatcagatctagttagaaaaattttaccaggttgtggtcgagaaagaaacttgttaaattaaacacaccttgttataccagaaagaaaggaaaaatgatggttaatacaaaattacataagagccaacttgaaataattcatattggtcaaacctggacaatttgaacaccaaaatagttaaggacagtaatgcattgcacacctttagagaaaaatagaaatgcttaagtctatagagatgataggtaggtaggtagacagacagatagatagatgatagatatagatagatagatagatagatagatagatagatagatacatacatacatacatacatacatacatacatacatacatacataggcaggcaatagatagataaaatgaggcagaagagaggcctcttgcttatagtagaatacgaacttctgactaggaaacgtggaagggtgctggaggtgggaactcaagtcatcatttgcaaccatcatagtaaatactagttctggcataagacattaatggtaataaaagtagaggatacggagagttttgatggggagaagtaaatttgtatagtcttaaagtgtctcttacaaatcacttattagttgcaagggaaatgaataatatttacacaagagaaattaaacatcttgagtgggtaatcaaaataaaaattacagatgagaagcagacactgtgcgcctccagaggcagtggactgagaaggacccaacaccgtgcatgtagtgtcccatgaagaatgtaagtggatgtaaacattatgagaaaacaaaagtcaaaccaaaattgaagaatattctatgaggaatgttctactaaaaagataaaggagaatacattgtctatgtatcagtgtgataagagacactaaaaggctaaggagttattctaggtaaaagaaaattaaagggacatgatacctacctgtaatacgtgatcctagcctggatcctgtcttggataagaaaagatgccctaaagacataattgggtcaatggataatattgggatatggaaggtttattcgatgtagcaatgttaaatttcctgaaattgataactatatacttacctacatatgtccttatttgtatgaaatgtacactatttggaagtaagtgaacatgatatgcaacttattctcacatggttcagaaaaaataatgtgtgtgttggggtggtggaaaaaggagagagaaggagagggagagagagagagagagagaatgataaaccacatagcacagagtaaaatagaagaataagaataaagagtaaaaggacaagtgttccttatactattattgcagcttttccataattttgaaattatttcaaaagaaaagttaaacagatttaatatttccctgaaaatccagcattagaaacacattaccacagcttgtattcgtttgtttgttttaacagggtattctttcaaaaccagattgccttatgtgagtatataaataaacatactaatcttaaaccactaattgaaatctgtattagtatatttaattggatctttccattaactagctaataagtggtgttctccagaaaatagagatttgacttgataaggcagaggaaaaagaagttagaccaagagaacgactgagaaacaatgggaggggcaatgagggacgagagagcctccatcccgtgtgggtgtctgaattgacaggagcacgtggaatataagaaaaaagacacaccaatctatcaatagacagtgttatctaggactattcctgatgtaagtgatgagtagtcagctgctgttttgtgtttggttctatatcatatgttcaaagatactaccaaagatgtacacatagaacactaaactgtggaatcatatttgtttcacaggatttgtaaggtgaagggggtgataagaatttcctgaaagtcaataaaactgtgaatatgctttcaggcatggagaactcaaaagcaccaacaagtcacacttatcagaataagtttgaaagtggaaagaaagaagacgtgacattagcttaggacaattggatatttcaaaacatatgtaggaaaaggtgctaagggccttgacagaaggaaataaatcacaattagatcttgttctggaaaaatctgctaagatctacggtggcaactcaagtctgaggaggacatgaaggttttctcttgccagaggagtacttagtgttccttggagagagttgtcaggcaaatatgatatacagattctctgcactcatttgttctgtgaagatatcaaaaagaacctgcctaaatgagaaagagatttttatctagtggaatgggcttgcactaaatgttgtctagtttccctgccaacactgacattcttgcattcatcctaaggtaaactgttttaaaaagtttgcaccaggcttcgtggctcatgcctgtaatcccagtactttgggaggccaaggcgagaggatcacttgagcccaggagtttgagaccagtctaggcaacatggcaaaaccgtgtttctacaaataatgcaaaaattagccagacatggtggcatatgcctgtagttccagctcctcatgaggctgagatgggaggatcacctgagtccaggaggtcgaggctgcagtcagccatgatcacaccattgcactccagcctggggcaacagagtgagatcctgtctcaaaaaattaatcaattaatgaactataaaatttagctaccccatatgtaatatcagttgctgaaaggtagtcatatttataaatcacatttcatttttttgcatttttattataatgtaagcttattatttaatattcttctcctttagatataatttgtcctacatcatttatttgaagtaatgttgtacatgtcagcataaatgcctttctttcatccttaatacattcagaataccagggagaatctggcattggagaaatgataatgtaagggttttacatgacacatcaggaaattcccaaactttcataagaaaggcccaagtgctgacactatatgttgactcaggtcctataaatgaaatcttaataaagcaattgagattgagaataaaggtaaaattttgaggcaatataggcaataacattagaatttcagggttacttcagcagagattagaaaatgtgtttcaatttcctcaacagagaacaagtcaaatcttaaaagaagagcagagtcaacttttattttaaagagcatcactaaactgattaatggcacttaaatgtgtctgttgacagaacaccagtaacagtattatgcattagcccctatagttattgaaggagctgcatattttttaaaattccagctattaaagtcaaattataatccttgttgggtgcagtggctcacacctgtagtcccagcactttgggaggccaaggcggttggatcacctgaggccgggagttcaagaccagcctgatcaacctggagaaaccctgtctctcctaaaaatacaaaattagccaggctgtggtggtgcatgcctgtaatcccagctacttgggaggctgagcctggagaatcgcttgaacgcaggaggcagaagttgcagtgggccaagatcgcacaccgttgcactccagcctgggaaagaggagtgaaattccgtctcaaaaaaaaaaaatatatataatcctaactctgagtctgagacctaccctgactctaagcttaattccacctccaacccaactcaattgaaaacaaaaatacaggaaccacaaatcataagtgattgaagaagagaaaaatattgcacgtggtatctcagtgagtaaatagaaggaaagagaaccaaagatagagtaaaaggaaatgtctaaattcagctgccgggctaggaaaatatgaaagagaaaaatttaaagaaaaccaatgtggtcagcagtaagaggaaacctagagtgggggaggaagaggatcaattgctttaagaacaagagacttgagattacctttagaggtgggttcagctcaaaatgtgaaacaagattttaaatagagtggtaaaaacagaatgacataaatacaaaaatgtggtaagacttttatttaacaaatatttatcaagtttatttttattgttcagatgttacaatgagtaatggatatatatagactccaccatcatgaccctcatggagattagagctagatagaatataaaggtgtgattatgcagtatgtttttaaaaagtggttgagggtggtgagacagagggagagaactaaggcagtggtagacaagaagcttgcacaccagggaggttgctttcttttttatcttttataggccaggcaaaagtggaacatgtctgtaggtaagaggaacagtgaatgcaaagtctctgagggtggcagggtgtgtggcctggagctgagaggacaaaggcatttccattgacagagatcctgctatgtggcaggcagtgtgccaaataccatttggttttatgaaagttctagaacagcccctgcagttcaataagtacacaaactagatagggacatatttatctgaaagaaaaatggatcatattgatctactcatccctatgaagactgaaaagaggatagtctattgtggaaaaattattttaaaaattaatgttagtttaaaatgtattgtcttaacctaaagaaagcatctacattcatttaaagtatttatcaaatgattgaaaaaaaatttcttggaacagaaaaaaaaaacgcattattgacattctggttttatgggtccaagctgttaaaatatgtataccagggtcttaaggatagaatgagccctagaataataataacctcctttggattaagataattaataaccatgatgtctatttgtttgtctgcttttgtaccccttcttcctactggatgccagctctcatatttatcactgatagaacacaaatggtaaaattataggctagaatttttttcttgttgtttgcttcttttcacattatatggatttccgttttaatttattttcttttttctttgtttgtttggttttttgttttttgagaccaagcctcatcctatttcccaggctggagtgcagtggtgtgatctcgtttcactgcaacctccgcctcccgggttcaagcgattctcctgcctcagcctcctgagtggctgagattacaggctcatgcccagctaatttttgtatttttagtagagacagagtttcaccatgttgtccaggctggtcttgaattcctgacctcaggagatccacctgcctcggcctcccaaagtgctgggactataggcatgagtgtttttccttaccctttcattttcttgaacacattttaaaatttttaaaaatttacaattacaatgaactgatgtttaggtgctcaacaattttgtacagttgtcttatttaataaaatcgatagaaaacttttagtgaagaataaagtattatactaatgcatcataatttctattaatctgacacttagagattgtgaatccaattcacaatccaagtgtacattgctgacacttggagattgtgaatccatctcttagcagggggtaaccataaaattcccctcctaatttaaaaactatcattataaaaaatcagcattcagtgagataggtctacaaacataaactgcttctcagtatcctacaggcctgattttcttcatcagccttgtcagggttgtgttacatcgcttcatctgactacatgaatggctaaagaaaaaataattatatgtaatttgctggattttggagccatggcgccttataaatatttaaaagatatcgtatttagcaatctgaacagagatgtatactgataatgcttgagaccttggcaactcaattaacctctgggcattggatttggaatggagggattattattcattggcaattgtataaccactgtaattaaaaagcacttgccaaccttttaattattaatcctgtggttcatcctcttgtataaaggctaacatgcccattttaccagttagtggattggggaaaatgaagggaaaatgatagatgcaggcgcggtcgatggcaatgttaagactttagaatgcaggactttttccacctgccagttcgttattcattctgattagaatcatttattctatcttaattaattctgtattttgagggttaaagtacttagcgtttgatatattgaattaattctttacttaaatctcatgttgcattccaaatacgttcaattttgtaacataaaaagagctgtagcatttggacctttcttaatgacaacaaaaacgaaaaaagtgtagttttggcaacttttggatcataacatgctatttcctgaataaatagtgataaatcacttcttacacttccttgttaaaaaaagaaaaagaaagagactcaaatgtccatcctatgacatctgggcacaaaaaaacaaaaaacaaacaaaaaaaacgctaatgacactcaatgcaaaatattcagcctccttctgaatgagaactaatctttatgcatactatttgaatgtgtaccctgggggaaaggcataatgttacttggctgtctatcaaagatatcacagacaactctcaaaggttagagcagatgcttttaatcagatgctgttttcattttttatctgagttttcttaaactaaacttggctaggaattcaaaattctgtgaaacatacatatgcactcatatttttgcacttgtgtgcagccagacacataaacatcgccctgtctgtatggttctttatggtacagtgttatagcagccactccagggtgtaatgtggtcattctggttcccccagttattaaaagtgttttgaacagattcagtaataaaccagtgttatagtcacttttgtgcttgagtcaaccttcatgcatatagatttccacttaatggcaattgtattggatttatatgttcttacagtgacctcagatacagaaataatgagtgatcttattaatttgggacctgtctaatgtgggttttgaaaaataatgatttgataacttaaaaactcctttagatcagtaattatgtcaaagtatagaatgaagagtgaacctgtatttaaagaagtgacaaaaaatttttcatatttaagtctttaaatgtatctcccaatagtaggcatttatgactgtactgaaaagtttaatgttttctcaaagaagtaaatagcataagaaaatagttttaaaaaggagctttattatagtattaactaattgtttgtttataagccttatctgcttcaacataatcatgctaccaagaactttattcaattgagatgaagagttatcaatagctgataattatccaagataagaggtatgtctttcatatgactctatgctttaattataacattagtcaaatgtccacatggtatttccacagttaacttgtaaaatgagaatagccttgattcaaaataactaattaaatacagaatgtgattcaataaaagtcactgattgggtaattaagagaagaattagaagacttgaatgaaaatatataatacttgtaatcctaattagtactatgctatttgcttccccttccattactagacatttaccaaccaagtatttaaccttgaaagaatcaaagaagcttttctgagctcatactagttcccaaatagaagctaggctatttaagatttctaaagattgaagataaaatacttgctagcatgtccttgaaatggaattatggacaaaaagtgttagttgctattatataatgaaaacacaaatataaggagtaaatccaccttaagcaaaatgtctaaatgcttagctgtatttatcaagtgcttttcaatattttttcttcctccttttctgccctctttgctattgatagaggttgttgttaaaggtatagttgttttcttcttcagttttatttttagaattaaaatgctctaagtaaccttttttggtggccattatttgacattttaaaatatgtacctttctatatgtataatatcattcagtgttttattcttctctttaataatgtagagcattagcatatttaccaagacataaaaattacaaaagaataaaattagagatctatatttataatgaatatagacacaaaaattaattagaaaagtaaatccaataatttttatataaagacaataccttatgaataagtggtatttatcccaggaaagtaagtttggttcaatattttaaaaaatcagtaatgcaaatcatcatgattatggcaacagatataaaaaaatcatttgactaaatctgacattcataaaatgacaaagtgttcttaacaaaaatggactggaaggcaactacctcaaattcataatggtcaactataaaaactcacagctgatggatgcagcacttaatgttaaacaatagaatattattgatttttgaatgagaaaaagatatgtttttacattttatttaatattacattggagattctagccaatgcagtaagaaaagaataaacagaagcataaagattggaatagaagaagtaggcctgtctgtgttcatagatgacataataatttatttaggaaatcctaatcaatcttaaaaacaaaactactgaaagtagtcaggctgggcgcggtggctcaagcctgtaatctcagtgctttgggaggctgaagtgggaagatcacttgagaccagccttggcaacataataagacctttcctctaccaaacaaagcaaaacaaaacaaaacagaacctgcagggtggcaggctcctgtggtcccagctcaagtggtcccagctcaagaggctgaggtaggaagctcatttgctcccaggagttcaaggttgcagtgaggtatgatcttaccaccacactccagtctgagtgacagagtctatctaaaaaaaaaaaaaaaaaaaaaagtataaatttaacaaggcaacaggttataagattaatacaaaaaattctatatgctagcatcaaatattcggaaaatgtaatttgtaaaaggaataccatttaaaataggaccaaagacttgaaatactaacagttaattataataaaaattatactgacattctttactgtaattaaaaatactctgtaagaaactaaataatagctaacacaatggagagatacataaggcttattaattgtaaaatatgttaacttgttcactatcttcaaattgagtaggtttttaaatttacaaggtgattcaaagtttacttgtactgcaaaaggcctaaaataatccaaactgggtttgaaaaaaattggaggaaatacaagaatttcaaaaattactataaacttataataaagatagtcttgtatagctgtaaatataaatatatagatgaagagtccaaaattgagtccacaaatagactcacatatatatggagaattaaattttaataaagccaccaatatgattaaatgcagaagagaatagtcttttcaacaaatggtgttagaaaatgatatccatatggagaaaatgaacactgctgcttcacattctacacaaaaatggatcatgtacctaaatgtaggcaccactagttttaaacctctagaagaatataaaggagaaaatattcagccttgggataatcagccatttattaggacaaaaaagtattagccataaaaatgataaaagcataacacagagaaatcaaaatcttctattcttcaaatgacacactaagaaaatgaaaatcaaaccacatgctgggaaaattcattcacaatacacaaatacagtaaaagccttgtatacagaaacacaatgacccgttttccttgaaaaggaatccttgtactagtcatactattgtctttgcgtctgcttctcagaagatctaaatgaatacattcttcttctatttcttatcacatatattattctcagaagatccacccatttctgttattattcagaggtgccatccaaacataataacaaaatgttttacctactgaattcagtgctatttgctgtatcattccaatgttccccccgacagtttctcatctgcctgttttactttttgaaacattgggatccaggcttcaggttgatgtatctaaagtacatatacacatgcacggaaagtccaagataaaagaaatattatcaataggaaatgaaaattccaaacctttaatattaggtaattccatataagcctttataataaaatatttatctcattgttttccaaaataatttttatttacattattttttacatttcagtacatggtaaagtttagaagatttgatatttgagaaagggtaaacagtctttagctcctgcatattaataatttatttaaccactgacactaaatatgatgtgccaaataagaaaacaattagcaataatattaacattcccactgttttctcatggttaaaaataaaaagttgtgctttatttctaatttgtgatggaaaggtatgtccatgacttcacatatgattgtacctgcataacacatttggctggcacggcaagtgggagctgaaatcctttttttcaccatgtttcactatgtcaaatttaacttttgacaatttaattggaagaaatccatgtactttcttaaatatgtcttgaatattcagggaacattatttgtaatagagcagagttggaaacatttgtctatcagtacaatatttctgcaatcaattacagtatactcacatgatggaaaacaatgtacctgataaaagtaaacaagatagatgtataatataccacggtagaaacataacttcgatagggtctttcttctaaaacattgtaatatcatatatattacatatcattttataaacatagattatttttatatgtagatgcatataacaacctagaaggatatatggaaatctcttttttaatcttttactttaggtttggtgggtacatgtggaggcttgttacataggtaaacacgtgtcacaggggtttgctgtaaatatttgatttcatcacccaggtattaaacccagtgcccaatagttatcttttctattcttctccctcttccaaacttctgtcctcgagaagaacccagtgtctgttgtttccttccttgtgttcataagttcttatcattaggctcccatttctaagtaggaacatgtggtatttggttttctgttcttgtgttagtttgctaaggatgatgacctccacctagtccatgttcctgcaaaagacatgatcttgttctttttcaatggctgcattatatttcatggtgtatatttagcacattttctttatccaatttgtcattgatgggaatttaggttgatttcatatctttgctatcatgaatagtgctacaatgaacatcacgtgcatgtgtctttatggtagaatgatttatatacctctgggtatatacctggtaatgggattgctgggtcgaatggcagttctgttttttagctctttgaggaatcatcatgctgctttccacaatggttgaactagtttacacccaccaacagtgtataagtgtttccttttcttcacaacctcatcagcatctgttattttatttactttttcattgtagccattctgactggcgtgaggtggtatctcattgtggttttgatttgcagttctctaatgatcagtgatagtgacttttttttttcatatgctcgttggctgcatgaatgtcttcatttgaggagtgtctgttcatgtcctttgcccactttttaatggagtcgtttgtttttctctcataaattttaagtttcttatagatactgggtattagaccttcatcagatgcatagtttgcaaatattttctcccattctgtaggttgtctgtttactctgttgatagtttcttttgctgcagaaacgctcttaagtttaattagatcccacttgtcaattttttcttttcttgcaattgcttttagtgtctttgttgtgaaatatatgcccattcctatatccaagatggcattgcctaggttgttgtttaggtgtttatagttttggattttacatttaagtctttaatccatcttgagttgatttttgtgtatggtgtaaggaaggggtccagcttcaatcttttccatatggctagccagttatcccagcaccatttattgaagagggagccttcctcattgcttgttttgtcatctttgtgaaagatcagatggtcgtagatgtgtgggcttacttctgatatctctattctgttccattggtctatgtgcctgtttgtgtaccattaccatgctgttttcattcctttagccttgtagtatagtttaaagttgggcaacgtgaggcctccagccttattctttttgtttaggattgccttggctatgcgggctcattttggttccgtatgaattttaaaatacttttttctggttctgtgaataataatcttggtaatttgacagcatagcattgaatttgtaaattgctttgggctgtatagccatattaatgatattgattcttcctatccatgagcatgggaggttttttaatttgtttgtgtcttctctgatttccttgagcagtgttttgtaattctcattgtagagatctttcaccatcctggttagctgtattcctcagtattttcttctttttgtggcaattgtgagtgggattgcccttctgatttgcctgtctgcttagctgttgttggtacccagaaatgctaataatttttgtgcattgattatgtatcttacaactttgctgaagttgtttatctgctggaagtgcttttggtctgagactatgtgcttttctagatatagaatcatgtcacctgcaaacagagatagtttgacttcttgtcttcctatttggatgtgctttatttctttctcttgcctgattgctctggctaggacttccaatcctatgtggaatacaaatattgagagagggcatccttgtcttgtgtcagttttcaaggggaatgcttccagcttttgcccattcagtataatgttggctgtggttttgtcatagatagctcttattattttgaggtatgttccttcaatacctagtttattgagagtttttaacatgaagtggtgttaaattttattgaaagccttttatgcaataatttagataatcatgtgttttgttttttgtctttaattttgtttatgtgatgaatcacatgtattgacttatctatgttgaaataaccttgcatcccgggcatgaaacctacttgatcatggtagattcgctttttgatgtgctgctggtctcagttttgtattagtcaggattctctagagggacagaactgaataggatgtatgtatatttgaaagggagtttattaaggataattgactcacatgatcacaaggtgaagtcccatgataggccatctgcaagtagaggagcaaggaagccagtagtggctcagtccaagtcccaaaaactcagaagtagggaagccaacagtgcagtcttcagtctgtggccaaaggtccaagagccccttgcaaaccactggtataagtccaagagtcccaaaaccaaagaacttggggtctgatgttcaagggtaggaagcatccgtcatgggagaaagatgaaggccagaagactcagcaagtcagcttcttccaccgtcttctgcctgctttttctagttgcactgtcagccaattggatggttcccacccacaatgtgggtacgtcttcctctcccagtccactgactcgaatattaatctcttctggtaacactcagaaacacccagaaacaatacttcgcatccttcaatgatcaagttgacacttcatgttaagtttatcacaaatttgcaagtatttttgctgaggatttttgcatcatagttcatcaatgatattggcctgaagttttcttttttgtgtgtgtttctgccaggttttggtatcaagatgctggcctcatagaatgagttggggaggagttctccctcctcaatattttggaatagtttctgtggaatggtaccggctcttctttgtacacctggtggaattcggctgtgaatctaccaggtcctgggctttttttttttggttggcaggctatttattactgattcaattttggagctcattattggtctgtttggggaatcattattcctggctcagtcttgggaggctgtatgtgttcagcaatgtatccatctcttctaggttttctagtttgtgttcacggaagtgatcccagtagtttctgatggttgtttttatttctgtgagatcagtagtaacattccctttgtcatttctcatcatatttatttggttgttctctctttccattagtctagctagtagcaaacattatgaaaatgaatttagacaagatactaactttcaatgtgaatacttctatatattcaaagttttaaacaaatatgagtttacttataatcaaatatatgttttgtaaattgctgtgtggaaatcagaggctgctcatttctcattcaaactaacttaaagatactatgttaaatgttctacaatcataactttaaagttgttttctctaagagtttgaaaaagaaccagtatttttgaggttgtgtcaatagagtcatgattaataacaagcataataaaaatttttattaaaaataagcaattaaatattcttcttttactatattaatgctcctgagaattataactttctaaacaatttaaatgaaacatgagcttttaagcttatagtaggtgctcaaatgtttaggaaaaatgaatgccaaaaatagctatattgtttattcagtggaaggaaaaaagactaaacataatttttacacattgtctgtttatacattactttgctaaaaacttacaaatagatggactcatttattttagagatctgtgtgtgaaatgtattgaaatggattataacatttcccaatgggacacatctaccagcaaagcatttcaggagtgattttatgtatatgtgacgaattaggcaacttatgcttgaaaatatcagaaatattaaacaggcacatctaggggcatttaattcttaccaattttgttttttcctgtctcttaagaaataagagcagggtgtggtggctcacgcctgtaatcctagcactttgggaggccgaggcgggcaggtcacctgaggtcaggagttcaagaccagcctggctaaaatgatgaaaccccatctctactaaaatacaaaaataaggcgatcctaatggcaggtgcctgtaatcccagcgactcaggaggctgagataggagaattgctcaaacccgggagatggcggttgcagtgagcctagattgtgccactgtactccagcctgggtgactgagcaaggctccgtctaaaaaaaaataaataaataaattaaataaataaattaaaaaatgatatagctacatgagctcagtcatcaatgataggctagaaagagtaaattacaaataacaaaaattactatatttaacaattattgtaaactttgacatccatcttcttataatatttgcaataaaatatattttcaatgagatagtgacatggatgtatttttggttataaatcatatgatttattatttcaaaaaaactatccttaatcattaacagtaatgtctttacattgagaaactatgcaaatctcagaatatttgtctcctaacatgttttatgagcataacaaattcaaaaaacacagaactataactcttttgttttacaacttgatacatcacatattgctattctccaaagatttccttcctaattatgttttcttctacataatattaaagttcattgacattctcataatacacaacaggatgtctgcatgaaaattgcctgcaagcaatgttggctgatgggagaatgctagcttatattaaaaggtaactattatggttttatcaatagaaagaaaaagagttaattacattggtacttatctctttcccttttgggccagttaaattattgaattttttttttttttttttttttttggtaaattgaattcttcatgggaaggtacgtcatccacctgtatgaaaacagatatcacaagaaaaaagtatatatagaccaccccccaaaaaacaaacttaataaaactatgtatttcaaatagaattatttttttctggttgaaaaagaaagttggaaacaaaatctgtgacaaaacccaggctttgcctgtactttaacgtaaaccaatgctgcactttatgcttactattttgttgtcttgtaaggagaatttctagagggtggttgggttccatgcaacttaattgtaagtgtcagctgaaagacctacaaagacattgtcagttattgagtttcttatcaagccaataatgtggtacggctgttgtactaataatgaagttttaattagttctcaaaaatactgagagcttatttaaggcctccaaattggatagtgcatgcttagcttgaaggcatcaatgcatcccaaacatatcaaaataactgtcaaacacattgtatacacattaggagataatagctagaaggcttaacatctatcttagaaatactgtatgcacaaattgttcaaggaagttctttctacacttaaatgattgtcttcagaatattgtattttataatttaagcaaattgtcatgcaaatggttcagtgttatctgtttatctgagggtcagtatagttgagaaaattcattttagccaatgtttatcgttattccaaatgggagcattctctattcataactatcccaacatagcacctgcatttttacttataaatacttattgcttgtttccaatattttactgcatgagaaattgtgccagatccctcttccctaatccatgggtagttcaaagatactaacatttaagaaacagttgatttaaacttctaccattggagaattgttgatgtcttttcaatgcattgggtggatttagaccactgcattcttatatgcctgtctattaatgctatacaagatgtctggtttaaactaacattactggaagtaaccctttctaccccatcccatctccacccacacgtctacaaaaagaattttatgcaagacagattttgaagcacatagaggaggagctaacatgagttgctgctagaaaaataatagctgtgttatttgtactgacagtttgtatttcttctcaaatcatttattttcacaaaattggtctggctcttattttttcaaaggacgtaagctacttcattgttgttgttatggatttctgatataatgacattaattacttgctgtgtgccagggacttttttaggcttagagggtgaaagtgtagaactggaagtgcatgcgattcagaggctgcacagtgaccctctgtgggtaagaagtgggctcctagagtatttgaattatgaatgcaagtgggtcaagggaatgaggaatggggtgtatgagaagaataataagcatggagaataggacatatggcttgtttcggggaactacaagatgtttcctatttctgtatcacaattacatgaggataaagggagaggcccaaggatataatgattacaatttgagggggaagtgtttactacattcagagagcctgggtcatattctgttagtacatcatgtttttcgtcaaattttgagtgactattatgtggaggtggaggatcttcttttgatattgatttaaaaatattatttacaaagatattatatattttcttccaagaaaatatagcttatattatacctacaagagttcatgatttgtagggggcaccaaattaagtcggaaatgctaaaatgtcacacatttcaggagaaataaatcagaaagaggtgggtttattggtgaaggatcaatttgatgcatcaaaaagagggttactcttaaattctcgggagaagtgaactcaggaagaaggaaatatcaagtctgacgttaaaatctgatgccaggaaataggaacttgtatataaaagatcctgaatatagctgatgtttaggaaaagtttattaaagtgaattcacctaggatagaaaacaatatggtataattagtagttaaaatgaggatctattagaactttgtctagataaacaaaagaaattaattcatgtttattttttatttttattttattttatttttttgagatggagtcttgctctgtcaccaaggctggaagtgcaatggtgcaatcttggctcactgtaaccgctgtctccagggttcaagtgattctcctgcctcggcttcccgagtagctgggattacaggcacctgccatcatgcctggctaatttttgcatttttgtagagatggggtttcaccatgttggtcaggcttttcttgaactcctgacctcaggtgatccgcccaccgtggcctcccaaagtgctgggattacaggcgtgagccaccacacctggcctcatgtttctttttataacagaaaattgtaattgtgtgactgtgtaacaaaattgtaattgcagctatacttcagttcttcacttaaattgtttgtcaagttttgacatgattctttcaataaaattgtatgataacacgacttctcattctgcttctgtggcattatcacctgaaagtcatttctgcaaagaattatttcagagtcttatcagtttcccaattagcgcttttgtttattttatattcaaaccattttatttttaaaagcctattgtgcaatcattcttgccaatttctcttgatcagaataggtctaactgctttgcacatgttttgaactgttctacatcaacgtcattaactttggaaagacctccttcttttgtaaaatttgcaatttcattattcaatttacatttatttgcattataagtagcgaataactaagaatatattgacatgaaagacagacataggctgaaaggcaaagacaggctctagtgtaaaaaggcagaaaaggatgatttaatggcatctgagattgtaagtggcattttgttatacatattttcatgagaagctgaatttggttctctacacaaacttataactgaagggattcagataaataattctcctatatggagggcctctggaataaacaagattatatcttaggatctgactaaaatggcctcaatgttccccacagcttgattaaactttacacaagctgctgcttaaatctaggccctgacctcccttttcttagagcattccctttagaaaactagtaattgtaaatcctttctctgactctttgagatgtaaatcttttttgaaagtgctttgccagttttaaaacacgaaactgtctttctcaaaagacctggaagccagctcttcgaaatgtaaacatcaatgaagacagagcccctgtcttccagcttctgtgggatagcaggagcctacatttgaaggatgctttgctccaaggtgtaaaactacctcctaagaggcagtttgcttttggcgggggggcaaagccagttaggaaatactggtggcctaaaacccaggtcctttatgacctaattctagctttataaaaatttttcagcttggccaggtgtggtggctcatgcctatgatcccagcactttgggaggttacagcagaagggtcacttgaggccagtagttcaagaccagcctagacaacatagggagaccttatcttaaacacacacacacacatacacacacgcacacacacacacacacacatacacagcaaaaaaaaaaaaaaaaaaaaaaaaaaacaaaaaacaaaaaaacgagaagaagaacaaaaacatctttttgggggcaggagttgcagtacagctcactttgacttttggcttccctcctctcttacattaaactcctggcctgtttaactttgtttggcagattgttttggttttttgctttgacagatccaaataaaataattaaatcagtcaggactgagagatctagatgcatgttgactcttagggagttcatgggatcgtcaccaaatctattcttgcatcacctgaatcttcccaggttgaagatgagagcagacactgaaggtcatattcttgctgctggcttgtatttgctgccaagtcccccagggcatgttctttttccttctgtgaatcaggtcggatttcatataccattttgtgttatttattttggaatttttctcttaaaatagctcctccgtaaagaaagcatattgttcatatcattgtgattatgatttcagcaaaggagataaaactctataataaaataaatgtccttcctagaaaaatatttgagttgaataaaacttcagaatactgccaggaatattgtaactttcgtttgcctcaaaatgctattctgatccttcatctttcattattaatccattcaacaaccatttattaaacccttacatttgtgccagaaccttctagacatactgatttaaaacatgtattctcaagttgcaaaatcgccctccagatcaccctgggtcattggatcaacgatacaataatgtgtattgttgattatcaggtcaacaatgatccaatacacattattgggtcaaaattgttgacctaattcacattatatgtgtttttcactcaaaaagtctggaaggctcagaaaagactggaggaaatgcacattttttcctctgtcatacccatgcatattggttgttctagattagataattaagtagacttagtgcaaaaatcattttattttcatatttcactatttaggttattggtatatttgtaactttttacttttaactactgctttaagcgtttttcattgatgacattaagcatgtaagaaatgatcttaatggttattttgactatagatatcagtgtctttctcattatgtgctttgtataagaaaggacataaatatcaagcaagaaataacaaaagcattgcattcagaaacaagaacatacaagttaatgaaaagaaggtaaaacataattttttcgaccattaaaaacataggaaaggggccaggcatgatggcttttgcctgtaatctcagcactttgggaggctgagaggagaagatcatttgaggctaagagttcgaaatcagcctgggtaacatagtgagacccccccatctctataacaaaacttaaaattagcctagtgtggtgccatgtgcctgcagtcttatctgctggagtggctaaacctggaagatgggttgagcccacaaatttgaggatgcagtgagctatgattgccccactgcactccagccagggtaacagaacaagagcctgtctgtaaaatatatatatatataaaatatgtgtatatgtgtatataaataatatgtgtatactatatatgtgtgtgtatatgtatacatatatacatatgtgtgtatactatatatgtgtgtgtatgtatgtatgtgtgtatatatgtgtatatgtacatatacatatatgtatacatatatatggacttttaaacttttttagcagctctatggctttcagtgctatttggatatttactttgaatgaagcaagattatttgagaactgtttatatttcatgatgtcaccttccatgatagtttttctattataggagattctcagttcattacccgaccatgatgacaagtgaaaactatgaattattttcactaaatcaagtaatcgactttcataaaatacagttcattaatgtttcctcttcagcatattgttttaagatagtcctaagtcattttcagttctttaacataataaaatactcaatagaatacattaaaagaggattcagaacttgtattctttcattttaaaatgtctcctggaaacacaatttactttattttggtgtttattcatgggccaacgtcccctaattatgatagctgtatcttgaatactgttaatgcaaccacttcaatttgagtggtagatatcttctatttattcttctagatccactctccacattttttaccatagtatttggcaggctgctgacttctgtcagtgacattaattgacttcttgtccttgatcttcttcttccatttggccagtggcaaaccctgggaggagaggggaaggaagaaagtgatgatgtattatcttttttttttttctataatgctaacttcattttgctagtcacttaggaatatttttttacagctgaattgctgagtaagactctacattttccctttcccacaagtactcttgagtttttttttttaataagattataccagccctatgtttatgttagaaaagatgacctaaggtaggagttagaaaaccatatctttttaatatcataaagcagacgctgtcattctcttttgaaaaaattatttcactagtttaacttcactctctgaatgaagccctaactcttttaattgccaggaggcccttcataaattgacagcgcctgtttctctgaccccatttctgtggacctcccctgccctcactccactctaagtacatcagctttctcgctgcttctcaaaaaagatgagcttttccttgcctcctgacctttgcaactgtttgccttacctgccgatcttcttacgctttcttccaccctctccactccccattgaaatgtccaactcaaagcagctctgaccactttcaagaactcctagtatctctctaaccccttattttgttttactttgctataatggacacttaccttttgcgaactttatttgctcatttgtttaatgcctttcttcaacaaaatatcagttgtgagggaaaggactgtctgggttgctttcaatcacattttcaaaccaagaaacactccaggcttgtagtaactgctccataagtatgtgtggaatgaaatataatggaaagcagatgccttcataggttgactgaggcagtgtctgtgctgccatttcattgccctgtggcaggcatcattttcccatcactgcatacttgatttgatttactcttctgactattaattctagttactattatcaatagatgttggcatagatgataaacttcctttccactctttctacatttaaaaccattctggattttttaaaattagaattaaatgcatccagttatataagatattcccaacttttatatatcatgttagtaaacatgttttaaaattattttaatgttacatttgataagctgtcaagaggcagtgttgaacaactttatattgttctcttttctattaattatccttcattttctacaagatttaaataaaatatataatattaaattagcatttactatgttacagacactcttatgagtgttttacaggaattagttcatttaagtctcataacactccatgaagtcagtactctcacttccaagatatgggaattaaggcacaagtaatttgtctgacaaatgcctgggtccagaacctggcagggactgtggagctgagagccttctcccaaaatgagaacagcttgtttctacatcttagctcatgagctcacggtcagtgctcagtgaatgttatttttctttataataataaagaaaataaagattgtattagtctgttttcacactgctgataaagacatactggagactgggtaatttataaagaaaaagaagtttaatgggctcacagttccacgtggctggggaggcctcactatcatggctgaaggcaaaaggcacatcttacatggtggcagacaagacagaacaagagccaagtgaaaggggtttcccttttaaaaccatcagatctcgtaagacttattcactaccatgagaacagtatgtgggataccactcccatgattcaattatttcccacctggtccctcccacaacacatgggaattatggcagctaaaatttcaagatgagatttgggtggggacacagccaaatatatcacagataataatgaaaagtttatgtcctccacaaattcacatgttgaaagcctaatacctattgctatggtatttggaaacaggagcctatggtgattaggtcctgaagttggagccttcgtgatgggattagagcccttatagaaagaaattcataaaagctcctttatgctctctctttctgccattcgaagaacaccaagaaggtagccacctgtaagccaggaaaagggccctcactaggaacctgaccatgctggcaccatgtcggcaccatgtcttagaattccagctttcagaactgtgagaaataaatgtttgtttaagccaaacataaatacaattaaataaaacttaaaattaagtaaataaagatcttacctgagtagaaaattctacacaacagtggagttgaaatatgaacccagaggccacagatgggagctttttattacttcattatgttttccctctttatcatcccaactaaaccatttaaggagtatattttctaatactttgatgacaattaggtgtgcaagtacaaaactctgctgtgctgtgcttggttttcccatttatatattagtagaaggagaaaaacattttgtcatctctttggaaactcaaacttacagagggctgaatatttgttttattatcttttaatctgttgtctacaaaatctcaggggatgaaatattatcctcattagattcacaaggacttactaacttcagaaatgtcttcagagatgtgtttgcagaattgtggctttgtgtttgcataataaaccagcagcatttaaatgacattcctaaatctgttgaagctataatgtgagcaaaattaatatctgagagatgtttataaggaattatttttgttaccagccaagtaattattggcattgagtagattccaggaaagtcttttaaaaatccttccagaattttgagccaagtctgcattctttgcactgccatccaatagaaccctatcacatggaacaattctaattccacacacgttactctagatcttaggtattttaacctacaggaaaagccaataaaactgtattggttttctcaagaataaactgaataatctcaaatatgtaaaccaaatttttcatgttttatttgtaaaagcaggttatagaattggatgatctctaatttttcttagagctttaaaattgtgggatttattaggatatggcaaatattttcatcaaatacagtatcttatggaaacccagacatcataagaagtcctacttacaaaatcatcttaaggccctgcctgatttttagcccagtctttaattattcatgtgtgttccatttatttatttattttgggtgaggaggtgggggtcaagaccctggattgggatgaaacttcaaatgctactattggttatgttttgctaaaaatggatgttttctgaaaacatgaaaaatttatgattttttgacacaataaatggaaaatatggatatttcaaaaactaagggaaaaaatagcaaaaaatatatacaagttttacccccaagagttatgatctctgtcacttgtgcttggtgaactgatccctataattttttttttttttttttttacaaaatataaaaacacattatcttcttttattatttttctaccttttattttagagtcaggggatacatatgcagctttgctacaaaggtatattgcatggtgctgaggtttgaagcacaaatatattcgtcgtctagatagtgaccatagtacccaacagttagtttttcaactcttgcctcctccttctctccttcctctgctggtctctagtgtctgttgttgccatctttgtgtccatttgtacccaatgtttagctcccacttataagtgaagatacgcagtatttggttttctgttcccgcattaattagcttaggataatggcttccagctacatccatgttgctacaaaggacacggtttctttcttatggctatatagtattttagtggtgtatataaaccatatttccttcattcaacccacctttgataggcacgtgggttgattccatgtctttgctatggtgaatagtgctgtaatgaacatatgaatgcatgtatctttttggcagaatgatttattttcttttgggaatatacccagtgataaggtttggctgtgtccccacctaaaatctcatcttgaattgtaatccaaattataatccccatgtgttaggggagggacttcatgggaggtgattagatcatggttccgccatgctgttctcatcgtagtgagtgagttctcacgacatctgatggttttataaaggcctttcccccctcttcaccctgcatttctctctcctgccaccatgtgaaggatgtgtttgcttccccttctgccatgattgtgagtttcctgaggcctccccagccatgcagaactgtaagtcaattaaacctctttcctaagttacccagtcttgggcagttctttatagcagtgtgagaacagactaatatactcagtaatgggattgctgagctgaatggtaggtcagctcctagtgctgtacaaaaataagtagcatttctgtacacaaataatgttcaggctgagaaccaaatcaagaatgcgataccttttacaatagctacaaaaagaagaaaatatctaggaatacaactaagcaaagagctgaagaatctccacaaggagaaccataaaacactgctgaaagaaatcagagatgatgcaaataaatggaaaaatattccatgttcatggattgaatcaatattgttaaaatgaccacactgcccaaagcaatttacagattcaaacctattctgatcaaactacaaatgtcactttttgcagaataggttatgtactttttaactatttggtgtgttacataggtaccgtaactgtaaatttgttttatgtagttgtttatatagttctaaataactaatggacttgaattattttagccatggatatgcatttgtacattgtatttttcaaaatttttatttatttcaaaactgaaatacagcatattattctttacaatgttatttcacaatattccctataaaggtgtttccaataatttcagagataacttttaaaattatatttaagctcctggcacatacttctgataattgcattgcctttctcttttctttagttgctagtagtaattctcaaaaaatacgtttttttctatgtgttcaaatttgcagttattgaggttttaaagggaagatttacacatgtgtgtgcacatgcatatttaaaagaaaacagtttttattttcattggaatattctcataagaaccaaataaactttagcttagaaatttaggacaacgaagagaagattttgcgagaactcagcaaatttaagtgtttctgtctctgctccattcctttcaaatgcataagtacatacagccaatacacacacattatcatttgtgaaatgccatcttgttaggttataataaatgtactaaagagttaagaacatcaggacagaatgtttaaaaataatggctctaaacaattgatcaaaacactattttagtataaaaaattagtttctccaatttctccaaaatcatcttatagattatttagaataatttcaagctgtttttttaacatcaaagagaatgttaatgtaagttgttccactttctgctaatatataaaataatcatattatgtttgaagtgtcatttattagtttttttggaagaagccatagtttatgacctatcttggttactattgatgttcaatgaattttaagcatgtaaatagggcattttcaatagaaaagttcatctgatttctaactattattttaccagtaacaaactccgtaatataattgtccctgggtatatgcaggggatgggttccaggaccgtctgcctataccaaaacccaaatattcaagacctgcagttagctctgtgaaatccaggtatatgaaaagttggtgctcctgatatgtgggttttggatccagaaaatactgtatttttgatccccacgtttggttgaaaaaaatttgcatataagtggacctgcacagttcaaatttgtgtgtgaggttcaactgtgcttcttttcttgcatattatttatttgcaggtacattgcagctaaaattggaggaagaataaatttgacaggtagcaatggaatagtggaaagagtggtccctattttggctgttactactatacagctccttctcttcttgggcatctcgaaacctcccagtgccatcttaagaactgagtgagatgtttcctactcagtatgtattgagtatcagctatgggttagatgctgttctaagcatggagagtacaatgttccttgaggtagatgaggtcccatacatatgggatttacattcaggtgatgaataggacattgcactacaggatggggctggagggcccactggagcataagtagagtgcaacagaagacttcgaggagaaagcccatgtctaactggggccaaaatgctgatgagcaggaattagtcaagcaaaattagtcaaggaagggaggggaagtagagagtaaattactttgtaaatgataggctgctactcaaaataaaaagtacaataattattatcattctaaaaacttgtagacaaaattataatttgcttttctagctcccttaaaaatttttacagctctcaatgtcatatatgcctttaaaggtaagtctctacaagcctaatcactgcatttgataagttcaagagtttataatcaatggtggtctaatgaaattttttaaatgcatgtgtatctcccagacccccaaactaaaaatttcatggaaaaatatgtttacatgttagatgagttatgttaactacttatgtttagccaactagttgtgtggtttcttggaaaactattttcagaggacatagaaacaatgtaaataaaatgaaattataatttgcttccgaaatgttaagttactcttaacgtctttggatatttacattgttgattccaataaaataaaaaacctgcagcttacatcaaataaatcttttattttttgcataagaaaatttttaaaaaatgaattattaacaagttagtggcaagaaacgagaataccagggatccagtagtctaatgtaaataataatataggggaatgtcacatgggtaattaactttgaggcatttcctgggatttaaacagtgttaggaaatttggcaaaacaagctcttatatagctgatgtaaaaatgcacacacgttggcattgtttgaattctgccacttcctctagtttgtccttaaaaaagcaagagcaatacatgataattatagttaatataaatggatatctttaattatttaagattttaatcttacagagaaagtttcagcaattatttttattgtcttcagaacttctttttgcaaggaaagcaattagttggacatggattgaaacgagccaataagaaaacttaagtgattctatttgtcatgttttcaattaccgtattgtcttggagtgtgctctgccagtattttaacaactgacttatcacttgaagtcaaagattcttttcagcatgaattgtaaactaagcatttcaataatatgtgagtgtattttgcacaggatagaacttgtcgtgtttcattatgctctttaactctgaatatatgtaagtcggtgtgtgtgtgtgtgtgtgtgtgtgtgtgtgtgtgtgtgtgtgtgtatgtgctttccctttacatttttaagatttcaagaatagactaattctagtacaaattactctaaaacgattccttgtaaagttaacccaattgtttctctggctgcttttataaaaatttgaaggtttattcacccctcaaccctgcaatcaaaactgattttaaaagagcatctgaagcctagagctggaggaatgttttttcatgtgttttattttggtaattactttcttaatttgtcaggatttttctgactctaaggttttcccttatgctatcaattttttgttcagttttcttaaaaaaaaaaaagaaagaaatatctttataccaagatagcaccaatctcactttcaaagctgccaaaatttgccctcctacattcttttattgtttttaatgtttaattctaaaacagacaaagaaaaaaattgcagcactataattctttttggtagatatctccaatgattcacatttgtgccctggtatattcaataagactactaatctttgcctcacagatccatggaaagaataacatgggaggctattgggactgcctggactgtatgtttttttctgtttcttaatctaatattctaccaatctctctttaaaaatgttaattgatgatcacatctttttctttttaggcatttcaaattttgtaacattagtattctgtatgcttagtgtgccaagtaggaatctgcttaaaatcatcaggaaattttcataccaacgtgttcctcagtaccaaaattgtacaatcatcacatggaataagtttatctagtatagcctcctatgtcatgagtgaattctctttatgcgtgaacacgaaatggatttttctgtatttgcttgactaacacaagtgttataaactcatcattttcaagcaactcttcttgctggaaaacttttgctaaattcctgtaatttgccagtgagtgacgtctgccctgctgctcagtggatcataggaaatagacctaatatttctgccatgtaaaaacccttaactcctttatggtgtgtctgtatcccctcatgcttctctccattccccagtctccttatttactcttctatccatcagactaagtattcataaaaatcttcatttttttctatctcagatatctagatatctacatagtttttttgtttgtttgtttgtttgcgacagtggagttttgctcttgtggcccaggctggagtacaatggcgcgatcttggctcactgcaaactcgcctccccagttcagacaattctcctgcctcagcctcccgagtagctgggattacgggcgcccaccaccacacccaactgattctgttttatgttttgttttgttttgtttttttgtatttttaatagagacaggtttctccatgttggccaggctggtctccaactcctgtaatcctagcactttgggaggccgaggcagcggatcacctgatgtcataagtacatggtttttatttatctcatttaattgtaattattttacattaatatcctgcagcctgaccttcattattaataagtatgagtaaagccattgaatcagtttttctttcacattaccatttatttttctgtattttttttctaaaatttctttcagtaagaaattttgttgaaatccaggcatacggtctatattcccctgtattttctctaattgccttgtcaaaacaaacaaaagaattaagttgagtctggccttaataaactcaggctggcttcctgatatgctttttttctaaggtgttaatgcaaatttagcattttattctagatgagattgtattcacagatgtacacttcacaggtcatttccttgaccaccctagcatttcttgtataacctacaattagtcaaaaagaatttatctaagttcttttcttatgttagggtgtccacttttagtcttagagatataaactgacttagggttgttctgtatatgtttatgttatctttgataaccttgatttttagctctgactaccaagtatttaagtccaaaatttatttacttagaaaatctagccaatgaattaatctatcatccattgacattagatcattagcctcaaggaccaggtttttgtgtttttttccctcttcttactcaaacagagttccaaatctttgaaaattatataatatttctttaaacaatgttatttacaacatggtatcattttatttaaccttcattaaatatactttggttttattttgggcagaacctgatgatatctgaatagtagaactcgtgtggaaattttctcaattttataacgtttctatttttttctctccagaatattttatacatatatggctaacaaattaattttaccttactttctatcacttgttaattaactttcatttaccttttattgatatattggtaacaattgtattttactctatcatttcatatgtaaggtaacttccacatcatgtgtttttccttatcaaaaatttaaatttaactatattctaatgctttcctttttagttatcattaaattgaaataatcaagaccaccatttcctaggacctttttcacttctattctgcctacccatttttttttcatcttgataagaatttggtccagattatatagtatatacatacactgaaatattattcagctttaaaaaacaaggaaatcctgtcacttgagacaacatagatgatctggaggacattatgttcagtaaaataaaccagacacagaaagacaaacactatatgatgttacctacatgtgggttaaaaatagtaaaactcacagagagtagaagagtggttgccaggggataaggggaaggggaaatggggatatgatggtcaaagggggcaacatctcagttatgcaaggtaaataagtcctggagagctagtatcaagcacagtgcctatagctaatgatactacgttgcatattacaatttcctaagtagatagttcttaaccacagagacacacagatacacacatgcacacacagaaaataatagagtgggaggaaacattgggaactgatagatatgtttattgccttgatggtgatgatggtttcaccagcacacttatccctaaactcattgcattgtttacattaaatgtgtacagctttttctatattaattatacctcaataaagcagtttttaaaaaagttttaattagttgctttttctgtttttcaaaaaatgttataagtatagctttcttatatatatttagatatttcttcctagggtcattgaatctaaaatatgtgtaaatcttctttgatacagagaaactccagaaatatggtagaatacagcaatagacttcaggacggaggccaagtgtaaatttaaactctactgtttattaaatttgtggtcttgggtaagtctccttaactctcagatgcaagtcattcatctgtaaacagtgagattcatagacgtgtcttcccaatactaagctgtattgtgatatgacttaaacctctatattaaaaatgagctgtaatttgctttaatttactattttattctgcatggtcttcttattttaaataaaatgtacatttccattattgttttttagttgaatcgaaaccactgaatcttgatcatatctaaaattttacttttacatcttcttgttaaaattacaataccttgttcttcatcacttattcctagtgtatagactacggagaacacagaaagttttctgaagctccttcctattatattatcatataaattaccaggcatgtctgtcttgatcatactttcttcatcaatccccatgtctttcttggtatcctgttttataattttatctaggacttttttctcactccgattctaatttagatttgagtattattgatgagattggaaattctccaggcaggcattttctttctcgtcctcattaggagctctcaggtgccctagccaagcgtctatcacttgggtatattcatggtacagaaagccaaatcacattatgtgctgccagccagcaactgagacagagatccaagctccacagcatcccttatcttccaaatttccaactttcattggaagcaaagatgaaaatgccacctgtgtcccaaggtccttcatatttaaaaagtgggaaaatgtattaaagatatgccctgattttgtcttctaccacgacacactcataggctatcttcagatctcgacagtattttatgtagaatgttattttatttcactctcttcaaagtagtcagttgaagctggtatcgctgtcctgaccacaagtgagaaaataagcagagttgtgaagtgctttgcccaaggacccacagatttttaaaagtagaccagatggagaatccagatcaggtttcagccttcatttccagccagcttttcaacatagacatggcaccactttttaaaattttcctgtcagctactgattatattgtgtatttcaaccagagatgccatgttttgaaatatttgtctatcaaacaaaccacatctgttgagttataatttattttccacttttgctaatcaagcatgtatagcttctcatcatcatttttgatgatcatgagctaaaaaacaagttattaaaaataagttaaataaacctaatcaaaataaatgtatcttggtatttacatcagtcattatacaagtaaatgcaaattttctttaggcttttaaacattttgaaaatgacaatggctttgtttccaacatgagtgaaccagtttaactgtggtttacatcagcctgtgtaactatgatcatacatcattacttgatattagccctggaattaaaagacagattacccagcaatcccatttctgggtatatacccaaaggaaaataaatcattctaccaaaaagacacatgaactggtgtgcttatcacagcactatcacaatagcaaagatatggaatcaacccaggtgcccatcaatggtggattggataatgaaaatgtgatacatacatatatatctcatagaatactatgcagccacaaaaaataaacaaaattatgttccttgcagcaacatggatgcagctagaggccattatcctaagtgaattaatgctggaacagaaaactaaataccatacactatcatttatacgtgagagctaagcattgggtacacttcaacataaagaagggaataatagctagacactgtggactactaagtggaggagacaggaatgggttcaagcctaaaaaactacttattgggtactgtgatcactatctgggtgataggatcatttgtacccccaacttcagtgtcacacaatatacccatgcaacacatctgcacgtatacccccgaatgtaaaagttgaaattatgaaaattaaataaaaataaaagacaaatttgcacgatgttttacccagtatgttagctgaaaatatgtaatgttttaggtgaaaaaagtcagaagttatgcaaaagataaattacacagaaattacaggcatacatgaaatatcagctctgtgtatttttttggcagtcccaagtacctgaatgaatatgaacagtttttgttcttattttctggtgaatgattttttacaataatatgacattatgaaggatcttctaacatgaacataacaacagcaaaaatgggcaaatgtctcaaggttgttaatgacaaatacgtggtggtaatcaatcagtgtcagctcccactgtcaccagctggcatagcaggcctcgtcaacacagcactctaagaaactacaatttacctatgaagttggcacaagaaatggtatccatttttttattcttgttataacttttgtatttctgacaatgtttgtgatatcattttacatgaacctcatacacattctactactcattggcacctcttcccacctattaatgttttggccaacataaaattactggttatctattgctgtatcatgaaccactgaaaaacttagtagctttaaacaacagcagcaatatttattttactcatgaatttacaacttgggtagagttggtggcagcagttcatttgtgctttgtgtgccatcagctgaaatggctcagcttagattgaaggaacttcttccaagacggcccactcaatggctggcaagttgatgctgttatcagctgagagctcatctggggccttactttctcctcatgtgggcatttccataggttactgagactttgacagcacagtgcctgatcccaagtatgaattttccatgacacaggaagtgaatgcagccaatcttttaggtccagagccaagaaactggtaacctgtcacattccaatcattccattggttgaagcagccacaaagccagctcagttttaagaggcagagacagacttctcctctcaatgagaagagagccatagaatttgtagccatcttaatttattatgataatgttatttttatctcaagtcaagagataagagacaaggaagtataatcggttatggtgactgcctatctagtcttcaaatatttagccaacatgcatcaaatttcttgccctacaggaagccaagaattatatcttagctgggcgtggtggcacatgcctgtaatcccagctacttgggaggctgatgcatgagaatcacttgaacctgggaggcagaggttgcagtgaactgagactgcaccactgcactccagtctgggtgacagagtgagacactatctcaaagaaaaaaattatactatatcagttctttaatgatttattttttacattcaaatgattcaatgttactcaataagtgaatgtttgcaaaattattccagataggtataaacttctgatcgtaatcttcttgaggactccaacttgatatttaaatctctatatgcagagacaactcatgtttttgtaaacatatataaattcataggaaaagccatgataaataatagtgacagtaattggtaggaaaaaatatatattgtttgtaaagatgttttatacatatggacttttgtggtctgatatgcatacagttaacaaatgcatttattttatatctcttgcattgttatctatttctgtgtcagaagaaagaaggcattttgccccttttgttctttctacctaaaaccagtatataatgagctatttcattttttcctagtcacgatcaaagcataatttcagtttaattttgagttttaaattttatacctttgacagattccttctgaaaagaatttatcgtgctgaagagagttataaaatgcagtgattaaatatatataggtaaatagatattttaagataaatctatcatatatctctatatagagatcatttattacatatatacatatatgtatatatacatatgtgtgtgtatgtatatatgtgtgtgtgtatatatatacatacatatatatatatggagagagagagaaatattttgtttttccctcaggagggaaatgcattttctctcctggagcagaagcatgtacaggttaagaaaaagatattctaagtgggtagaatagatgactgactattcatctgttctagcttccggtcctgcaagaagtttggtgaatgatagctgaatatttgaagactggatagaaagctaccataatcagccatactgcctgtctctttaggatagtcttcaaggaatccagccatttttcctacccactgatgttgccaccttcagcaattatatgtgtgtctatgggttgaggaataatccactaagcgcacatcagttaacaaatgggtgactttagaggaagaagtttcaatagaagaagtaagaagatgtcaaagatgacatcctgcctcttgtggaagatgggtacaaaccgagctatgtaaaaacctaggagagtaatattctggctatcctttaagactatgttcttgaaatatttgttaattagttatttagagaagacagtggatactgcctatagaaactgtgaaaggaccactggttgctcactgcagaggtgtcgagccacctgttgtccttcacttataacacacctgccatttcctggccatttcctaccatacaccaagcaacttttggacaatttcttccaaatacttatactgtttactggaaagggcgtaaaggaaacaatatattctctgtctcctatgtttccaatgacatagtaatgccttagaaatatttcagtgttttaggaaattgtttcttaacccaggttagtatacagaataagggccaaattcctttatatgggaaacaatacccttcgaaatctgtggcttatatttccaaattaatcttttgctcctcttcatctggcactctttgcttcagcatttttaaaactctgtgtgttttttgttgttgttttgtttttcttgtttttgttttgttttggttttctcttgttttaactagttgttttcttatgcttcaatcttttgtacatgaattcctaagcttgaaatgctgctgcccctgtggttcgccatgaaaaataattcaatttaaagtgataactttaaacaatttccttgacctgtgtatctcttttgttgggtgcttttgccttttggtctgcatttttttattaacttgtacatacctctgtaagaacagatagtgtaaaatgttctttaatatttaatttacttttctaattctttgaagaaaactggtgtttcatgtaggttaactttacattcccatcagctaccatacaatcgatatccaataaatatgaatgaacagtgtttgctgatggccgaccttgactgaagaatatttaataattgagtggttgagaattctgaaaaactttttgaaaacactatggaaattgtcagcctcaatgctggccttcataagcaagtactctttgcttaggttactacattctcccaaccatttgaaactgctgtaagataattatttagcatttatattatgcatgggatcccatctacagggacagtttttccttcttgtactgcagtatttcttatgctataatgaaagaaaaaattattctaaacctgtacgtttagcttaagattaatgtgtctttatcttatctaggtgttttaatccccttccagccttctttccctcccttcctacatccttcccttccttccttccttttccttccttccttttttctttccttccttattcttacttccttccccttccttctttccttccttccttccttccctcccgccctccttccttcctccgtccttccctccctcccttcctttctctctctttctctctttcttttttcctatttccttgcattgcaaagccttccaaataaaactaaatttaatcatgaaattcacacaggatatacagttacaaataatggattaggatgtaattagctatatgtgtgtgagtacaataaaatctcataatcaaattatgtgtatctgtagttgtaaaaacataacattgaaacaccatataaattaatttagagccatttttgatatttttgttagtatgtaataattgttcatatttatggggtacatctatgggatataatcacgtggaaatacataaaagtattgctagcttactgatggctcttagacaattacatggcaccatggacacataacttctccgaaaaaggagtttctcttttgaaatgtgagatgcaatgggagaccctcaaatggtcatatctccaaagttaactcattatgtcattgtctcaaagtacctgaataaagctattttgagcttcagtccccgacggcataaattctcattttcacatgagtggttgcaactattcatatgtactaagatttactaaagtatctttctgtggaggattattataaaatattgcattttctcaactactggcaatctaagtacaccatacttaagaagtcaagtaagagttttggataatcgttttccttcctccagaaactttatttttcttttaaatttaaggtgatttattgggatatactattatctaaaatgtcaaatgcagacaaatttaaatctgagaaacaaaataagcttcagagtggtgggataggatgcagaatcacatgaatccagaatgattgatttaaatacccagcataacctcatcttagttttgctataaatacaacaattaaaacaggctcatttattatcacccccaacccattccaaacttgcatacacccttttaggcaatgcctgattcctggtcttgcaggaaagacttcctcttcaactcttttacttgggtgatgcctactaatccttattatctccactaggcagtctccctaattccccaaccacgtgtacatttttttttctgttccccgtagtatcttgtgaatatctacctctacatttaacagtttgcattataataactattttttaaatatttctcagtcactatactctgaactgttgagagctatactgtatgtctttataaatagaatcaatacaattttgttggctgatcaacaaaccaggcaatatcaaatattatgttggtgcaaaagcaattgcaaatttgccattatttttaatggcaaaacccacaattacttttgcaccgacctaatagaatagaaactaagcccaagcaaagtacaataagaaaatataagcttttgcttaaataattctgataattagtttattttcttctgttacaatataattttactttagtaagtaattttactttaataaaattataactagtaaaattataatgtttaggcaaatataaaatatttttaatgatgatttatttaacttattaattaatgagggaaattttaagataaccaaactgggctaaattgcaattaaggatttagataaagagtatttaatatataatgtaagggcaatattttgaaatttcatacaaaactgaatgatgtctgacagagaaaccgtatttctctgcatattgccctggacagaaattagtttcatattgaacacaagtaacctcattttatgagggcatctctcactagacaaaagtcaaaacgtcactcttactctctgccccacagaggtgtaacataatctagaaattggaaaatcaagcccatcattacactgagatactactcagtgtctattttacctgttttcaacttttacgtaacttgtctgacatttaagttgaggttctcgaattcaaatgccaacacatatcagaaggcagttgaagtgcaacaataaggtaggccatgtttgaacttggaggccagcatattctggtgctttaggaaaatcctgatatcagaattctagtgtaaagacttgtgattttaagatttggtcagtaatttaaaatattttaagactctaggccaaacaaagctctttatggttcgtggaggccaaaagccaccagctcgagacctacgttgtagaatccaacaggcaatccagcttccctacagaaactggattttatacactgatttcttgctcagtacgcagattttttttttttcttggcctttaggaaacacttctgctgtggaaaccttttgagagctaaacttttcccttacaaatttgtctctgccctttcttagtacacatcagtgatgatatttttctctagagcagtatcttaaaaagtcaatagcctaccacccactctgcagaatcaattgaccatagttaaatttttaagttagcctcattttttcaagactatcagagatatatttgtctaagtttaatgtgtttttttaaaaataattttgtgtttccttaggaattagataagaaaaattgttggagcatgcctcatttatccccctagaattttaattaaggaatgtttatatatatttttaatatctaaaaacaattcagtgaatgccgtttacaaatggtttgtgatatatacatttcactagcattccagaaatgtgttaaagcttctcttaatgattcctaaaataatcatagaataatatacatggacatcatagtatattattttgatcttttgaaaagataatggaaaaattgatatgcaaagttaactacaaacagtatataacttattgtcaattctgcaattatcttctggattttaatatataaatacacaataatttctgaagttttagaaatttacaaattaaaaaatagagatcacctgctgtgacagaattggccaggaaggtaaaattttaaaaatagttttattgttttcaattggtttcttagtgagcacaaaaatatggagcaaagacatcactcaggaaggatctaagctatatatgtattgattaggattctcaaaatacagaattttctgaacatttgctttccctagttaaatgagagtttcaaccactttattttaaattagttgtgcaactggtatttaaaaaaacaataataataataaaaaaaaaaactcttcttactgcctaaggaaatggcatctattgtgtgtgtgtgtgtatgaataatctaattgagtgtataaactaccacattataaccgcaagctgtattgaaaaataaatatcagctataagactatgttaacttttgtctttgtggtacctaatctccaaagatggcctcagtgacagagtcctcacagtcttcatgtttttgtgtggtttcttccgatactcaatttgtgacttgtttaaccgattgagtacatgcaatgaaaaaaaagacactttgactcttgcaggtgtagaccttaaaaggggccagccctctctactttttaacataatgtctgatctgccactttttttctcattaaaaaaaaaattgctatctctaccttcttcctcccattgcaaacgccactgaaagtgatttttgtcaaatttacctgtcatctccttgttttaaattcaatgaaaccatttaagtgcataaattattcaacctttgtgtggcactggaaactttcttttattcccagtttcttaaaatagcctctttagtttcttccagtttttgtctttgtccagttgttctcaccctgtttgtggattaccctcttccagagaatgttggtattctcatagatccactatctgctttctcttcttattccacacattctcaagtaattttatctaggcccatggctttaatctcatgttgctgacttcccaaattccatctccattacaatcccatttgcttagttccagaatttcttacccagttgccaacaagacaagtttattggacttttcttcggggtcctgaaaccagcatactcaaatcgcattcattcctgtcctcagcacattccaggtgagagccccgaaacctcttcttattctagaaatagaacatctagttgaataagccagaagccaagattcattcctggctcttctctctttcactttccctgcatgcattgaacctgtattttgtgccctttgttttaaatttcactttaacaattcagtttatttctacctaacaacttgtaataaaacaggttggtgtcatggcagagaatgcagaatagtcagtagttgagttctgctcaaaccaattccagatagataggctcacggaagaagaaccaggaaatccaagggataggacaggtcctcaaatttttctctgcctcagaattgtctcagtaatatgcattcaccaacatctggaggacccaaagttagctaaggagcagataatctcaaggaatctttgtcagaaccatcctccaaaacaagtgcttagcaaactgctctatgtgacagtgcattatgataagagcaagtggccctgtttatgggagcttttggatattaaccagtatctcatcccttaaagatagatgtccctataagtgattgttgaaggtggaaagttagaagtaagcaatagtttgagactattttaagtttaccctcaacgagctggaaatcagttatattttatttggtatttactcatttttcaccattatgtaattcaagctataatttcagtactacttgttgttaactacttgctatagacaagtagataagtaaaggcctaaacagtatctcaaaactaaaagaggagatttcctaagtatactgtcaggagcttcctggccatcgggatattttttagtgttgtcctgtagcatagtcaatcaccaaattctgtcagttctgtcatcacaacatctctagagtaaatgtaatacattattcatttttctgttttagtttaagccttattacgatccaactcaaattactcgaataattttctaaatagccttcctgcttctagtcctgaccatctgcaagtcaattcatttgaaagtttttcaagagggaaagcagtttacttaaccatgtctccactccacagcttcaccccatccccaactgttctaaaccttgctctgctctctaagataaaatctaaatgtatttgaatggctgatagggccttatccagtcaagccctggcctatcttgctagtcccatctcctgccactatttctattcccacttcatcatccactcctctcccactcccagtcccatacctcctgattcattctgcttaattcctgtgtttctccccagactccaatgaggcagtacctctgtcagctttctctgaacctcattaggagtctacagagttacctattcatattgctatccgagcgcagaatacttactgaatttcattacactcctatgctcacttggctctctcttctacctgcaccgagtctcttgggaatccagaccatcttattcattcactgcttagcataattcctgtccctagtggacacgtaataaatatcagttaaatattcaatgaacaaatgaatcctctgtcctcataatatactgctttattttatattctaagactatgcttcagaaaatatagaaatcaacaatgctattctgattaaagtagtaataataataataataataataataatgtttctttatctctggacctaagatgtcaacacaggtaaaacaaaagctattttttaagatattaaacttaggctaaaaaacagaaaaatccacttaatgcaaacagcagctacttatcaaaatataaataaaggaatattatggagaaaataattctctagtgtgcttaattcacccgagcctcaacagtttctgctgagtaaaagctataatgcccaatgaagttttacatttccatagaaaacaaaaattatttccagatgtttgctaagaataaaatatctgtatgtatgcataattggtatcaaaaagctagcaaaagcaattaaaatagctttctgtataatttctcagatattatgaatacatggatgaatacacagggaaagaattaaagagcattacactttgtcaatgttctaaataatggaacatgcaatatatgtcctagaaaatggaatttgacttaaacggcaaaataaaagccaaagaggatgaaataaacagaatcactttctaaaatttcatctctgttctagattccttatggaatttgcagtaggaaaaacttaaatatgcaatgagtatattaaaatccaaaggaaatatcagtacttacttggattggatatcaaaaactaaaagacaaagtcagttgtattagatggctggggaaatatcaggactctgaaaaaaattatttttgctaacaattgtattgtttattcttctacttttactaatgtgaactttgaaggagtatatttgttgctctttgagccctttacagtttttcttgcatatatgctcctttttttttttttttttttttttgagacggtctctggctctgtcacccaggctggagtgcagtggtgcgatctcggctcactgcaagctccgcctcccgggttcacgccattctcctgcctcagcctcccgcatagttgggactacaggcgcctgccacctcgcccggctaatttttctttttttttgtatttgtagtggagacggggtttcaccgtgttagccaggatggtgtcgatctcctaaactcgtgatccacccgtctcggcctcccaaagtgctgggattacaggcgtgagccaccgtgctcagccatatgctccattttttactttatcttcctcaggagcagtggctggcagtgagtgtaggggagattgtggctttcatcatatgctctcctgaactactcataatttctcacttttaatccctcttctgaatctaaagaatgcagtgcttttgaaatatactttgtttcttcatccatatttcaaagaagctatattacagtaacgtacatttcttctagtacttaaataactggaacttatatgacacttgggacaaaactggttcatactgaattttgctataataagaaaagagttatggcaagtttccaccacattgtaatcttatatgtagaaactgtataaagggtatgcaaaaacagtatgcagatgaaaattttcacaattcatatgcaggacaaccacctgtggctttcatcactttctcttcatttaagctaacttcccttgcaaacttccatttccactaatgccagagacagtttaaacgagccagtgaacgttaacctagtctcttctggttaactggagccctttcttgtaaatgttccgtctcatgagctgctcctcactttcttatccccaccaataaagtagctgagagcatgtggctgccattgcagcctcagggcagtgaggatgaaatctctgtttcccgagatgggccctcgatgacatggtttttccgacgtgtggtaaggtcatgaaacacatgcccagcaaatcacatgatgtcattgtctcctctctaaccacactgactcagtgactggtcagaactactcgagtagagcatgcagactgcctctggactaccagctgattttactggtcctcaaatgacatatctaccgatattgggagcaagagttggaacacatttttatcaacttcacgttggggcaacattcaagactgtgatctatgggcttgtaccattaaacagggtattgttcagttcaggtaatgccagactcacttctgtggattacacactggccatgcacagtgcgatcaaatatcggaccttgaggggttggataaaatcctgttttgtcaccagagatagcttgagaatcattttcttatgagatatacccattttcacagctgtaaacaccattactatgctgaaaactctctaatttataactctaccccagatctgtcttctgagctcccaactcagcaaattgcatactcaataatttcatttgcatgtaataagctccccaaacttaatatgttaaaaaccaaatttctgacccccactccaacaaaataaaacaaaatgaaactaaaacctgatccttctcagtctttccatcttagaaatgacaactttgttcttttattcatacaaaattagtgaattcatcaagaagatttttatcttttattaccaccctggtccagatctgacctctctctatcctcctgttgcaatctcctttagaaccttaggcaaaggaatcagcggatctcacagacctagagaggagaaaggtggtcaccagaggcctgcagagagagaggaaaggatgggcaaagagaagatattaatcaaaggttacaaagattcagctagactgggggaataggtttggctgatctcttgccccgcatagtgactgccattagtaataatgtatatctccaaattgttaaaagaatagattgttaacattttcaccccattaaaaaagataaattggtgaggtcatagaatatgttaatttgagtttttctctactatatatgtaaatcaaaacatcacattgtacaccgtaaatatacataattattatatgtcaatttaaaataaagttaaatttcttttaaaagtataaattagataacgttaattcaacactcacaacccttcattgctttccatgttacttattaaatagctcaggttctcaaaatagcccacaatatcttaatgatttcaccaataagcaagcttttcagccaccctgcctctaacttactcgtctccattcacactggcctcctggttgttactctagcatagcaagcacacctctgctcaggaaccttatatttgctgttgcttctccttggacctctatacacgtcaccttttcagatagaacatccctgaagaccctctatagaattgtggccccatacctgtactcggtccctgtaatctcgccacgaaatgtggcaggtttacataatactgtacccttagtgtctagaacaatgtcaggtatttattgagaagacattcaaactttgttgaatgagagaattcatctttgtttgtttgtttgtttgagacagagtcttgctctgtcacccaggctggagcacagtggcgcgatctcggctcactgcaagctgcgcctcccaggttcacgccattctcctgcctcagcctcctgagtagctgggactacaggcacccgccaccacgcctggctaattttttgtatttttagtagagacggggtttcactgtattagccaggatggtctcgatctcctgacctcgtgatccgcccacctcggcctcccaaagtgctgggattacaggcgtgagccaccgcgtccggccgagaattcatcttttgagcatggggctcagctcttgtcactgactgtgaatcgtattgtgctgctcacaaagttcaatggttttcttaatgtggaataattttatgtatgagcagatagaagggaaccaagagtaacatctcaagctcacctaccttgaaaagtccctttgtccttacaccttaccaccgcatactggatgtggcaatgaagtagaacaccagcctagtgttcctcaacctcagcactatgacatttggggacagataattccgtgtagtgggagattgtcctctgcattgttgcttagccgaatccttcccataggcctaacaggtgccagatactagtaacaatgcctacctccgcccctactcacgttgtgacaatcaaaaatgtctcctgaacttatcaaaagttccctggagtcgggagggggaaattgcctctggcctagaagatcttggatgcctccttagcctttgagggatgtgaggatttcatcaggagttttataatttggccttcacctaccacacctttctgcctgagactcagagaactgggaatctgtcctcttaggggctccggttttatccacattctcatcacctcacctttaatttccttgatacagaattctttctacattctcttcctatttggaaggacttcccctttcatcctcttacgagttggttccagcagaagtttggagtaaaattctttgatcagagttgcctgagtctggctcttgatttataaagaaagtgtatagaatttagaaaatattttgatcttccacagagactagctttccccaagtctttttcattcagagactcaaagaagtctaatgtgacagtcaaacaacttttctttgtagctgtcatttgccctccttctaaagcatgggacctcagtgggcaatgagtgataagccagtgggtgttactgtattagcagaatgaaacctataacaatttttaacttaatacaataaaatttggtttacgaaggaggagccaagatggccgaataggaacagctccgggtctacagctcccagcgtgagcgatgcagaagatgggtgatttctggaaatcatctgaggtaccgggttcatctcactagggagtgccagacagtgggcgcaggccagtgggtgcacgcaccacaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgagctttcagaccggcttaaaaaacggcgcaccacgggactatatcccacacctggctcggagggtcctacgcccacggagtctcgctgattgctagcacagcagtctgagatcaaactgcaaggcggcagcgaggctgggggaggggcgcccgccattgcccaggcttgcttaggtaaacaaagcagccaggaagctggaactgggtggagcccaccacagctcaaggaggcctggctgcctctgtaggctccacctctgggggcagggcacagacaaacaaaaagacagcagtaacctctgcagacttaaatgtccctgtctgacagctttgaagagagcagtggttctcccagcacgcagctggagatctgaaaacgggcagactgcctcctcaagtgggtccctgacccctgacccccgagcagcctaactgggaggcaccccccagcaggggcacactgacacctcacacagcagggtattccaacagacctgcagctgagggtcctgtctgttagaaggaaaactaacaaatagaaaggacatccacaccgaaaacccatctgtacatcaccatcatcaaagaccaaaagtagataaaaccacaaagatggggagaaaacagaacagaaaaactggaaactctaaaacgcagaacacctctcctcctccaaaggaacgcagctcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaaccggaagaaagggtatcagcgatggaagatgaaatgaatgaaatgaagcgagaagggaagtttagagaaaaaagaataaaaagaaatgagcaaagcctccaagaaatatgggactgtgaaaagaccaaatctacgtctgattggtgtacctgaaaatgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccgaagttgaaatgaaggaaaaaatgttaagggcagccagagagaaaggtcaggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaagcctgccctaaaagagctcctgaaggaagcgctaaacatggaaaggaacaaccggtaccagctgctgcaaaatcatgccaaaatgtaaagaccatcgagactaggaagaaactgcatcaactaatgagcaaaatcaccagctaacatcataatgacaggatcaaattcacacataacaatattaactttaaatgtaaatggactaaatgctctaattaaaagacacagactggcaagttggataaagagtcaagacccatcagtgtgctgtcttcaggaaacccatctcacatgcagagacacacataggctcaaaataaaaggatggaggaagatctaccaagcaaatagaaaactaaaaaaggcaggggttgcaatcctagtctctgataaaacagactttaaaccaacaaagatcaaaagagacaaagaaggccattacataatggtaaagggattaattcaacaagaagagctaactatcctaaatatatatgcacccaatacaggagcacccagattcataaagcaagtcctgagtgacctacaaagagacttagactcccaaacattaataatgggagactttaacaccgcactgtcaacattagacagatcaacgagacagaaagtcaacaaggatacccaggaattgaactcagctctgcaccaagcggacctaatagacatctacagaactctccaccccaaatcaacagaatatacattcttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccactcaactacatggaaactgaacaacctgctcctgaatgactactgggtacataacgaaatgaaggcagaaataaagatgttctttgaaaccaatgagaacaaagacacaacataccagaatctctgggacgcattcaaagcagtgtgtagagggaaatttatagcactaaatgcccacaagagaaagcaggaaagatccaaaattgacaccctaacatcacagttaaaagaactagaaaagcaagagcaaacacattcaaaagctagcagaaggcaagaaataactaaaatcagagcagaactgaaggaaatagagacacaaaaaacccttcaaaaaaatcaatgaatccaggaactggttttttgaaaggatcaacaaaattgatagaccactagcaagactaataaagaaaaaaagagagaagaatcaaatagacacaataaaaaatgataaaggggatatcaccactgatcccacagaaatacaaactaccatcagagaatactacaaacacctctacgcaaataaactagaaaatctagaagaaatggacacattcctcgacacatacactctcccaagactaaaccaggaagaagttgaatctctgaatagatcaataacaggagctgaaattgtggcaataatcaatagtttaccaaccaaaaagagtctaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaacagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatatgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaactcacaagggatgtgaaggacctcttcaaggagaactacaaaccactgctcaaggaaataaaagaggatacaaagaaatggaagaacattccatgctcatgggtaggaagaatcaatatcatgaaaatggccatactgcccaaggtaatttacagattcaatgccatccccatcaagctaccaatgactttcttcacagaattggaaaaagctactttaaagttcatatggtaccaaaaaagagcccgcatcgccaagtcaatcctaagccaaaagaacaaagctggaggcatcacactacctgacttcaaagtatactacaaggctacagtaaccaaaacagcatggtactggtaccaaaacagagatatagatcaatggaacagaacagagccctcagaaataacgccacatacctacaactatctgatctttgacaaacctgagaaaaacaagcattggggaaaggattccctatttaataaatggtgctgggaaaactggctagccatatgtagaaagctgaaactggatcccttccttacaccttatacaaaaatcaattcaagatggatcaaagatttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagagctaatatccagaatctgcaatgaactcaaacaaatttacaagaaaaaaacaaacaaccccatcaaaaagtgggcgaaggacatgaacagacacttctcaagagaagacatttatgcagccaaaaaacacatgaaaaaatgctcatcatcactggccatcagagaaatgcaaatcaaaaccactatgagatatcatctcacaccagttagaatggcaatcattaaaaagtcaggatacaacaggtgctggacatgatgtggagaaataggaacacttttacactgttggtgggactgtaaactagttcaacccttgtggaagtcagtgtggtgattcctcagggatctagaactagaaataccatttgacccagccatcctattactgggtatatacccaaaggactataaatcatgctgctataaagacacatgcacacgtatgtttatcgcggcattattcacaacagcaaagacttggaaccaacccaaatgtccaacaatgatagactggattaagaaaatgtggcacatatacaccatggaatactatgcagccataaaagttgatgagttcatatcctttgtagggacatggatgaaattggaaatcatcattctcagtaaactattgcaagaacaaaaaaccaaacaccgtatattctcactcataggtgggaattgaacaatgagatcacatggacacatgaaggggagtaccacactctggggactgtggtggggtggggggaggggggagggatagcatttggaggtatacctaaggctagatgacaagttagtgggtgcagcgcaccagcatggcacatgtatacatatgtaactaacctgcacaatgtgcacatgtaccctaaaacttaaagtataataataaaaaaaataaataataaaatttggtttacaatcttcaagaacattataaccattatatataatacatggtaattttcaagtatctcaaacacacatagaatttcatagagaggtataaatatttatgccaaaacacatggtataatgatttctttcctttgattaagaggcatttttatagtgatcattattaaatgaaataaatatttgcatgtggtacagtatacaatcctttcattacgaaatgttattttaaaagtatgtattgggtcctgaatcacgatgttttaaaatgtttgattttaatgagtcattgaatatgtattagcttttatgagatgcacatatttggaatatggctgtattcgtcagcataaggatgatttaaattttcttaaaatagactattaggatgcagatgttcttgctgacaggtgcttctaaagcattaaaaatacatgtaaccacagtgcttttgacaatgtaattctgttgccttcacacctattaagttgagcaatttcccttatttttctcaaacatgcatactaataaagtcatctatcagtgtttacatatatctaataattggaaaattacattttttatccataataagaaaaaagataaatacaattttgtgggaaatgctatgttagctctcaaataatgtaagtttagcagggcctcagggtaacaatgttttaaattaatcttttggtactatacatcaatttatattgaaatcatcaatttatattcaaatacctgtagtgctaagaccatgttttatttgtaatatcccctttaaacctcaagaaagagtccttattctaatctcataatttagtgataaaatgtatattcactttcccatttgtggcataattttcttagatgtcaaacattatttttctagactgtgaaaaacaaaggctttagtactatttatttgactgcgggaatgaaaataacattgttgagtatctgccctaagccaattactgtgctaatgacttttcttttagaatattgttgcctctttattctcttaatcattttaacattctttattttgacccactgcagtaacatttgatatactcatatgttatacgacaagtaaacatttcatttgctcccttcctttgttgatttcataatttcatgttatatgtagatgatgtcttcaggaaaattaatgactcctttattggttaatggagtttatcacttttcataagacaagtttaagtaatgtctatagattctgggttagataaatcagcaaagtttcatagagaaagagggcctgaacctcgaaagttaattatgctttagaaggcaaaaatgagcagcgggtcttttcagaagcgcatagggaatatgtaggattccctaggtactagtagttggccaggttagctgacgtgcatggtatctgtaagagagctgcgaatatggaaagaggatgaggctgcaacattggtgccttcttcattcagagaaggcactggaatgccaagctaaggggtttgtgattttcctgtaggtcctagaaggtgaaaaagtttgatgaaaatttttacacagagaagagaaagtgagtttgttatttcaggctgctataacaaatgatattagactgagtggtttataaatgagagtaatttatttctcacagttcttcaggctgagaagtctaaaaccagggtgccagcatggttgagtttttggtggtggccctctttcggcaaggagactgccaacttcttgttatatcctcacatggcacagagctcaaagaagcaagctttcttgggattctaaggtcttaatcccatgtgtgaaggctctacccccatgacttcatctaaaccctattacctcccaaagcccctctcctaatggcgtcacatagataagtggggtatcaacatatggattcttttttttttcaataggtttttggggaacaggtggtgtttggtgacatgaacaagttctttagtggtgatttctgagattttggagcacccatcacctgagcagtgtacaccgtacccaatgtgtagttttttattcctcaccaccctcctaccctttcccctgagtccccaaagtcccttgtaacattcttatgcctttgcatcctcacagcttagctcccacttatgagtgagaacatacgatatttgattttccattcctgagttacttcacttagaataatggtctccagtttcatccaggttgctatgaatgccaatatttcattatttatggctttttaaaagtaatgtttttttaaaacattatttatgctttatggctcagtcgtattcatatatatatgaatacacaccacattttctttatccactctttgactggtgggcatttgggctggttccatttttaattgtgaatggtgatgctataaacatatgtgcaagtatcttttttgtatagtgattttttttccctctgggtaggtacccagggcacgattactggatcaaattgtggatccacttttagttctttaaggaatctccacactgtttttcacagtagttgtcctagttttccttcccaccagctgtgtaaaagtgttcccttttcaacacatccacgccaacatctattatttttttttaatttttttattatggccattcttgcaggactaagagggtatcacattgtggttttgatttacatttccctggtcattagtgatgttgagtattttttcatgtgtttgttagccatttgtatatcttcctttgagaattgtatattcatgtccttagctcactttttggtgggattgtttttttgtctagttgatttgtttcagttccttgtagattctggatattagttctttgtctgatttatagattataaagattttctcccactctgtgggttgtctcttcactctgctgattatttcttttgctgtgcagaaagaagctctttagtttaattaggttccatcaatttatctttgtttttttgtttttttgttttttttgcattttcttttgggttcttggtcatgaagtctttgcctacaccaaggtctagaagggttttcccaatgttatcttctagaatttttatagtttcaagacttatatttaggtttttgatccatcttgagttaatttttgtataaggtgagagatgaggatccagttttcttcttccacatgtggcttgtcagttatcccagcaccatttgttaaatagggtatactttccccactttatatttttgtttcctttttcaaagatcagttgactataagtatttggctctatttatgggttctctattctgtggtctacatgactgtttttataccagtaccatgctgttttggtgactatggccttatagtataggttgaagtagggtaatgtaatgcctctagatttgttattttcacttagtcttgctttggctgtgcagattcttttctgatgccatataaattttagaactttttcttctagttttctgaggaataatggtggtattttgatggaaattgcattgaatttgtaacttgcttttggcagtatggtcattttcacaatattgattctacccatgcatgagcatgaaatgtgtttccatttgtttgtgtcatctatgatttctttcagcagtgttttgtaattttccttgtagaagtctttcacctccttgattaagtatattctaagtttttttgttcgtttgtttgtttgtttttgcagctatcgtaaaaggagttgagttcttgatttgattctcagtttcatcactgtgtatgtatagagctactgatttttgtacattaattttgtatcctgaaactttgctgaattcatctaccagttctaggagctttatgtatgagtctttagggttttctaggtatagaattatatcatcagcaaaaacagtttgacttcctctctactgatttagatacactttatttctttctctcgtctgcttgctctggctaggacttccagtactatgttgaatagaagtggtgaaagtgggcatccttgccttgttccagttctcagggcaagtattttcagcttttatccattcagtataatgttgactgtgggtttgttatatatggcttttattaccttaaggtatgtccttctatgccgattttgctgaggattttaatcataaaaggatgctggattttgtcaaatgttttttctgcatctattgagatgatcatgtgattttcattttaaattctgtttatgtggtatatcacatttattgacttgttgatgttaaaccatccctgcatccttgttatgagacccacttgatcatgatggattatctttttgatatgctgttggacttggttagctagtattttatcgagaattttttgcatctgtgttcattaaagatattggtctatagttttccattttgttatgtcctttcttggttttggtattagagtgatactggattcaaagaatgatttagagaggattccctctttctctttctctttctctaaaaatattgtcaataagattggtaccaattattctttaaatgtctgattgaattcaactgttaatctatctggtcctggacttttgttgttgttgatgataactttttaattaccatttcaatcttgctacttgttattggtctgttcagagtttctatttcttactagtttaatctaggagggttgtatatttccaggaatttatccatctcctctaggttttctagtttatgcatgtaaagattttcagggtagccttgaatgatcttttgtatttctgtggtagcagttgttttatttctaactgagcttatttggatcttttctcttctttttttggttaatctcactaatagtctagaaattttatttatcttttcaaagaaccagctttttgtatcatttatcttttgtattttttgtttgttttgatttcatttagttctgctctgatctggattatttcttttcttctgctgagtttgggtttggtttgttcttgtttctctagcctccttgaggtgtgaccttagacagtctatttgtgtctttcagactttctgatgtaggcatataatgctatgaatttccctcttgtcactgcctttgctgtatctcagaggttttgatacgttgtgtcactattatcattcagttcaaagaaatttttaatttccttctggatttcattgttgacccaatgatcattgaggatcaggttatttaatttccaggtacttgcatggttttgagagtttcttttggagttgatttcaaattttattccactgtggtctgagagagtacttgatataattttgattttcttaaatttgatttgtgtcttatcatatgatctatcttggagaatgttccatgagctgataaatagaatgtatattctgcagttgttggttagaatgttctgtaaatatctgttaagtccatttgttccagggtatagtttaagtccgttgtttgttgactttctgtcttgataacctgtccagtgctgtcagtggagtattgaggtcccccagtattattgtgttgctgtcaatctcatttcttaggtccagtaagtaattgttgtataaatatgggagctccagtgttaggtgcatgtatacttaggattatgatattttcctgttgcactagtgcttttatcatgatataatgtccttctttgtcttttgatatggtttggctgtgcccccacccacatctcatcttgaattgtagctcgcacaattcccacatgttgtgggagggacccagttggaggtaattgaatcatggggtgggtctttcctgtgctatacccatgatgttgattaagtctcacaagatctgacggttttataaaagggagttttcctgtacaatttctctctttgcctgctgccatccatgtaagacatgactttgcacctccttgctttccaccatgattgtgaggcctctccagccatgtgtaactgttagtcaattaaatctcttttctttccacgttacccagtcttgggtatgtctctatcagcagtgtaaaaatgaactaatacgtcttttttaactgctgttgctttaaagtttgttttctctgatagaataatagataacccagtgctcttttggtgttcatttgcatgaaatacctttttccacccctttaccttaagtttatgcaagtccacatgtgtcaggtgagtctcttgaagacagcagctacttggttggtgaattattcattatgccattctgtatctttaaagtggagcatttaggccatttacattcaatattagtattgagaggtgaggtattgttttattcatcatgttatttgtttcctgaataccttggtttattttcattatgttgttgttttataggtcctgtgagatttatgctctaaggagattctattttggtgtgtttcgaggatttttttcaagatttagagctccttttagcagttcttatagtgctggcttggtagtagtgaattctttcaaaatttgtttgtctgaaaaagattatctttctttcatttatgaagcttagtttcactagatacacaattcttgcctgacaatgtttggtttaacgaggctaaagataggactccagtcccttctagcttgtagagtttctgctgagagatctgctgttaatctgataggttttcctttataggttacctcatgcttttgcctcacaacttataagattatttcctttatcttgaatttagataacctgatgacaatgtgcctaggcagtgatccttttgcaatgaatttcgcaggtgttttttgagcttcttgtatttggatgtctagatccccagcaaggtcagggaagttttcctcagttattccctcaaatatgttttccaaacttttagatttctcttcttcctcagaaacaccaattattcttaggtttggtcatttaccataattgcaaacttattggaggtttgctccttttttaaaaattcatttttctatttctttgtcagattgggttaattcaaaagccttgtctttgacctctgaggttctttcttctacttgtttgattccattgctgagacttgccagtgcattttgcagctctctaagtgtgtccttcatttccagaagctgtgattatattttattttttgctacatacttcactggagagttttccattaatatcctgtatcatttttttgacttctttatgttggatttcacctttctttggtgtcttcttgtttagcttaatagttgaccttctgaatggtttttctggcaattcagagattttgtcttggtttggattcattgctggtgagtaatgtgatcgtttgagggtgttaaagaaacttgtttttgccatattaccagaattgttttctggttcattctcatttgggtagactatgtcagagggaagatctgggactcaagggctgctgttcagattattttgtcccatgggggtcctcccttgatgtggtgctctcctcttccccttagggatggggcttcctgagagccaaactgcagtggttgttatttgtcttctggatctagccaaccagtagagctactgggctccaggctggtactggagagtatctgcaaacagtcctgtgatgtgatccatcttcgggtctttcagccatggataccagcagctgctccagtggaggtagcaggggagtgaagtggactctgttagggtccttggttgtatttttgttacatgctctggttttgcttttgctcgcctccagccaggaggtggcacgttcaagagcacatcagctaaggcagtataaggaggatcaggcagtgggcggggcatacagctcccaagagattacatcctttgtcttcagagttccttgactgtcccatggagcctgtagcagcagtctacctctttcaaagggtctgtggattcttttggctttcctggtatgttcctgcagtagttcttggagcacaagtttacaatgtgggtctccacatgctgctctgtccatctaagtgggagctgcaagttggtccttcctcctatctgccaattttcctccattctcaacatatggattctgaggagatgacaaacatttaatacataataataagatttaataaaatcatgattttataagcagatagaaaagcctgacaaggggaaatattactaagagagtacatctcaaatgttaccataaaaatgtgaaatactggccaggcgtggtggcttatgcctgtaagcccagcactttgggaggccgaggagagcagatcacctgaggtcaggcgttcaagaccagcctgggcaaggtggtgaaactccatctctactaaaaatacaaaaattagtcgatcatggtggcaggtgcctgtaatctcagctattcaggaggttgaggcaggagaatcacttgaaactgggatgcggaggttgcagtgagctgagattccacgccattgcactccagcctggaagccaaaaatgaaactccattaaaaaaaaaaagtcaaatactgaaggtgataaataggttaattaccttgatctaatcatgccatattgtattgaaaaataataacatcactttttgtcccataaatatacacaacaataatttgtcaatatataattaaaaagaaaaagtgatttctagaagatgtttggaaggaaatcagatggtaaatcatatttactatgtctttaataatttcacactgtagccgtttcatgttttaaaaattgtaataaaaataaaaagtatagttctatacttaaattttttcattgaatgttgaactgtccactatgagggttgtggattttagttaatctttcactttggaaatgcctttgcagactaaattttgtttaagtgcacgagttgtgagtaagcctgaaaatagtttccttttttctaattttgcataaaagtgacataaatgccagctgctgcagctcagagcaaagaaaacagataatagatacaggaaccagtaaaacaatgctttcagagaatagtgctgtaaagaaaataaattaagataataaatggtagggcatattttagggcaatgttatgtaattagtaaaaaatggacattccactgaagctcaaagagctacatgttgtatgattccatgaatatatcttctagaaaaggaaaaattataagaacacaaaacagatcattggtttcctggggcatgcagcagcagaagaggtggactaccaagaggcacagtgaggtgttatgggagattagactgttctatgtcttgattgtggtggtaattatattatgtgtttctcaaaacttgcagaattgcaacataaaaagggtacatttttactataaattaattaggaataaaaactaatgaaaaggaaaaacaatgtcctgagaacaggatatatgacttgagatgcgaatgatgaatcccaggcagatggatctgcaagtgaaacctaagccagaacatccttcgtttgtttgagaaacaggaaggcaagagtcgtgtattagttctcatgcggctaacaaagatgtacccaagactgggtaatttattttaaaataggggtttaatcgactcacagttctgcatagctggggaggcctcataatcatggtggaaggcaaaggaggagcagagtcacgttttacatgacatgagagcttgtgcgggggaattcccatttattaaataatcactactacgagaacagtattggggaaatcacctcacgattcaattatctccacctggccccacctttgacatgtggggattattgcaattcaagatgagatttggggtggggacacagccaaaccatttcaggtggcctgagtctcctaaggaaagcaagggtgggaaataatgagatcaggtagcagatggaaactgaacacgaagacatagtactgtgcctgaaataagcttctgtgaattttctgctaatgtagaaggtcattctaggtcctagacagccttgaatctagaggaagaaagagatgacagaagctagataaatggagtaaagaaaaacatccgttgaatataaatccttccttccatggatgccactgccacccataatagaaaatttcatctcattgtaccctttcagaatgatagatatcacatcagacccacccagtaataatgccagtagtctgtttatatgacatgcacaatcattttaaaatcatacacatatatatataaaacaattgtctgtttaaacttaaagataatattgagatatattaaatgtacatttctgccctgtaattccttcacatgttatatgctatgggcaaagaaaacttaataaaggaaaaaaaaaaaacgccactttcagccttttcagttttctcttaggacaaaattgattttgcttttattgacattgtatagattgtgtcaaatttgcatagtaattctaagcctttccagttaattgacttttatatacaatacaaaaaagtccccccatgtcctgaacgtagtggtgaggcaagtcatttgagtgaacacctgcactcctgtatcaatatatatggttgttttgggaggttaatcaatcaatattttaaaataaaaaggtaaagaaaacaatgataaatatcctaaagacctatgaataggtgagaattgaagagaggcagtatggaattgcagtgtatagtgagaattctaaagttagaaaaacaggattcaactttcatatgccacatattagctctgcgattgtaaaaatgttacttaattcctctgattctaatttctcatttgtaaattggaagtaataataaaactatagggtttctttttgaaaataaaatgagatgcagcatttaacacattgcctggaacaggttaactgttagtttctattacttagagcagcacattgagataactcattaaaatatatctaatattttttactctacgggaaatgggagaaaaaaagacgagtatgtaaaaggttttacttcttaagtgtattactagagtaaagaccacaggaatgcatgcttgacaacataagggaaaaatgttttcaatcacattttaagacagcatagctgatgtagaagggtctagaaaagtcatgcagacaaggtcatgcagaaaattccagccttgactcttttggctgggtgatctggggcaagttgcttaatcttttaaagctcagtttcctctctgtgttttaggaataataaaagtactttccttaaagggtggttgttgagaattaaaagagaggatgtttagcatagtgtctggtacactgtcaaggtttaggaaatacagggataagcagaacatgctggtatgcatgaaggtagcatttacttaacacatgttcactgagtgtttactatgtatggggcattgtgatgaagtttgtaagaaacatcaagatgcacaaggcatcatctctgctattatacagcattcactactttagaaattgatcttcctgacagaagagattgggtttcgttctctgtattctcattgcttggcacagtcgctagcatataatatgtgcttagcaatatttttaaattgagtaactgtaatgataaatacacacacctcctttctaatgaaaactgagtttgaggaaagaaaaattgaattcccttcaagggagaaagagatctcactctttagtggctgttttacctgcttccaacagtattattgtttggctgcttttatttgttgtccgctactcctggtggattttgctcctgttattatcgcattcgtcattataattacttctgacccaaccacaaataggtcctctaatttgatcaagatctctctcgatctttatgcaccaagctcatttatttagtatattggctttcaaagtgtagtgcctggataaacagcatcagtatcacctgggacttgttagaattgaatattcctgggacctatcccagacttactgagtcagaaactcaggaggtgggtcacagaatctgtattttaatgagccctcccagcaatcctgatgcactcaaacatttaagaactgctttcatagcttcccccaactgttgtctctctcttaaagtatatgttttttttcttctgccgcggttcttggaataaattatagaacttgagctgaatgaattcttgtaactaaactgaacaatgacatccctgccatgttctgtcccaatagtgggttccacagagtgccaggctgacactcaggccttgtcaggtttcttgtctctagatccatttctgacctttccaagttgtcacctataaaattagattttttttaaatttttatctttctttaagaaagttgatcctggtgtctagaggtctaattctgcaccacagatcagtttcactgtctggtgacttaaagagtcttaatgctgttggactctgttatgttattccattcactgaggtaggcatggaatccctacagcctccctctctgattcacaaatcacaaagtatttagcaatatatggtagatttataatgttcataacagttagtcaatgtgagacattcagcagccagagttcactttccttaggaggtcagcagaggagacttcttggtgatgtcatcacacttgtcttgaaagacctttgagggccagccactattactaaagaaaaaagtataaggtgataaatagagtaatagtgagataaatatatcactctattctcaggagagtaggaagtcagatgatcttacctaactatttgacctgacactattttttgaaaaaaaattctaatcttaattgtagttctcatttaaagacctgaagagttttttgtttgttcatttgtttttgttttttatatttgtgcttaagctatttcaaagcttatgaatggaaattattttataaatcttttgattcatagaagtttcaacccataacactgaaggaaaatattggcatgccaagaattgtgattccatacaggaatagaatgtcatgcaaaaaaaattaaaaatgtatgttttctgattaatatgccatattcttattttcctggacctttaaaaatcataagaattgctatggatcagcctcacacaccactctttggatggttgtaagttctagtagaagtacatagtgctgacccttttaaaatttctctgttttacacagagaatataataatatatgcacccatattgacttctcttacattttttttctgaaaataatgagtacatctactgttgaagcaaatgcaaagattaatcacttgtaattttcccatcatatatataaatcgcacctttatttctggctttcacagaaagtaagtttcaaaatgagtttcaataaatacatattatcaaagttaaacatgagaatgaatttactttcattaaaaatcaatgttggacattattattaagaagagcaaggtgacaaaaatgtagtggaaatcaatgttggacattattaagaagagcaaggtgacaaaaatgtagtggaaacatccaaatagtcaaatgatctattgttatgaatttacctacgttaaattgatcatttgttaattatgttgttatgttaattatattatgttaattatgttgttaatttgatcattagtgagggaggaagatccagtagttaaagaaggcggggatgctaactgtccttgctatgtagtatgtcacaaggaaaactggtctcagagcaaataacattaaaagcaggcataacaagtgtcataccactctctaagctctattaaattccagatcctgttctttttgatgctctgacaacaccttgaatgtttacttgagatataattcataatattgtagcagcaacattcagctaaccttttggtcaaaatcagggcacatacaaaatctccaaataagcttccgaacacactgacaattcaattctcaaggttaaggtgacaatccagagggctgtaagttattgagatctctgggtccctctacttcattcttttgtgcagaagcaattgtatggcacttctatcttgtccaaactggaagaccagccgtttcactattcaatttgaaagtatgcttatgttatttatcaagcctctagccttgattggagataataatactcaaatgcttatagtagctgactgtggtacatggcctttggattacaattctttagttgctagctaaccaatctttcagaatattttattattaaataactaaccatgaattcttatatttctgattagtacgtttcaaattgtatattaaaaccaatctgctgtgtacatttgtgtgtgtgtgtgtgtgattcattgacaatataacaaaaattttaactttcttgaaaaggatactcttctcctctaacagtactcttctttagtctgtttttagctgtcagtactttgtgtagaaaaatttcctctgatatttgtttataattccaactgagtttatgtctgaatttgaactttttaaacttttccatgaattagactgtgagtttcctaggtagtaagcttttgagcacttatcgtgatgcctgacaaattacagatcctcaataagtagttgtggaatgaatgaatgaattcttgaacgggcctccttccacaattttagtactcagtctattacccaggcttgtgatctctgaaatattttgtagcttttgaatgttatctaacaaaacaatttttaaaacaatcaaaatatttaagtgacttttgttacagtaggaatgatataaagtctatgaattaaatttcacctaaatataaatattacaaagttgtaagggagctcttctagaacaaaaccaaacaaaaaagtagtttatctgtatacaatccaaaaatatggaaatcacttttcttgttcaaagataaatacattatcaaaaaatgtgatacattttagagcttctattgctcaatggatatgggaataaaataagaaaacacaaataacttcgattcagcctttaaccccgaagccacatgtttccactaacaagaagaaatccttgagagaaactttcagcaaaaagaatgttgacagaagagctttgagttagtcctgggtctttgcttaatgagataaagaagcaatcttggcagacaacttactgtaaaattccaacagtctttctcttttcatgtcatcaaaactttaattttctaaatctgtttactgggaagggcaaagagttctcctgtaagacttagatgtgtattttaagttccaagaactgatgagttataaccttgaaactgggaaagctttcacatttcttaaaatgtattgtagaaaactgttttttagtctcttaaagttgaaaactgtatttgctgaaagaggttggttttgcttaccatcatgtggcaatttatcattgaccatgacccagtgatctagctatgattaagtaaatctgatttaaaaagtctgcagtttctccagaattagaaatatatataatgatatttcccttgaaaaacttattttgtaagtaaaagcagtatctaatagattaactttaaaacataatgtaaaatctttttgtgtaaatacaatatacaatttgtataaagatatacaatatacaatttgtataaagatatacaatattactcctggaataatagcatgcatgcactgcctttttttcgttaaggtaacacatttctatgacatttttaagaagaaattgttttaaaatatctatgctaaaaacatcattacttttcttggtcctaaccctgatcaccagtctctggaagcaatcactttcactttaaatgtgtgtgtgtgtttgtgtgtgtgtatgtatacatgtatatgtcttgggcactttcttcagagaatttcacaggtgtaaatggaataatcaggacatatctatatctctttatatatttctatagagagagtgtgtgtgtatacatatgtatatatagttacagtgtatatatagagaaagttatataatgtgtgtgtatatatatatatatataaatatatatatgtatatgcatataattttccttataaaatatccctcctgtagtcctccatcctcctgtttctacctgcattcttcactgcctgggctggctactcctggtatttctctttgtcattgccctgattatgagaggctaaacaaaagtcatagatactttgtaaaacaatgaccagtgtaaaaataaaaagtaaacaagtgtccaaaagttctaatgggtgaataatattcaactgtattgttttaccataaattttgcaataaaatccctgtcattatcatttaagttcctctttacttactaacatttctctaaacagtcttgcataaaattgatttgtgtaattttctaagcactgtggatatggatatgtttccatggcaaaattttaatgttggtcgttctgggtgatgtgttcataggctattttattttaatgataaaatttgttcaattcgggactcgcagccaagatggccaaataggaacagctccggtctacagctcccagcatgaacgacgcagaagacgggtgatttctgcatttccatctgaggtaccaggttcatctcactagggagtgccagacagtgggtgcaggacagtgggtgcagcgcaccgtgcacgagccgaagcagggcgaggcattgcctcactcgggaagcacaaggggtcagggagttccctttcctagtcaaagaaaggggtgacagaaggcatctggaaaatcgggtcactcccaccctaatactgtgcttttccgacaggcttaaaaagcggtgcaccaggagattatatcccgcacctggctcggagggtcctacgcccacggagtctcgctggttgctagcacagcagtctgagatcaaactgcaaggtggcagggaggctgggggaggggcgcctgccattgcccaggcttgcttaggtaaacaaagcagccaggaagctggaactgggtggagcccaccacagctcaaggaggcctgcctgcctctgtaggctccacctctgggggcagggcacagacaaactaaaagacagcagtaacctctgcagacttaaatgtccctgtctgacagctttgaagagagcagtggctctcccagcatgcagctggagatttgagaatgggcagactgcctcctcaagtgggtccctgacccctgacctccgagcagcctaactgggaggcaccccccagtaggggcagactgacacctcacacggccgggtactcctctgagacaaaacttccagaggaatgatcagacagcagcattcgcggttcacgaaaatcctctgctctgcagccaccactactgatacccaggcaaacagggtctggagtggacctctagcaaactccaacaggcctgcagctgagggtcctgtctgttagaaggaaaactaacaaacataaaggacatccacaccaaaaacccatctgtacatcaccatcatcaaagaccaaaagtagataaaaccacaaagatggggaaaaaacagagcagaaaaactggaaactctgaaaagcagagcgcctctcctcctccaaaggcacgcagttcctcaccagcaacggaacaaagctggacggagaatgactttgacgagttgagagaataaggcttcagatgatcaaactactccgagctacaggaggaaattccaaccaaaggcaaagaagttaaaaactttgaaaaaaatttagacaaaagtataactagaataaccaatacagagaagtgcttaaaggagctgatggagctgaaagccaaggctcgagaactacgtgaagaatgcagaagcctcaggagccaatgcgatcaaccggaagaaagggtatcagtgatggaagatgaaataaatgaaatgaagcgagaagggaagtttagagaaaaaagaataaaaagaaacgaacaaagcctccaagaaatatgggactatgtgaaaagaccaaatctacgtctgactggtgtacctgacagtgatggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcaattcaccaaagttgaaatgaaggaaaaaatgttaagggcagccagagagaaaggtcgggttaccctcaaagggaagcccatcagactaacagcggatctctcggcagaaactctacaagccagaagagagtgggggccaatatgcaacattcataaagaaaagaattttcaacccagaatttcatatccagccaaactaagattcataagtgaaggagaaataaaatcctttacagacaagcaaatgctgagagattttgtcaccaccaggcctgccctaaaagagctcctgaaggaagcactaaacatggaaaggaacaactggtaccagccactgcaaaatcataccaaattgtaaagaccatcgatgctaggaagaaactgcatcaactaacgaacaaaataaccagctaacataatgacaggatgaaattcacgcataacaatattaactttaaatgtaaatggactaaattctccaattaaaagacacagactggcaaattggataaagagtcaagacttatcagtgtgctgtattcaggaaacccatctcacatgcagagacacacataggctcaaaataaaaggatggaggaagatctaccaagcaaatggaaaacaaaaaaaggcagggtttgcaatcctagtctctgataaaacagactttaaaccaacaaagatcaaaagagacaaagaaggccattacataatggtaaagggattaattcaacaagaagagctaactatcctaaatatatatgcacccaatacaggagcacccagattcataaagcaagtcctgagtgacctacaaagagacatagactcccacacaataataatgggagactttaacaccccactgtcaacatcagacagatcaacgagacagaaagttaacaaggatacccaggaattgaactcagctctgcaccaagtggacctaatagacatctacagaactctccaccccaaatcaacagaatatacattcttttcagcaccacaccacacctattccaaaattgaccacatagttggaagtaaagctctcctcagcaaatgtaaaagaacagaaattataacaaactgtctctcagaccacagtgcaatcaaaccagaaatcaggattaagaaactcactcaaaaccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaaaagaaagcagaaaagatccaaaactgacaccctaacatcacagttaaaagaactagaaaagcaagagcaaacacattcaaaagctagcagaaggcaagaaataactaaaatcagagcagaactgaaggaaatagagacacaaaaaacccttcaaaaaattaatgaatccaggaactggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattccttgacacatacaccctcccaagactaatccaggaagaagttgaatctccgaatagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacactgatgcaaaaatcctcaaaaaaatattggcaaactgaatccagcagcacatcaaacagcttatcaccttgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggatgtatggcaaaataataagagctatctatgacaaacccacagccaatatcatactgaatgggcagaaactggaagcactccctttgaaaactggcacaagacagggatgccctctctcaccactcctattcaacatagtgttggaagttctggccagggcaattaggcaggagaaggaaataaagggtattcaattaggaaaagaggaagtcaaattgtccctgcttgcagatgacatgatagtatatctggaaaaccccattgtctcagcccaaaatctccttaagctgataagcaacttcagcaaagtctcaggatacaaaatcaatgcacaaaaatcacaagcattcttatacaccaataacagacaaacagagagccaaatcatgtgtgaactcccattcacaattgcttcaaagaaaaaaaaatacctaggaatccaactcacaagggatgtgaaggacctcttcaaggagaactacaaaccacttctcaatgaaataaaacaggatacaaagaaatggaagaacattccatgctcatgggtaggaagaatcaatatcgtgaaaatggccatactgcccaaggtaatttatagattcaatgccatccccatcaagctatcaatgactttcttcacagaattggaaaaaactactttaaagttcatatggcaccaaaaaagagcccgcatcgccaagtcaatcctaagccaaaagaacaaagctggaggcatcacgctacctgacttcaaagtatactataaggctacagtaaccaaaacagcatggtactggtaccaaaatagagatatagatcaatggaacagaacagagccctcagaaataatgtcgcatatctacaactatctgatctttgacaaaccggagaaaaacaggcaatggggaaaggattccctatttaataaatggtgctgggaaaactggctagccatacgtagaaagctgaaactggaacccttccttataccttatacaaaaattaattcaggatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctagtatccagaatctacaatgaactcaaacaaatttacaagaaaaaaaaacaaacaaccccatcaaaaagtgggcaaaggacatgaacagacacttctcaaaagaagacatttatgcagccaaaaagcacatgaaaaaatgctcaccatcactggccattagagaaatgcaaatcaaaaccacaatgagataccatctcacaccagttagaatggcaatcattaaaaagtcaggaaacaacaggtgctggagaggatgtggagaaataggaacacttttacactgtgggtgggagtgtaaactagttcaacccttgtggaagtcagtgtggcgtttcctcagggatctagaactagaaataccatttgacccagccatcctattactgggtatatacccaaaggactataaatcatgctgctataaagacacatgcacacgtatgtttattgcggcactattcacaatagcaaagacttggaaccaacccaaatgtccaacaatgatagactggatgaagaaaatgtggcacatatacaccatggaatactatgcagccataagaaatgatgagttcatgtcctttgtagggacatggatgaaattggaaatcatcattctcagtaaactattacaagaacaaaaaaccaaacaccgcatattctcactcatagatgggaattgaacaatgagaacacatggacacaggaaggggaccatcacactccgtggcctgttgtggggtggggggagggggaaggggggagggagagcaataggagatatacctaatgctaaatgacgagttaatgggtgcagcacactagcatggcacatgtatacatatgtaactaacctgcacattgtgcacatgtaccataaaactttaataataataaaattaaaaaaaattgttcaattcaaattttcaacaatggacatgtattcgcatttataattttgaaaagaaaaaaatggacaatggtatttttatactattttaagctccccaatggcagacattattttcactgaatcatgaccaagtcaagttcagtgctgggaagaggggacttacattaaatatataatcagttacttccaggctctgcctcttattggataaggatagacactgtgacatcagagatcaccgtgctgtggaccgaacaaatgccatgtaaacagtgaccatgaccttttatgatcactgtctttctggaatttgacaaactcagagaaaagtttagaggaatgtatagactaaatagtccatttgctattgtgacattgatgatgaaacctttaagaaacttttgatttaaaatgtgttcatgaccttgtgttcataatttcacaattgagaggcgtccctccacattcttggaactgtgcacccattggaacctttaaggtaaatctaaccagggaagtttctcctcagaagaagatggcatccttgatgtgaacagcttttcccaagatcatgaatcaagacttctgtactatcttgagactcttatctttgagtaatttttccccttgtttaggcctctatgaacaatagaaatgaaaagaggtcttctgtgtgcacttactgggtatacttttacttgtgaaggatttggcagccagacttatatgtagataaccttatattttgatagataaaatatgaaagcccaatgtaggtgagagacttaaatggtacatacgttgcctcataatcagtcagaaacagaactttggttcactccctttgacccacatcatgtgttaaagagaaggttgccaggaggccttcactcttctagaagggcatcatttgttaggtactttttccatggtttggagtaaaagaagcaatgattagaaatgtatccctcatgataagctgtctagcaaactctactttaaaggctataattacacagcagattttaaattctcttgtgaaagttatgctaaataatcgaattgctttagattgctgactggctaaacagaagtatctgtgcagctgctggcacttatgtcttgtggagaaagcattgggtattacagacactcagttgtaggggattaagaagaggactacttaatcaagcgagtaaactctttatctagctcattctttgatctatttgattttaagtgatttggtttatggagaccctagtagggaccatactttcaactcttggtgttatcctcccgatagtcataatagaagtctccctggtgtgctgtatgctctcaaaggttttaaatgtttgcattcagacatctccagaatgtcaggtagtctctcttcaacagaaatgacaagagctgaaagaactatgcaaccatgggaaaaccgtaatctatgaatgaggtgctaagaccggaaacccaaaatgatggtaactgagagtagcattaaggccctaaagtttggtcacactctcacctaaatgagaacctgaccaaaaagggggaattcttaaaacaaaattacgggaggctattgtttggactgagctcaatcactaggcaccaacagaagaaactgtataaaaatggagtcacttgtgctaagtgtgacataatcaagctaagactttaaggaaacacatagatcctagaacagacgaggttttgtttttctcctgcaaacaggacgtttctgtataaggaggtaccatctactcaatcctcattcccaccttgcaaaacccactgttctactgttttccagtgggtttcaagaccaaataagtacatttacgatggtgatagtgacatcgatgaataaagttttggccaatctctcaaaattgagaaaatgaccaaaagcggggaattgttaaagcaaactaactgtggcctaagaaggactccttacttttatatctgagtccttgtggatgaaccataacctaacttaataggtagacaagattgaaaacctgacttagaagtatgggattgtcacaatatctgaatcttggcaaatcccagcagccatacttcaaccagtcatagactgctgagtgtttaaactgtgttcaaagagggcaaacactgaactgtaaccaatccagttgtttccatacctcacttccaatttctgtaggccacttcccttttatgtctatagatcttcttccaccatgtggctgtactagagtctctgtgaacctgctgtgattctggaggctgcctgattcacgaaggtttcattgcttcactaaactcctttaaatttaaaataaaataaaatgtgttcatgaacatgagttctaggttggttttggcagttttgtaagatcaataaaagcttcatttaatttatttgaaaacagtgtttaggaataccccaaagtatgttctcacatcgagggatttagaaagtgaaaaccggccgggcgcagtggctcatgcctgtaatctcagcactttgggaggccaaggcaggcggatcacgaggtcaggagattaagaccatcctggctaacacagtgaaaccccgtctctacttaaaaaaaatagaaaaacttagcagggtgtggtggcacgcgcctgtagtcccgggaggtggagtttgcagtgagctgtgatcacgccactgcactccagcctgggtgacagggtgagactcttgtctcaaaaaaaaaaataaaaataaaataaaataaaataaataaaagcgaaaaccgactgttaatacttgtacactttcaaaatgatgaatattttaaagtttaagttgttctcactagagttaactccaggatttctttatttctgttaagaagaggaaaccttgctatgggtagtgcttttctcacaagcttttctcacaggggcacttgcctgaaattatgtggtttattttggtttataaaaagtggctgggacaaggctgcaaaggttggtagtaaagtacctgacacctgccctggaaacttccattggctcttgctcttacttttattttattaaaaaaatgcacgtgtaagagagatggtgttgaatatgttgtaattataaataatgccaacctaaaataattaaaaagggttagaatctagtttaataagagtttattcaagcacaaagtttgaagacagccactcaggaagcacaggttacaaagactaaaagtcagtgttctgatggtagaagcttagggttgtttatagagacaaagtttaaggaagctaaaaagaatttcaacatctttctgtacaaggctggatgcatatttacaatgatctgattagttgagactgtatttttctttcaggaagggtatatttaacattccaccctgaagatgtaacagtcatgaggtcgtttgaaccatctggtctgagttaggtacatgacaataaaagaggtagttaatctataacaaagataagtgaattgaaggggtaagatgtctgatctctagtctcccctagtcatttacagagcaagaacaatgaagaagagagtaaatctataatctaagaagctgaacttgcacacatactatgtgactcatctccaaagcttaactttccccttggcgtaataaattaagagcgtcctaaaattacaatccacagataagtatagatacagcgctttatatgtgtgtgtttatatatatctctctgtatatttacatatataatatataagtagtagaagtagaagtagttttatatattatatatacatatatgtgtgtacatgtatacatgtgtgtatacatatgtacacatatatatgtatatataatatataaaactacttcttttgtacattgtattctgcttctaagaatgacatcactgcaaaaacaaatccctccactccacatccatgttacagtgaaacatttctcattaatgctccatcacttattaatttaaatgttagattctgtttagggtattatgtttataatttttattctgattgccatgtaaaaatatttcgttaaaatattgtaaagtatttttgaaatgtcttgctaatcttattattctgtatattccttattagcccatcagcttctcgagggacaaaaaattacgcatttcatttttattttgtgtgctcaaatctattgtcttattcatcattcaacaaatatttattgagcttacgatataccaagccaagcattagatattggtagtcccagaaatctaacaatcctgatgaattgagtgattattgaaagtgaatttacaaattcatcatccttctatctaagttttagtgcagaaagacattgtcaatgcaggctagcctttactgtaggacaaatggaaacctgacatttacaagaaaatataatttcataatgtatctaggaggaaaaatatttatcactgccaacccaggaaaaaatagaaaacttaacaaatgctaggtattgaccaaagaaacacatgatcaactgtaaatctacccccaaatgagaaaaaatgcattttttcttctactagtagctctaagcaagcggcagtctacaatgttttttcttgttctatagtatgtttcagaaactcacaataggagttcgttttgaattcttctgtgtagctcattttccatttggggaatctatttcttatccatttgtccacatctataactagcaaatagagaattcaatatagcaaatgtgcctacagtaaattcaaaattgcctctcatccatttgtgagcaacacataaataatgaaggcgacattaaaacttcgggtttttttatttttacttctttctctgaaatatcttttccagcaaaataaatggtttgaaataattatctatttagaagcactgcaatagctgtgggaatgtgattgccatttacctttcaggattttacggttcccatgagaagaagaaattttttgattccttgattctcttttccttcattatacttcattcttaacccatcagttttttaatttgcctgtaatagatggggctcagtgtctcaagagcatcccaattttatggttatagaaaccagacttagtagacaaaatgtttccttttgagcaaagacttagtggttttagcacctacaaaaaaactaaaggaataaaatggaaatgcaagggaaaccaaaatgcattaaaggttaaatttttcaatatttgtatttctttcttaacttggcacaaatgagattttttttcagttttttacattttatttttgactgctttgaatagtgtcggcttgccaaagtctcaccggactaatgcttacagcagaatttaacacattgccaaactaaccctgaggtgtggtttacactacagaaaagagtgttttggcacaattgccaatttagaaagtacgaaaggagtggcagaacttattgccatagagttagaattttacatctatactgcctattttttaaaatttaatatttcattgatgtcacgaaaaacattctcatgcgtcatattttggtccctttctttttttatttttattatttatttatttattttttgagatggagtcttgctctgtcgccaggctggagtgcagtggcacgatttgggctcactgcaacctctgcctcccgagttctcttgcctcagcctccctagtagctgggattacagtcgcccgccaccacgtccagctaattttttgtattttagtagagacgggtttcaccttgttgtccaggatgtcttgatctcctgacctcgtgatctgcctgcctcagcctcccaaagtgctaggattacaggcgtgagccaccgcacccagccccttatttttttaacagagtgttaaaggtggagtgtggaaggtcttaataaattatgtgtttgctgtgtgtatgtattaccatattacacatgcagtgataagaagccattctcatgataccttgttggccaaactgggttgaaattgaatttaagctccacagagattgtgactacacattagtgtagtaaatatatatatatacacacacacacacacacacaatatggtgtgtatatatatacacacacactgcactatatatatatacagtcgtatacatacagttgctgtatatatagttgttatatatatgtgtgtgtgtgtatatacatatagagagaaagagagagaaagagagagagagagaattgttatattatcttgctaaatgggccactttctaattatataattaccatctttgtctctttttacagcttttgacttaaattgtattttatctggtttaattctagctattcttgctcttttttaaagtttctatttgcatgagacatctttttccatttctgtactatagttaggtcctatttttttaaaccattcagccacttcttatcttttggttggataatttaattaatttacattcaaagtaattattgataggtaataacttactacactatattgttcattgtttcccagttgttttgaagattctttcttcttctcttactgtcttctttgtggtgattttctctagtggtacaattattttgttgctttttatttttagtgtatcaaagttatttgctttgtgattatcatgaagcttgcaaaagtcatcttacagttataacaggatattttaagcaaaagcaacttatctttgatcacaaaaaagcaactctacactttaactctacttcccctctacatttcaattttggatgtcacaacttttatcattttatattggataatccttaacaaattactgtagtgattactaatttaatagttttgtcttttaaccttcatactaatgatatacatgatttacacaccgccattatagtatgaagatagtctgaactttactttgtattttctcttaccaatgagttttattctttcagatgtttttgtgttaatcttagtgtcctgttctttcaactcatagaaccctctttatcatttcttctaacacaggtttggtggtgatgagctccctcagctttgtttgtctagaaaagtctttgtctcttttttatttctgaagaacagttttcctgggtatgctactcttggttgacagatttttttttttcttcagcatgttggatatattatccaaatcttttctggactgtaagatttctgctgagtgtgtctccagttaggtatattggaacttccttatatgttatttgctgctttagtcttgctgttttcagaattctctctttgtcttcaatttttgatagtttgattttaatatgtcttggggtattcttatttgtatagaatctgaatgaagaactttgaccttcctgtacctggatatttttatcttttcctgagtttggaaatgtttctgctcctatttctttaaatatgctttctattcttttaatatttctctttcctttatttaacttctataactcatatagttgcttttttgatgttgtctcataattcttatgcacactggaatggaatggaaaaataccttcaaaattctatgaagaaaaaatatagatgtaaaattctctacataactaaactatcagtgaaacagtgggttagatgaacaaatttatatatgctggagcctaaaagaaaaaccaactttactcacttactctccctcagcagagagaataagatatgtgaaggcgctcatcaaattcaaataaatgacattacagttattgaaatatataatacatgggagaatgaaagaagattgggaaaaaggagtgaggtacaaggactattacaagaatgtggctgaaaaacagaaaatgtttcaaaatgattgtaactgttattacaagctatatatcagttattattaaaaacaaaaaacttgcataaattaaaataaaaaggccgacactgcagtgggaggaaaaggacaatatatatgcaagaataacttactgaaaagacacaggagtggccaatgaaaaacaaagaatgcatgttcaacctatcattaagaagaataataaatgaaataccacaattacctattgactgagaatcaaatttatgtataatgccaatgttagtgtgttttggagaactgccaatgccaatgttaattgttataatctttccaaaatatcgacattgaatgttgcctgcatcaacactaaaataggcttaatctttgaccttactattccaccttttattataaatgattgggaatagctcttaaaggacattgaaatgtttctattacaacataatttatcacagtaaaaatttagaaatagtgttcatttttacatgttggcttaaaactgtaaaataaaatagagtgtacaattaacccttgaacaatgtgagaattaagggcacagacccccctgtcatgcagtcaaatacccatatataatttttgactcctaaaaaacattatagcctactgttgaccataagccttacttgtaatatagtcaattaacgtgtattttatgtttatgtattatatactgtattcttactttaaagagaaaggaaaatggtattaagaaactcataagaaagagaaaatgaggccgaggcaggtggttcacctgagatcaggaattcgagaccagcctggccaacatggcgaaatcctgtctctactaaaaatacaaaaattagccgggtgtggtggcatgcacctggaatcctagctactaggcaggctgaggcaagagaatcgcttaaacctgggagacagaggttgcagtgagctgagatcatgccactgcactccagcctgggtgacagagtaagattctgtctcaaacaaacaaagcaaacaaagaaaaagagagatagagaaaatacatttacagtactgtactgtatttatcaatactctaagttacatcatctgtttacaaggtgaattgttggtctgaagtagtagcaaccgcagctgcaggcttctgtctatggtacatatcatgccatttagcttttactggtgatgtcatgacttttctctgcttcttgggagcacttcgagcatcactagtggcaccttgtatgggccccatggtgtcattcaagatttacagtattgcactaaaaatgataagaactacaggagaactgagagaaattacttactactgcaatactcaattactggagagataaactgcttacatgaagatgattagcataacacagcattttaggaggatactgacaacaccagctcaccgcaatagcagtaactataaagttattactatagtttaatttgtactatagttaattttatagttatgatttaatactgcacctttacttttgtttatatttctctcaactgcaaatggtaccatatatggtctgcgtttctgtgtgtaagttttgataaatttgaacttttcatactagatttgtgtatcatttatggtagtaaattatgaaatagacgagtatcaacatatattttatatgttcctgacatggctatttttttcttaatttttctatatttctaggctgtgagattcatctacaggtttttttttttcaaattgttgcaaatctccaatcatttttcaatacgtttatttttaaaaatccatgtataatagacctgtgaagttcaaacccatgttgttcaaagatcaactgtagatttttttaattttacagttatcaagcacatttattatgtgttgcatatggtatattgaatcttaattctgtgttatatcttaatttttatgaaacaacctactgtagttataaatatgataataaattagaaaatattcataaaggaataatgttaagtggataaggtaaaatactaagcagcaacgatgacattcctaaacttgcaagattattaatgtagatatacatatgcatagaaaaatcttaaggctgcccaggcgcgggggctcacacctgtaatgccagcactttgggaggccaaggtgggcggatcacgaggtcatgagatggagaccatcctggctaacacggtgaaaccccatctctactaaaaatataaaaaaattgctggacgtggtggagggcgcctgtagtcccagctactcgggaggctgaggcaggagaatggcgtgaacccaggaggcggagcttgcagtgagccgagatcgtgccactgcactctggcctgggcgacagtgcgagactccgtctaaaaaaaaaaaagaaaaagaaaaagaaaaatcgtaaggctatgcatagcaatttaatggtagttgtctcaaggtggtggggttatgaatgatttatgttctgtcttttctgttggcatttctttttatatttttcttctgtgaacacctgttgctataaaaatactcagtgcacgtgataataaacatataaagcattctgtatagtctcactgacatttgaaaaaagcctctaggttttatttctcattgtgatcattgcaatgggcatcagaactgcatgtgtaaaaacgatcttgtctgttcttgttatcgtctgcaccctttatctaacatctgtatcactgcttagctggaagcatctcctttagcacggcactgccatgttttatgttctaatgtaaacttgtgtgacttagctatggttaaatagaaataactggtgtttcagcttgatttttgtaacagattctgaggcacgtttttctgtctcaacccgggaatatccatttctgcaccaggacaaattaattacaatactgatgtttaagtatttatggttagtcaaatcttgaatcaaatcgtaacagaaatggaaaacagaaaataagaagagagaggagaaggggaggaggaaaaaggcgcagcagcaacagctattttgagagattgggaaggatcttaattgaaaaaaattgttctttccccaggcttggtcggcgaatcacttaatccactcatcccttcgtcttttcatagaattaggaaagatatttagctcaggccctagaatcagactaatgctgactcgttcttgtctcgaagggctttctacaatttactgcattcagctccatactattaataataatgttgctgcttttcttaaaatccatgttggaaatgtaagaaaatgtaaagaaaattttatttcatatttcattttacatctccaaagcccccaccatctccagaaagagtacaatgatcattttctttgtctctttatatttgaacaatcatcacaacactaaaactacttcgccgttgtgctaagacctcctcctgcctagattgccaccatggcccaccttctccaatttagaagagggaaaggtggggccaaagagagacctttggtgggttttctaccaataagtttaaaaagatactgaaaaggagacccttccttccttcccttccttccttccttccttcctttccttctttccttccttccttccttctttccttccttccttcctttcttctttccttccttcctcccttttctttctctctctctctctgcttcaaatacactttttattcccctgtagaatcagaaaatatctgactgcttgagtctaaatctaccagactaaggaagcctcggaaaagcttttactatttcctcttccctgtctgtgatttttaaaagcatagaaataaaagttcattgtttttatgttatttgtctaaatatatttccatgatatattttaataaaacattccttaggtatttatagttataggattgatggaacagatataatataaagtaagtaaaaaatcttcatttcaaataaagtatccaaaacaaaaatttgattattgagctttaataacattttttaggtttaggggaggcttaatttggggaactggctattagaaaaaaattatttgaaattgcaatagataatgagctttaaaggtaaaaggttggtgcaaaagtaattacagtttcagtctgtgaatttaaaatcatgtataactaggctcaaacacatctttattaattaaaataggaaccattacaatcaacacattattgccaaggagaagtaaatttattcctgtagcgtaaaaagccatgcttcaggatttgatgaattcttggaaagcattttctacatcttgctggttccaacaactcaaaaactgcaattactttttcactcacctaatattagattagaaaaagatcattatttaaaactgataattgaaaaagagcaaatacaagcattcacaaaatccccccaaaaaagcatctttatagatatttttgttcctgtagatttagactgcatcttctttcattgtcatttcttatgacaattatttgcaataaaaatatcaatttatttatttatttatttatttttgagatggagtttcactgttgttgcccaggttggagtgcagtggcgtgacctcagctccctgtaacttctgcctcccatgtacgagtagttctcttgcctcagcctcctgagtatctgggattacaggcacctgccatcacacctggctaaaaatatgaagttagaaaaaaaaaagtttggtcattctgctaaagtggtggtgtacattttgagttgtcattttttaaatttttttctccagcttctcaaattgtcattagcaatgtcatataaatttgtaaatttttaagataattgacagctttgtgaacacccctatcaagttccttctctctttctctctctctctctctctctctctctatatatatatatatatatacatacacacacacacacatatatctttctatatatattgtatatatatactatatatatacatatatatctttctagatatatatagtgtgtatgtatgtgtgtgtgtgtgtatgtgtgtgtgtgtgtatatatatatatatatacatatatatatatatatatatatgtatatatctttcaaaatatttcaaagccaggcatggtagctcatgcctgtaattcaaacatgttgggaggctgaggcaggatgattgcttgagatcaggggtttgagaccagcctgggcaacatagcaaaaccctgttgctacaaaaaataaaataaaattagctggacatggtggggtgcctgtagtcccagctactcaggagactgaggtgggaggatcacttgaacctattacttcgaggctacagcgagctataatggtgccattgccctgcagcatgaatgacaaaggcagaatttgtttcagcaacaacaacaacaaaatttcaagttttataatatttgatgtagcccttaattttaaatgctttttaaaatttataacaaatttttctcaccttataatagcatataaaaagttttatgttacctttgttgatgttagtgtattttgtcaaatgagcaaaaggtacatttgaatgaaggtattcatataagttactacttggattatcaaaaaaagccaagcagctattctgtttgctatttatctttttctcttaataaatcccttgtttggtattatttaaaacaagggccaaatattttatgccaatttctttgcatattgcatgtgatattttctcctatgactctggggttggatagtggtgacacagaccatgttgcctgcaaagcctaaaataaagacagaaaaattatttttgacagaaaattaagttcatgatgtaagataattttgtggtaatttttgttataatttgttctcaatgttaaaataatttctgttaattttattgcttatctttatttgttgtgtcattttctattaattttgcatctaaatattatctctatacttttataaattaatgttagtctgacaaaaaaaatagccttcatttagggcctaatcaggagtttgaacttctcaattatatttaaatcaaacattccaaaacatatgttcacattacagtatataagtgctttataaaatgtatttccttcagtaaaacaataaattttgagtatataattgtgtatgatacattatgaagtagaagacaactctttggatgaggtgttgaattaaatacattccttgcaattttatacatctgattgttgcaagcattctccacaaattaacttgtggtggtgtacatgacaaagcttttttctttacaacacaggacacagatgttgggcctcatatgacttgttcctatcattatgcaacctcacactgtgtaattcatgtagcaatgctgtatagactggcaggtagacagaggagcaatttcaacattactaggctttaggggaagtgtgatggagaggaagcaggaataatacaatggttatagccagtcatgcttaactatattacttttgcaagttttatgaaaatacctgctatgagaagacactgcaagagctcctcccagggcctttaaccgactgtgtaagtgaggggcttaagcttcattttcttcataataggttcatctttgcatatcaggatacatagaaggaaagataaaacaattttgaaagccaatcaaagcatatataaagcctagatgggcacatattttttattgtgacattaagatagataggataaatgaaattgtcaagatacatgcaagcttctgccccagggcatttcccctatacggaaacagacctcagatcgcactcttccagcagtcttatcccctgatgtctctgaactacatcggtacttcagattctatttttatagttctttgcttttgccacaacctctcgtctgatttctccacgttgcctggtaaacctctatggtcctgaggttttgactctgatctgaaaactgtccctcttctgcaggtcttttttccatcaccatccttttcaaagctgctaatttagacaaatttcctgaggttctagtggaagtggggctacaaatacccttgcattatttagtcataattatttctgggaagaaatctaaatttcttgttttgttttctcagttatatcacaatgcatttgttgaattgaaattgtgatcttcaagcctcgttttcctaatttgtcccttaaagaagggaataggccaatgttctcatggtgccattgctttgatgttgaggcacttacagacctgatccaggactcttaacatttctccctgttcaaggtccattatgtggtgcagagccatggtgaaggatatgagcacaaagctctgtgggttttgttttcctttgtttttgtctttttaatctgtaaattgattcttgctaatcacttgaggaaaacaatgacataataatactatgtgcgaagaatttagcaaaaattggtgctcatctgtcaggaaatgattaatatgattccaaggatgaaatgtggaagcattaacaagagaaacaataacaacagtgatttttgccttaggtatcagaggccccaaaatacaaatttcctaaatccattagaaaaataattgccttaatatgaaaacatgtgcatctaacaactttctgaaataattatattatctgaaagtacatgtagatggtctggctttctttaaagatgtttataaaaattcaagataaatggttaataaccttctatccttgggaatcctaattttgccattctttatgcagacaattacttttctttctttttttataatactttaagttctgggatacatgtgcaggtttgttacataggtatacacatgccacagtggtttgctgcacccattaacccgccatctacattaggtatttctcctaatgctctccctccccttgccccccaccaccaacaggcaccgatgtgtgatcttcccctctctgtgtccgtgtgttctcagtgtttaattaccacttatgagtgagaatatgtggtgtttgttttctgttcttgtgttaatttgctgagaatgatggtttccacctttatccatgtccctgcaaaggacatgaactcattcttttctatggctgcataatattccatggtgtatatgtgccacattttttttagccagtctatcattgatggggatctgggctggttccaagtctttgctattgtggatagtgctgcaataaacagacttgtgcatgtgtctttagagtagaatgatttataatcctttgggcatatacctagtcatgggattgctgggtctaatggtatttctggttctagatccctgaataattgccacactgtcttccacaatggttgaactaatttacgctcccaccaacagtgtaaaagtgttcctatttctccacatcctctccagcatctgttgtttcctgactttttaataatcacctttctaactggcgtgagatggtatctcatcgtggttttgatttgcatttctgtaatgaccaatgattatgagctttttttcatatgtttgttggccacataaatgtccgcttttgagaagtgtctgttcatatccttcacccactttttgatgggcttgtttgattttttcttgtaaatttgcttaagttccttgtagattctggatattagccctttgtcagatggatagattgcagaatttttctcccattctacaggttgcctgttcactctgatgatagtttattttgctgtgcacaagctctttagtttaattagatcccatttgtcaattttggcttttgtggccattgcttttggtgttttacatatgaagagtttgcccatgtctatattctgaatggtattgcctaggttttcttctagggtttttatggttttaggtcttatatttaagtccttaatccatcttgagttaatttttgtataaggtgtgaggaaggggtccagtttcggttttctgcatatggctagctaattttcccaacaccatttattaaatagggaatgctttccccattgcttgtttttatcaggtttgtcaaagatccgatggttgtagatgtgtgacattatttctgaggcatctgtttgttccattggtctatatgtctgttttgttaccagtaccatgctgttttggttactgtagccttgtaagataatttgaagtcaggtagtgtgatttctccagctttgttctttttgcataggattgtcttgactatacgggctcttttttgtttccatataaaatttaaaatagtttttctaattctgtgaagaaagtcaatggtagcttgatggggatatcatttaatctgtaagttactttgggcagtatggccattttcgcgatattgattcttcctatccatgagcatggaatgtttttacatcatcctgataccaaaacctggcagagacataacaaaagaaaatttcaggccagtatccctgatgaacatcgacacaaaaatcctcaataaaatactggcaaaccgaatacagcagcacattaaaaacttatccgccatgatgaagacagcttcatccctgggatgcaaggctggttcaacatacacaaatcaatagacataatccatcacataaacagaaccaatgagaaaagctacatgataatctcaatagatgctgaaaaggccttcgataaaatttaacacctcttcatgctaaaaactctcaataaactaggtattgttggaacatatctcaaaataataagagctatttatgacagacccacagccaatatcatactgaatgggcaaaagttggaagcattccatttgaaaactggcacaagacaagtatgccctctctcaccactcctattcaacagagtattggaagttctggccagggcaatcaggcaaggaaagaaataaaatgtattcaaaaaggaaaagaggaagtcaaattgtctctgtttgcagataatatgattgtatgtttaggaaaccccatcgcctcagccacaaatctcctgaagctgataagcaacttcggcgaagtctcaggatataaaatcaatgtgcaaaaatcacaagcattcctatacaccaataatagacaaacaaagagccaaatcatgagtgaactcccattcacaattgctacacagaaaataaaatacctaagaatacaacttacaagggatgtgaaggacctctttaaggagaactacaaaccacagctcaaggaaataagaaaggacttttcttacatttctaaaggcacataagatcacagagacagaagatgtccagtagatttattttcattcctctagtacaaattttttatagacagaatcataggaatttctgaacctaaaaatattaatcttcatgccacctatttaaaggaaatgcaagcacatgtttattgtaagtgacagtcctctgagatgatagttgatctgtgttcatggcttaagattattatattcagtgagaatgaaattacttctattgaaatcttggaagtaaatgaacagatcatagaatattctagctctcaaggctggtctcagcaagacaatatctgggtagaaaaaacttgatggatagtcaaggatattttagatctgagtaatcaatagcaggtgatggagaaaaagagccatataataagtggtcttataagcatttttgctgctcaagaagtaccagccacaaagaaccaatactattttaaggattaaagttaccaaactatagtagaatgtatgtgtacttaggaatcacatatgtatcatttagtgtgtatgtcactagttctgcaacttgtagtttaaactagttttctcatgtttaacgagatgataaaaaaaactaactcagaagattgtagtataaataaaaagcgatgacatctcgttttacataaattattgcatttgtcattcattcagtaaatgctagctatttttacttttctggaaactagggaaaataacttctatataggtttgtaacgaattccaattacgaaattcgaaataagcataaaacaatacctcttgcatcatatataatcaaacattaaattaccttttgaacaaaaatctttgtttattaattttactggcccccaaatggctatgaacttgttgaaaatggagatatcacattcatctttttattccccatttctagtagagtacctgagacaaagctagcaaatgccgactgattgaacaattccagctctgttattaaaatcatcatataacacaaacttgtcaatggaaaagttaactttcagataccaaaaaaagggaaataagctattgcaaataataatcaggtaaaaaaatatttattctgtttcagcatagtgttataaatattgaaatgtaaattaaaggcagtagggcacacctatatcttgtttctagtttttgctgatagctgtatataatcaactattattgctttgataccaccatataacgtgggttataagattttcagataaaagcaactcttatttcatttgtttttcttgaattactccatataggaagaggctttggaatcgtatttcttgctttgaaattttatttcttgcatttatatgcctttgcaataaaatcgtgttaacttataatctctcacgcaatggtttctcctagtgtttaataaaatggtattaagggtaactgctactattttttctaaaattagaaggtaacattgaatggacacacagcagatacatgttacattctgaaatgtatgctttgctggagcagaatgaatgcaatcaatgtaatggaaatgctgcactaatggctcattaaacatggaaagtatgcatagatgaaaaaagtctgtgcatatgtttcagttcactgaaggaagcaatgaactataatgtggaaagaaaaggaaacatacttctttacgtaaatattcttacttctggaaaagaattgttgaatcagtcaggaatttgacagcaagatttcaactattggagcagacaactttatattgtaattgatggatctggtggacttttaaatattttttttccctattctgtgctttttcacattgtttctatatctttttgtttttttgcaaagttctttaattgatcaatattttcttttgtgatatgtgttttattgctcacaagaaaaaaatttctctatttaaatgttatactctcttacactttctttcaaactgtcacttataccactgcaattcaccccaaattattttagtatatgatgtgaaatccaagtctagctttacttttttcacctttattcaattgtcccagaaacatttatcaattattccacatttcttcactgatttgtaatatgccctttgtcttaaaccatgcaaagctccccagcatcaatagaaagagagaggaagtagatgataaccttttgcagtgggaaacaaaaaagatattttaaaactcttgtttgtgtttggaactgtcacctcctatgacatgtcaaacaaccttatttggcattggatagtgtaagtaattttttgccctgacaaaatatatttaggtacccacttgagcaaaacttataatatagatttaatcatatattcactgttatcatcgacttcattgtgttcttctacctctgcctgatgcacctcttgattattcagcattgttgccaagcatttgctgttagtagctgataacattcatcttcttttgctaaatatttctcatatacaagaagatttaagactgtttatccctgtagttggaagatttttcctctaaaagctgtttatacttttcctagcacgaagacctgcttatatgccacacaagtgtctcttaaaaagttagtcactcaatgccctgctaataggagtgaaaaagacactagaaacaaaaatcttttctaaccagaaaaccacttttgtataaattttgagctccttgcaccacagtgactacagtgtgcctcactaaggtaaacatagaaaatggtatcatttattgtttcaaattaatagggtaattgtaaatatgataagtttatcgaagatattacagaagtatacattttaagacaaccctagaaataattcttttaagagcatgttacaattattattttaaaatgcattactcctaccctaattttagttggaagagatgtatgaaaattacaatgattgtactgcatagaatatgtcatttttgtttgattttttaattagcagtttaatttgtgcagtgtcgaatataagagataattctgataggtttgtcatcacagagtctctggcagttaacatgaatacaaaatattaaatgtattacttaccgcagtaaacggtcactagtcagtaggttgataattcgcatcttgtagaacactggccatgactgatggatttttatcctttcttattatgtatacgttttttttcattaatagtgttccccctccaagtcagtttttatattcaatcctagcacaaatgattttaaaaatgaaagagatgaaggagatcattagattctagcagaggaaaagttgtaatacaagttggtttagaaccaaagtgctttctaactttcccatttgtttgttttttgttttatgtttagacttggtattaaaaaatgaagatgtaaacaattcagttaggaaaccttcagagatattctgcactgaccttcattagagtttgtgtagtgcatgaccgtggtaatatcaaatggttgcgtaagtatctacaaggccctttttcaaaaaagccatcaagttgcatctctctaattattgcaaatatcttgtttactcctatttattcactacatcacttgaagtttcctcttgaatctgagcatgtcctgtaggtctaccttagaagaaaggaaaagtgctgtcttccacattgggtttcagctgggcttacagccaagtgtacattgcaatttgcaattatctccttttcctgcttgtgctggcaaagagagggaaaattttaaatatactctctgtgaaaagagtgtgagatcagaaaacagacagtattatgaatacttaatgtatttcctactcaggacaatttccagcacttttcttttgggatttaggcttctgtgtataatatccccttgaaaactgaagaagtacaagtctccttgcttgtaagcgactaaatggctgacattctggatgcatgttttcatagactattgtgttttgagtaaatataaatgggatcactggataaatggatttggaagagtaacgaaacaagaatagcatgggggaattatctcacaggaacattaaacttaaggggatttaactgtattcccattaagagaaaaagattaaaataaaatatgtacagccacgtgtcatttagtgacagggataccttttgagaactgcgtccttaggagatttctcatcatgtgagcatcatcatgaacagtcatgtgtttctgaacaaccggggtatgttccaagaaatgtgtcattaggcaattttgtcatagtgtaaatatcacagagggtacttaaacagacctagatggtatagccccctacacacttagactatatggtatatcctatttttcctaggctataaaaattttcagcatgttactgtagtgaatactgtgggtaaatgtaacacaatggaagtattaatatatctaagcatatctaaatatagaaaatgtaatgcattgtcctaaaatgttaggatagctatgacttcaccaggtgatagaaatttttcagttcccctataatctatggaatcaccatcatataggcagtgtgtccttgactgcaacgttatgtggcatatgactgtacatctatgtaagttgcatagaccattttagtctccatttcactctgtgagaatgtatcctaaacggtaaatgcaattaagttttaaaaacatgttgcaagcatacacaaaagcatagagtaattgtgcaaattattttaaagttttccaggccatagatgaaaaggtaaagttcattgcttaggtagccagggaaaaggagagtgatagaaacaatggcagtcttggggtagacagtgaaatactgagagcctttgacagtcattgaaaaagaattggagcccgttctccatgtcgtgcttatttcagattgcatgcctgtatcaaaacatctcatgtactccataaaaatacacacctactatgtacccacagaaatgaaaaattaattagaacaatgaacaaagaataatggatttatatgggtgtacataaatccaagtgtgtaatagtttatacacatggacttatcaagaatgataattctttatcattcatgataaatgaaacaatctttatcattctaaatcaatgaaactatcaagaatgatttagatgtacagaatttatagtgaggcatgaccattagaatctagccagaatatagcgtacaatttcactatattaacatattcttgaaattgtctattcatttggtttctactggatggtacaattagagatgaattagggagggacaagaaactagcatttactgggtctctaacatgtgccaaaggcgaatggcacctcaggaaggtgcagctgcctttacgtgacatagggaagaaaacatttagaaaatgatatttgatcttccttgagaaatacaaatagaacctatccagatggaggaaggcagtgagcaatagcatgtttgagaacatacttttgttctcacacatcatgtaccaaacacagaagaaaatgacgcatctaaaattttttttaaaactacgctgatgcttttttttcttcacaacacatttttatggttttttttttttttttttttttttgagacggagtctcactctgttgcccaggttggagtgcagtggcacaatctcagctcactgcaagctctgcctccagggttcatgccattctcctgcctcagcctcccgagtagctgggactacaggcacccgccacaacgcccggctaattttttgtatttttagtggagacggggtttcaccatgttagccaggatggtgtcgatctcctgacctcgtgatccgcctgcctcggcctcccaaagtgctgggattacaggtgtgagccaccacggccggcccatttttatgtcttttaagctccaagttttcttagctattttcatctgtcatatatagcctcaatatattgttgcctggcacatagtaggcatccaattaaaattaattgaatgcatgactgaaacaagagtttctcttcattatgattcttaatttaagcttaaatttagaaatcctcttcttatcatttttcttagtttaactcaacactaataagattgtcgtttctatcatattctgtgtctttccccatgatttccatagctctttgaattaggataatgacttttttattttattttattttatttatttatttattttgagatgtagtcttgctctgtcgcccaggctggagtgcagtggcgccatctcggctcactgcaacctccgccttccaggttcaagcgattctcctgcctcagcctgccgagtaactgggactacaggcacccaccaccacgcctggctaatttttgtatttttagtacagacagcgtttcaccatattggccaggctggtttcaaactcccgacattgtgatctgtccgcctcggcctcccaaagtgagccaccgcgccaggcctaggatcatgacttttataacctgtagcgagaaaagatgcaaatctttctcttattggtatgattctgctcaaactcagatacacaatctagagtcaagatgacaccgtaaaattattttttttaaaaaagaaagaagcctgggcatggtggctcacatctgtaatcccagcacttcgggaggctgaggtgtgtggatcacttgaggtcaggagttcgagaccagcctgaccaaaatggtgaaaccctgcctctactaaaaatacaaaaattacccaggcatggtggcagacacctgtaatcccagctacttgggaggctgaggcagaagactcacttgaacccgagaggtagtggttgcagtgagctgagatcataccactgcactccagcctgggcatcacagcgagtctcaaaaaaaaaaaaaaaaaaaagaaagaaataagaatacgaactgcaatcacatttccaggctgattgtaaaataggaacagcacacttgagccaaagcaaaggtttcaagaaggataaggtcaaatgcacagaatatgggacttagattgtcaagctgaggttaaagtcagtaattattggagagacctagggattccaactttagactaggagcatctaggctgtcataagtaagaagagagcaggggctttaaaacttggctgtcacaggtagcatttcttttccccttgaccctggggcacaggttgtccactcgcaaatgttttcgtgtcacctgacactcaccttctcttctcgccagtcttgcaggccacaccttactcctaccacatcttgccctaggttttccttttcttgcactgaaagttctcctaacttatgccatcctactggggaaaaaaataagtttctttttctccctgctacataactacattacaacacttaataatcccattcaggtccaaaatgcacatctttctctttgcaaatagttactatactttctttaaacattcttattacttattttgagaatgtttctattttctcagttttagcatttcatgagtctttgacagctgggtctcagagagaggccagttaggaattggacaatcgtcttaagcaggctctgggtttcctgtacttttctgtgcagtgcctgtgctgattaaactatgacctgcagtttttctttttacggagttcatagtggtcatttgaaatatgatgtggcattcagaaaaattactctttctcctgcagtttctgtgaatatattttacactgcagcaattgtcatacaaggcatataaggatttattcaaaaatttatcaacaatctgagatgcattggtaagaattacaatgaaaatattagttgttctttatatcactgcaaacaatagacaaatccttacatgcaagaaaacttgctatgatgtttcaatattgtaatttcagccaatctaaggctaaggttctccaaagtttaaatatggtatttttttttccttttagaaaatccccatacatttaatagcccagttataaacatactgcccatgtaggtctcctttacttgtgacctctagctgtgagagaatccttaggttccagagaccagtagttcactgtgtgctaaaggacatgctttagctactcctttgctactccttttgaattctttctccttttctaagtgggcagctctcacccgctcattctctgggctttgcatttagaatgattggtcttccccactattattttagacaattacatttatcatgagaaattaatccttgagggatcaatgatgcgtgcttttctctggctcacaggaacaaaactattattcattttccacttgacataaagtgacccgtgaacccatttacattttcattcccctgctggcagtaccagtgaagccctttgtcagttatcagctagtagtgacccctgcaggcacagccaccactcagcccagggaggactgcttccggggcaggtcccctaggtgccaataaagaatgcaaccattagcccacatgtagggacctaaataacgctggtcagggtcttgggtctacctatgtgaagcaaacaggcaaatattaacaattttgctgtgacctgtatttgagtgataaaggtgtaattcgaagtgaagaactatgagagctggggcatttgtcattggaacttttccattttctctctaagggtaactttctttcatttttacaccctctaccctgaaagttgtcttcagtcttcagtcactgcccctgtattccatgccattatattatgtcatatattggtgactcctgtccctggaaaatttaatgagaaatgggaacgaaaataatatcgtcatggtggaatgacaggcggctgatattgttgagctagggaatgcttgcaatgctgagcacagccacatgtgccagaaatagggaaatgtatgacacaagacacagtcttgaggtgctcatgagctattaggaagttgcagcatgatctcaccatctgaaaatgaaaaatgaatcattctctggggaatgagctaaatttgactcctgaaatcaccatggtgccagggattacggtctctgaatgtgctacagacttggagtgactaatgagctgcttgaggtcatagagagacttaggcaattaaagacaattaatgcacattatcttgcttaaaacatagaaaatgatactccagttacgcagtggttacttttgtgacctgtttagataactctaaacaccatatttctcctagattttataatcttgttgttcattcagtataatttgttttctaacataaacttgatctttactgttgtgagattcttgagaacagagacactgtatgttatttcttctttatattcccagtgcattaagagcttccaaaacagtagatttttgctaaataagataactgttgaacaaatgaaagaatgagcaactgtagagctgtgttttgtgcattttctttaacacagtctatttttactgctgccgatctttactgttgctgatcaacctgagttgagttcatatttgagtgcaaaattcttcttctgactaagtaaggaatacttgagatgatgcaggattgaaggttcctaagtttatcagtaagggagtaagggagtcagcatattttaacccactttgggtaaaatatgacattgaactaagagacaaaaaactacaatgaaattagttaacatagtttttttgtttgtttgtttgtttgttttttgagacagagtctcgctctgtttccgaggctggagtgcagtggcacgatcttgactcactgcaacctccacctcctgggttcaagcgattctccttcctcagactcctgagtagctgggattacaggcaggcgccaccacatccagctaatttttgtatttttagtagagacagggttttgccatgttggccaggctggtctcgaacccctgacctcacgtgatccacctgcttcggcctcccaaagtgctggcattacagcatgagccatcgcgcctggccaacattatagaattttaaattaaggacatctgaaagataattgagttcaacatttcacattcaccctagactgctctcccaagatcaggagctactggagattttgaaggaaaacaggcctattcctaaaatgtaaaaagtgagcatgaaaattgcatctgatgatgacattcaggagaaacagttagtgtgcctatgcaaggtgatccgtgtgggacagagccaggactattacgaagcacttgatacctcaccacggaggactgatgagaaaattcattataaagagtttggctaccgcgaaatgtaagttgacttctaaataaagaattcaaatgaaataaaaatgatcgacaaaagttgactagaagttctctaaaatatatctatttctaattttatttcatttgataattacctaaattactctgaatcctaccttcaattttacttgtctttgtttgaacagtaattcttttgtctcaaatgtcatgtatctttgcttaatgccatgaaatttagccagtcttaaaaatctttgatagaggaaagaaaaatgtcctaaacatgtgttatttattttacttcctgagtctcaaaatgtgttttcatattgtgcttcaagtgtcatggtttagtttttgccttactcatttttaatatatctcatttaatagattaatattatattcccttgtaacctgcttatttcaagaataaaacacaatgtcttaaatagtaacacaattaattcagatttttttgacagcacgatgtatagtgcctaaatatattcagccagatttaaaacagggcataataagtaaaaaaaaacaaaatttcatagtgttgaaaaatcgatttggtgtttaatatttatttagatttataaaaattgtttcatattgtcccttgttatcactaagcaattaaagcattgctatctgagtagaactgccttggatattgtgtagcttatgaagtttaaatggctcaacactgtaggattctgatttgcaaagaaacagtctgaaagctcatcttcccaggctggaagacactggtttatttatttcactgtattaggcaagacaggatgatttttttttttatgttgagtggatgccttttggaagattagaaaactctgaggaagagggttctgaacaacaagccatctcaatttactgatcaccagcagtggaggcaaaaaatgagaaaatccatgagtttcctcttgatctattaaagtcctatttgtgatccaaatcagaattggaaactttcttcatagccttagtccactgtttctgaattaaaatcacttcatcatggtgttattttgaatactgtgatcttaattaagatccaaaccttagtgaacatttggaaaacaatagaatttgctgcaaagtgttacaaaaacatgcaaaatttctaatcattgtcacttactaatgaagtttatgtttctgtaaaagaatagcctgtaactaagtattctttggggttgtctttaaaactgatttgtttaaatttaaattcccagatgtcttaatagaagacagtaaagtcctaaaacaaaggtattcactgtgttcagctccttaacaccaagtacagatcaatttgttagctgcagtgttggatatcttccagcactaaaactgacaaggtgatattaagataaaatatattacctcctttcagtgttaagatatcttaaacctggaactggactcagaggaacaatttatgtagaaatggttttccatgagtgtagaaatagtttggggcaaatgttaaatttttgaacaaatgtttcctgaatctcctttttatgtacagcaggggttcacaaactctttctgcaaaggaccagatacaagtattgtaggctttatcggtcagccaaacgatgtcagtttctgtctctatattcaaatctgcccttgtggcatgaaagcagccatggacaatacctaagcagatagtcatggctgactgttccaaaaaaaaatgttatttactaaaacaggtgactggccagagttgaccaacccctaatgtagaacattgtgttgagaatcgtttaggaaatgaatttataaaaaaaacaaaacaaaacaaaacaaaaaacagtgctactcccctcctggagcttatcatatgatataaatcaaagaagcttatgcataaatacttaaataataagtaaaacttgaaatgtacaagagaagaaggtgcatgataagagtcatgtaagaacggcaggaaggtggggtccatgtgtacagaggagagggggtgcaatcatttaaaactaaggaagaattgcaggcactcaaagctgtcaagcagtaccctgatggatggagactgccctgtagagaagagagcataatggaaccctgggagagccatgttctttccacccatctcacagtctttgggctgctttgttcttctctaaatgcagagtaactattcatatcactgtcttatagaggaggatgctaggaaccagtgttggacaaattagcagagtcagaactcacattgggtttttcttacttcaaatccctcaggattttgcacaatacattcttgcaggtcattcaggcaaggtgtattaaattgcatttttcttgaatggcgtacactctagcctaactaaacatgggtattttgttgtactaaataggagtaaaggttgaaaattttgggtacaagcagaagttggatggttttgaatgcaaagatgtttgaagtttaggtgggaaatagaagaggacccttaaaagttttaaattatagaataagataattaaaatgatgatttatagagaggtgaatctgctgaaatatccaggctatagaaaaccgttatgtagtgcttgactaaactttattcagagggataatgactaagaattagacacatcatggaaacaggtatgtgaggggtcgcacacttttgagtacaacaggtgtcatttgcaggaatatacacatgaccatggttttgagaaaccttacgctagactagcaagaacttcaatcttccaggtatctcctctaaaatatcattatggttgttcagaggtaacccttggcatcagttctgactctctcatgttctgcttctcttagtgaagtggaagtggatgtcacctttgtggctggacaccacaatttctgctccccatagagctccacagtggtgctccttgagcctctctagttgggtctaataatggaaacgtaaattatttgggattgtcattgtctctgtacgcaacttctactttaagccttatcagtctcactcttactccttctggtcttagtgtaacatgcacagagatgaacaggaagaagtattctggtagcatgattgggaaaattgtctactcatctgtgtatgctttatgaaaggcacaaactctctgagcccaaagggttatcacccatgcctgtacaatatttcccacttagacacacactcttacatgaaaattcatgtataaaatggaattctcctgccagggagcattcactgtgcccaagagctcaggctgtgcccagaaccagctgccgcctttgacgtaggccttagtgtggaaggtgattcaccagtttactcttttaatatctgcaatctggcctccatttagggctgctcaatccaccagatgaatatttatatctttgagctactattgagggtttcatccccagccatttctcctacagacaaatgattcttaggttcctgtgttacacagtatgagcaagtatatatggaggatggggaatgacgaacacaagcatccaattcacaatgcaaatgtactcaggaaaagatgatgcttgattattcattagcagggtttgagcttcagatcaaccagaccatatatcatagcagaaaaaccttttctgtactcctgcctcagcaatatctggattcaatatctagttcagcctaaatctattgtatactaaatagtgtaaaagaggtatttaatagataatttttaaaaagcaaaaccatgatcacacaacgcatggtagccccaaattgtaatttcttggaggtgggacacaggcagccaaaaggaagtgaagcacttggtagaatgtacatgaaacggtgcacagtagttgatgctgcttgggtgaaaggaaggggaaaaatctattgatcacagaagatcaatgtttagtgatctggttttgtgtgtcagataccttactaaacgtttttacattggacctcatttaatcttcatgataggcctatgtgtaacaaattgttgaataacttaaagatgtcaggtggaaaatatgatttcatttgttctttaataatttttattgatgtagactttagtaacattattacatattatgttcatatgcatgtaacctatatatttcctttcaaacaaaactatattcttgaaataaaagttaatactaatcctgtgaagaaagtcattggtagcttgatggggatggcattgaatctataaattaccttgggcagtacggccattttcacgatattgattcttcctacccatgagcatggaatgttcttccatttctttgtatcctgttttatttcattgagaagtggtttgtagttctccttgaagaggtccttcacatcccttgtaagttggattcctaggtattttattctctttgaagcaattgtgaatgggagttcacacatgatttggctctctgtttgtctgctattggtgtataagaaagcttgtgatttttgtacattgattttgtatcctgagactttgctgaagttgcttatcagcttaaggagattttaggctgagacaatggggttttctagatatactatcatgtcatctgcaaacagggacaatttaacttcctcttttcctaattgaataccctttatttccttctcctgcctaattgccctggccagaacttccaacactatgttgaataggagtggtgagagagggcatccctgtcttgtgccagttttcaaagggagtgcttccagtttttgcgcattcagtatgatattggctgtgggtttgtcatagatagctcttattattttgaaatacgtcccatcaatacctaatttattgagagtttttagcatgaagcggtgttgaattttgtcaaaggccttttctgcatctattgagataatcatgtgttttttgtctttggttctgtttatatgctggattacatttattgatttgcatatattgaaccagccttgcatcccagggatgaagcccacttgatcatggtggataagctttttgatgtgctgctggattcggtttgccagtattttattgcggatttttgcatcaatgttcatcaaggatattggtctaaaattctctttttttgttgtgtctctgcctggctttggtatcaggataatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagagcctgttattggtctattcggagattcaacttcttcctggattagtcttgggagggtgtatgtgtcgaggaatttatccatttcttctagattttctagtttatttgcatagaggtgtttgtagtattctctgatggtagtttgtatttctgtgggatcggtggtgatatcccctttatcattttttattgtgtctatttaattcttctctcttttcttctttattagtcttgctagcagtctatcaattttgttgatcctttcaaaaaaccagttcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttctgtctttgttctcgttggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatgtctgatcttttacatttgctgaggagaactttacttccaactatgtggtcaattttggaataggtgtggtgtggtgctgaaaaaaatgtatattctgttgatttggggtggagaggtctgtagatgtctattaggtccgcttggtgcagagctgagttcaattcctgggtatccttgttaactttctgtcttgttgatctgtctaatgttgacagtggggtgttaaagtctcccattattattgtgtgggagtctaagtctctttgtagatcactcaggacttgctttatgaatctgggtgctcttgtattgggtgcatatatatttaggatagttagctcttcttgttgaattaatccctttaccattatgtaatggccttctttgtctcttttgatttttgttggtttaaagtctgttttatcagagactaggattgcaacccctgccttttttttggtttccatttgcttggtagatcttcctccatccttttattttgagcctatgtgtgtttactttaaagttcatatggcaccaaaaaagagcctgcatcgccaagtcaatcctaagccaaaagaacacagctggaggtatcacgctacctgacttcaaactatactacaaggctacagtaatcaaaacagcatggtactggtaccaaaacagagatatagatcaatggaacagaacagagccctcagaaataatgccgcatatctacaactatctgatctttgacaaacttcacaaaaacaaacaatggggaaaggattccctatttaataaatggtgctgggaaaactggctagccatatgtagaaagctgaaactggatcccttccttacaccttatacaaaaattaattcaagatggattaaagacttaaacaatagacctaaaaccataaaaaccctagaagaaaacctagacattaccattcaggacataggcatgggcaaggacttcatgtccaaaacaccaaaagcaatggcaacaaaagacaaaattgacaaatgggatctaattaaaccaaagagcttctgcacagcaaaagaaactaccatcagagtgaacaggcaacctacaaaatcggagaaaattttcacaacctactcatctgacaaagggctactatccagaatctacaatgaactcaaacaaatttacaagaaaaaaacaaacaaccccatcaaaaagtgggcaaaggacatgaacagacacttctcaaaagaagacatttatgcagccaaaaaatacatgaaaaaatgctcaccatcactgtccattagagaaatgcaaatcaaaaccacagtgagataccatcccacaccagttagaatggcaatcaataaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcctattactgggtatatacccaaaggactgtaaatcatgctgctataaaaacacatgcacacgtatgtttattgcggcactattcacaaaatcaaagacttggaaccaacccaaatgtccaacaatgatagactggattaagaaaatgtggcacatatacaccatggaatactatgcagccataaaaaatgatgcgttcatgtcctttgtagggacatggatgaaattggaaatcatcattctcggtaaactatagcaataacaaaaaaccaaacactgcatattctcactcataggcaggaattgaacaatgagaacacatggacacaggaaggggaacatcacactctgcagactgttgtggggttggagggggagggatagctttaggagatatacctaatgctaaatgacaagttaatgggtgcagcacaccagcatggcacatgtatacatatgtaactaacctgcacattggtcacatgtaccctaaaacttaaagtataattaaaaaaaaagttaatactaaagaaagtcttttttccctaaaatattattgtacaaagagagaactcttaataaatgttgacctctgacagaagcttaatttatcctaaagcatttattaaacatctattgtgtactaaaaattggaaaggctttcttttgaggaaaaaataaaaaggcactatatttgttctcaaacactagcgatatgaataataggtgtctatatctgagaaaaatgcagaggaaatagaagggttatctaagtctatttgggctcgtatagcaaaattccttagaggtggatagcttatcaacaataacaaaaatgaatgtctcacagttctggaagctgggaagtccaaactcaggttgccagcgtagtcaggttctgctgaagaggcttttctagggagggtcctctggtgagggtccttttctgtgcagattgccaactccctgttgcatcctcatatgggagaagtggagaggggtcactctctggcctactataaaaaggcactcattccattcatgagaactctgcctgcccttgtgacttaatcacttcccataagaccccacctgctaatacccccacctgctaatacccatcatggagttttgaactacaatatatgaattttgcattcagaccataataaagagtatatttattgcttatctaacgctctgttttaatcctaagaaatttatatcacgcatctacttcgatgctatagctagactaatacatgttcatcttcgtgcattttcccatatatgctattttacttccatctgtacttgaattttcttagtggcttgggtaaagccttgacatgtacacttgttaaaatggcctcttgatgactgacaagataaccagctacaattaatggtcattgtaatgttgagggggaaaatcatccttgaagatgattagatactaaatgaattagcacacagcatatttaaacacaagtatcaagtcaacaaatatgattttatcaatctttaataattttactaacctttattaatgtatattctagtaatgatactatatactatgtacatatacaggtagcctagtatttcatttaaaataaaattgtattcttgaaattaaaatcaatacagaggaaagcttatttctctgaaatatttacaaaatgcacaaatttttaaatttcaaaatttaacatttgtgttttattttaatgaatacaattttcaagtatgttatatgtacagaatggaatacatagcacaaaagaattatttactatctgtgtatgaacctaaactgcatcaatgaccatataaagcaggtaatataatttaaaataaacaataatgatgtaacaaattttttcatatataaaatgaaaattttggagattaacactgcgtctgcctttgtgggtgatttattccacagagctctttcaattgtttagctgccttgaatcttgtagcttagttataaagagaagtttggaggtaaatgttctgcagcattcaaaaggcttccttgaaagccatttaatgcttgaaaaccttttattaatgtatttgaaaatagtcatgttggattggaatatgagagaaaaactgatttggttgattttcctggctcatcagttttgaggttattgtaactaacacacctcagtcagaggcactaatgaattaaacacacagtgtttgattctgtgctgtctaataccatagcaactggtcacatgtggctatttaaattagaaattcacattaaagtaaaaattcagtttctcagtcacactggttatgtttcgtttctctctctctcttttttaaaggaagttttgctcttgtttctcaggctggagtgcaatggcacgatcccagctcactgcaacatctgcctcccaggttcaagtgattctcctgcctccgcctccttagtagctggaattataggcacgtgctgacatgcccagctaattttgtaattttagtagagacagggtttcaccatgttgaccaggctggtctccaactcctgacctcaggtgatccacccgcctcagcctcccaaagtgctgagattacaggcgtgagccaccgcgcctggcccacactggttatatttcaagcactcaatagatacacatggtttgtggcaactaatggacagtgcagatgtagatggaacagatccattcacactgaaagtactattagccagtattattgtaagatgtacgataacctcctttgcaattttatttagtcaaaagatagtaaatgcagtgtaaagtcattagagaaatattgacttttaaggataattaaaaaccattaggataataaacctatgttaaggttattcctgattaaatcaataccatcatgagacatattccaaagatccactgtgagatgctttatggaaactctaatttctaactaaaaaggcatgatatgtgaacactcatagcttaataaaaattatagttaatatgaatggcagcctgtcatcataaacatggttagtaaatttcctggtatccctctcatattcttcccaattggcatcattcatgaagtttctgtgtgattagttccaactggatttccaaggtgatcccccttttctaaaagaaataatcataatctcttccctttgccacaatgatgacttcatgaatatgaattgagctcaggccccagtcctaccatgaattacattcctcctatgatgccgcttgattcaagggtgtacaagagcttcataaggtcaaaacaaagtgaagtccagcagttttgctttaggatgagggagatagattctcacttttaccggatgctggggtgtgtggactgatacccagaataatcatagttatgttgttgccctgaaaggtgctagcctgaagatgaagacatatagaggacaggggatgagaacatcacacactatcactaaaaatcagttacttgggctgggcagggaggctgaggtgggtggattacctgaggtcaggagttcaagaccagcctggccaacatggtgaaaccccatctctactaaaaattagccaggtgtggtggagggcacctttaatctcagctactcaggaggctgaggcaggagaatcacttgaacctgggaagaggaggttgcagtgagccgagatcatgccattgcactccagcctgggcgacaagagcaaaactccgtcttaaaaaaaaataaaaaataaaaaaataaaaaataaagtcagttacttatttacctttaactatagatgtcaaatttagagttagattttctgttatgtaaagtcaaaattattctgaaactcttaggtatgtgacgacttgtaggcaaagttatctctccaaattggaaattagtaatcttatttaaatagagtcttcacatttagtaaaagcatattgatgttggtacatttaaattgcaaaataaaagaatgacttactctttagaagcaagaataggactgggcacagtggctcacacctgtaatcccagcattttgggaggctgaggagggtggataacttgaactcagtggtttgagaccagcctggccaacatggtgaaatcccatctctactaaaaatacaaaaattagccaggtatggtagcagatacccgtaatcccagctacctggatgagaatcactttaacccaggaggcagaggttgcagtgagcagagattgtctgggtgacagagagagactctatctaaaaaaacaaaacaaagcaaaacaagaatagacagtatattcaccaggtatacgtatattaacttctattaatttaatattttcgcaaatagttgtttgaagtctctggtttaggatagaacagaagtacatattttgggtgatatctgaaaaatggactctgaagggagcacaaggagagagaatccagagtgaataagacagtagctcacggctgggcgcgttggctcatgcctgtaatcccagcagtttgggaggccgaggtggatggatcacctgaagtcaggagttcgagaccaccctggccaacatggcaaaaccccgtctctactaaaaatacaaaaataagctgggcatggtggcaggcacctgtagtcccagatactcaggaggctgaggcaggagaatcgcttgaacctggcagacagaggttaaagtgagccaagatcatgccactgcactccagcctaggcaacagagtgagactctgtctaagaaaaaataataataaacaaaaaaaatagtggctcatgtttcacaggcgcgtaatccacatcactgctgtgcattctgagagtgcaggcgtgaagtatagtcagttcgggattgtaatcagggtccttaactgaaagatctaagggaaactaagatgttttacccctcccaccctagacacacagacaataacagcggtgataaatttcaagatgaaatcacagatgtgctcctccatctcccattctcaaaattaggaaggctttattttgaggtgccagagcacacattaggggacatacaccttcctaggtagacatttcagatattttagagagcatgtgaattaagaacttgaagtcccaaaatagtgtttaaagacatatggtaactagcagaggcatgaaaacgctatttttatcagcaaatcccagggaaggatggggagacagatgatcctgtaagggagctaaatttcttacctttcatggcatagagtcaaccacttaaagtctaatgatgatgagcgaagaaaccggtatgtaattattgaggcatcattgtggacacaaccaggaaaataaaatctgaaaacaggagcccttaaaatacaatttgaaatatggtgtcaagtttgttggagatttgttaattcaagtggtgagttaacctaaaaatatcacagaggccaggtgtgaggtaaaaacacaaactgttttcctgcttctctcgcactacaacagtgggcacagaaggcgtctgtgtgtgggactttctctccatgtaccaagtaagcaaccagttctgcagtggacacaagctgactgtcctccagcccagttgcattctgaccctgtctatctggagagagcctcagatcccacagggtgagggctccatcccacaggcctgccctccacttcccatgccagttgcaagccccaggctcttttacctgtgcttctgactgaccagctgtaagtcagggatcccaccacctcctccttgggtttgattaatttgctagagtggcttacagaactcagggaaagacttatttacattttccagtttattatgaaagatatgacaaaggatacagatgaagagatgtctagggtgaggtatgcaggaaggggcctgaagcttccatgccctctttggggacatcaccctctaggaacctccatgtgttcagctgtccagaagctcttcgaaccctgtcctcttggaccttttatggagattgcattggacaggcatgattgaagcatggagaaatgtcattacacaagaagggtaaggtatagtcctcatagactgggtagcgaaacccggcaaagcctgtctgttctgtctgctctgtcgattcttcttggcctcgctgtgcagtattcttctctcccaggaatggggcaggactcctggaatgggggcctatgaacaacaatcagacaagcagatcagagaatttctttgtagccccctccaggacagaaaggcggaggaagattcctgccctggggagaaaaatgagtggataaaaggaagggaggagaaaggcagagagagtctgttttctgaggtttgctcctgaggtctaaagaaccccaacgttataacaaaggccacaggagttagagccagaacataaatgaaaatacatatataaaaaacataaaataataatgaaaaagggaggaggctactattgtttatgactcaatgtaaaacttgcagagagaaatgagtgaagaataatacttcaatcattcttctgtcttggtgttcacaacatagagacacacacacatatacacacagaatcagaatcagaatgaaggagacataaagataccatatgtgcatagatggacttcctgtaagaatgaatagagaaggaaaggaatagaaatgtaagagaatacaaacagttattccagtagagaatgaaacgatataattattgagtgatcgttcatggagtggttttggaagactctcaggaggagtctcctgtccttgatggcctattagccctttttgccacatgtgaaccctaacactctgaaggtgaaagataataacagacagtgttgagaccagagctaaaattgttgaacacataatcatgacagggtaaattaactatttcactttatcaaatgttttaataaactcttaaataatatgcattgaaaaactggcatttgatgtggaacattctcttagatactatattttataatttttaaatttatgtatgtatttattttggtgagcaactgaaaactgcaattgtcagtgaacttccaagtgaaatgcctttgcgctgtctgagttttagatcttcaaaagctcaaatgagtaatcctgtcaaattacatgggttgatatggaagagagataagtaaataaaactccactataatatttgtgtggtaccacacacatttggcttaaaaataaaaagggattgaagactgtgtaaagaaatggaattttttaaaagataagataggagtaaatatagaaaaggtcttaaatgacttcaggcagtgaagcaaaaagcacattcccttgtttcttcctgtagaatgataccctagaccaggctattagctgtggataggagccctttatagttcagcaaactattaatttatagtttaccctttcagctaagacattgaagctattctttaaaaatttgagataatttgactatttaaaaattcaactacctttgcaaaatcaaaacagatctgttttgtaagaggtttgccatttcagcatctcactgcaagtgataaggtggttcagtgtttaaccaaagatcatggccacttgacccggtcttcaacccagcgctgtgccaggctgcacatggagggcaccagctgagtatcaccagccaaaggactctttcaaatgacaccagaaaagcctgtcctgttcagaaaaatgacatttccaggagttggaataatgctaaactacatggtctgtaaagtttcctctaagtaatatctaaggcactgtgagtctagccttgggaacatatttgtcaaaagactatttaagaaggggagatttttcagtcctcattgtgttctctctctccctctctctagttaaatgtatatattcatcaggtatttgaactcattttgctaaacatgggacacagaattaataggcattaatattttgtccaaatttagataataagatcatatatatataatatatatatttaactctcctcttgctactttactaaatatatatttattaatagaaatgagtattacatgttaatctctgaagatcccaaaataaataagaaagtgtccagcctttcaagtagctctcagtgcattggggaaaatgaatgagaaaagtaagttctactgtagtattaaagcaagagtgtgaataaaattttgttacagttaaacacagagcacttttaaaagtttgagattttgagtaaggttaatttatggtttagctatacctcctgtggaagttctgaagatcttattgattttctacatttggacaaaacattaatgcctattaattctgagtcccatgtttagcaaagtgagtccaaacacctgagaatcaagtgactttcccccagtattgattttgttagtggtaacaatttgaagatctccttaactcttctgttctcccagttgtctttactctaaatgttgccctgtgtatttaaaacctctaaaatccacattccttcccatagcctgttccctttctacttccctggcctcgtcttatactgtgtatgatagccacactggccgccttctatttttacaaagattgctgtctcttttatacttgatgtttccctcttcctagaatactactccctccaatctttatatggctggctccttcttattatccagatcgcatctcaaattgtctccacagagagtgctttattgatactcaaactaaataacaacacccttgccccacaattacatttcattccatgtttttccattattacaatttaaggtttcacagcctttgtgtctgtaattattttatttgtttatcatctggtttcctctaattgaaataggtccgtgaaagcagagtgtgatctctccaatcctgtatctccaacactatgagcagtgttgagccataagtccaaaaaaatgtttgttgaaggaagaaatacttctagttcccacaaattatgcaaagggtaaagtaaaatctgtctaaatattatgagggcaccaagagggttacatttgtaaaaagaagaaataataactatgtaagctgaaaactctgtattactgactccttataagaggactataaaagagaagagtaaaatataaatcagatgatgaaggtataatattttcacatgttttgttaatatttagtttaacctaagtcatgttaggttggtgcaaaataagtgtggctttgacattacttttaatggctaaactgcaattacttttgcaccaacctgataaatgtaacctttttccaggtggatgtcctagttggttagtgatgctttttccattagatttgaagtcattgacgttgtccaggaaaagaaaagagcccaggacagagtttttggaggatatgaacaggcagaggaggatgaaaatgaaaagccagaaagattaataggaaatcaggtggatagggggatgtggtaatgttggtgggggttacctatgtagttctagtaaagaaaccaaaaggcaaaacagaatgtcagaagggggcaagtgatcaacactattaatgctatgaaaaagctaatacaggtaaggactgagctgtatgtgtcggtgaaactcaagctgctgtaacacataagtccttgattgacaatggtttgcccagtggaaggttgattctcaggagcagaacagtccaggtaatcttggttggcagggagctttgtaataattggagaccaggtgtggaatctgtttttgagtggctataacaggatacccaacactgggtaatttataatgaaaagagatttaatgggctctgcagactgtacaggaagtgtggtacaaacatctgtttctgctgatgtcctcaagtagtttccagtcatggcagaaggggaaggagaaacagatgtgtcacgtggcaagagaggaagcaaggtgggaggtgccatgctctttgaaacaaccagatctagcatgaactgacctatcaccaaggcaactgcgctaaactattcatgatcccttgtaatccaaacacctaccaccaggccccgcctccaacacggaattacatttccacatgagattctgaggagacaaacatcaaaattatatcatcgggttccttccttcttttggcctcactctattttagggttccagagtcccctacattcagctactgagtgtggaaaacagacaagagaagtcacaactgctttttctaccccttagcctagaaattatacacatcacttctactcatattccctaggcacaaggtcccatggttatgcaaaggagccaaaaaatgtagttggtagaagcagctatttcttggatatagatttatattatggaaggagaagcagaaataatgatgggcagtgacccatcttctgtgatactttagaaatttgtgcaactaagtcatttttcacttcataaatattgattgatctcctaaaaatataggactacatggtaatttgtgtctgctcccaaagagttataacttattggaagaaataagatttacaaatgaattatggtaattcaaagatatttctgatttattcgtgtaaattttgggatagaaaaatagatgagaacagtagaaaacaagtacatgtgtattactaacccagcaaaaatataaaccctttttactgctacattttgccattttcagaataaacttgcataaattctcctcattcttagctcaaactgtgctgctgattggattgaactacttgtatatgaatgtatcttggtgtgatacgtagcccattaaaaacctagtatggatttcttaactaaaatcctgtattcctaatttacgttgatttccatttttttaatctcaaagtaatatttcagttttattattgggtaaacaatgtgtattctggcttagaacactttaaagttatttcagaagaggtcacaggggaagaaagatccagaaaagtggaatattttcatgaatcattaagttaataactttggaggaggaaggtatgtctagaaaaggcttaaaacaaaacgattagacttactttaaatatttttatttcaaattaagtagatgaagatggtataaatcaggagttagcaaaccttatattgaaaagggccggacagtgaatactttaggatttgcagaacgcatataatcttcgtcacaaatattcaattctgccattacagcatgaaagcagacatcagagacagggcaaaagcataaaccagcgagtgttaatgtatttcaatagaagtttattaattgacactggactttgaatttcatacaattttcctacattatataacattattctttctttgattttccctcaccatttaaacatgtaaatggaccatgcaaaaacaggtggtgggctggtttggcccataggctataacccctggtatatagagccattaacataaaaatacaatttaaagctaatttagaaaattttacccaaagctgtgtaaattataacacattaattattatattctacatactcatttagggtggaactttataaaatatcttttaaaaatatataatatataagatcatgttatgtactacaaaattttaacacaaacattaacaccccattctttgtgtttttttgagaagtttttgttgttacttacacgaatgaagctataggaaattatcctaggtcagttcaacagaggagacattttcagtcttgctcatgtttagcactctttgaaagtcttgatgctcaattagtcaattagtagccgccagatggagaagggtatttcttcacaggaacacgtgttgctatgtgtgtgattaagagggtgaaagatgctgttgtgtgtcagacctctctgtgttccttttagatgtcactagctcaatcaccaagggcaatggaccataagatacttatgtatcttctgcttggcttcatgcttgatgcctctgatcagactcagtgtttcatttccagtatcacagatgacagagtaaaatgcaaaatgtgttgctgcacatgtcaaaaggtccagagaagaaaagacagctctacttttgcatttggattaacagcaattgaaaataaatgcccatttccaattctttgatattgtttaaatttatatgtttgatatctgtttgttattatctacacgtatccagggattatttgcctaagctgcaaaattggaaaaaaaagtacagatttagaaaatatgctgccaatggcttaattcagattcattgttaaaccacaatattaaagtacactgttaacataatgtacactgatagttttgtttgataattacctacttgaaatagtagactgataaattgtcccaattggagaagaccttcaaccatctatgccaaccttctagactgcaattattaattaatcatttctggaacaaaagctcctaaaaatggcttttaaaattgtgttttctgctgaaagattctgctgaatggaagtgggagtgtgaagcctaggaaagaatatattcatttcatgtttttgattagctctgaaattttatttaccctcttacctagaggaagagtgccagtgtatattccctaatcctctgctcaggaaattcaacactttctgcaatttgtacttgaaaaaaggtacacaattttagaaaacatagacaaaaaaaacagaacaaaaccaaacaaaaggcaattattgatgtgaagcaaaaagtattaatgcactaaagagttgcttcaggatgcctcccttgccccatcgctacacacaactaccctacaaacgccaagattcaaatgtgatactctcttccatattacatttgaatcttctttttccaggaaaagcagagtatgtatgggtgtacccatagtaagcatgagggcttccattgtttttccatttggcgagttgaaaaacaagtgtgctgcattctcctgtctgttacggtacagatatcttcattggagcactatttgtgaagcacacagttttcaagtcttctagagcaaatttgtttgtcaccatcagaagggctggaaataaaaatatgtttgcaattgacatagtgcaggaactggttaacagcttcaaagaatttataaagaatatttgtctctgaaatgttataaatacccatggtgaaaaagacctacttagaagatgttttctttaatattcattgtgttttaccaaatacagtgaggatatatgagcaattagaaacatgtgcctgcaggttggctcttgctttctttgcagacctactgcccttcttgttcttcctctccatcattttcattgccttgttaagatttatctggccaggcgcggtggctcatgcctgtaatcccagcactttgggaggctgaggtgggtggctcaactgaggtcgggagttcgagaccagcctgatcaacatgaagaaaccccatctctactaaaaatacaaaattagtcgggtgtggtgggacacgcctgtaatcccagctactcgggaggctgaggcaggagaattgcttgaatcctggaggctgaggttgtggtgagccaagattgtgccactgcaatccagcctgggcaacaagagcaaaaccccatctcaaaaaaaaaaaaaaaaaaaagatttcttaacctgcttttccctccgttgcttttgcctgtttccctttcctagttttcactttatttttttttctctctcctattctgttttttattctttgttccactttatattctcccttggtgtgaagaatggctgcagttttagtcatggctataagacaatgtcattttagagagctaatgtgtcctgtcattgaaaggatgagatgataacagaagtaagaggggctggtgtcctacatctccacggcaaggatttcgcccttctcccaatggtgtggttcattgaaatagctccacatcctcattaagtttatttttatagtatttctgtctctaatattttttccccatggaaagattaggttttctttttgagtccttctggctctcccattgtccctgtttgctggcagtggaaatgctataaatcagtattgaggtctggcaattttgcatgccgtcagctaaacataatgctgttgaaattcaagcacagttctttttaagtagacatttaattttagtagaatttgcatttgacagtttgaattcatgtgtttcagcatctgagtgaaatagccctctctgagttctaatggaatgaatttagtgaaattaaccttttgtcacaaaaacacactatcctaggcaaaagttttcacactgttttcagtcagttctatgtagttataatagaatgaatcttcctaatttaagtcatagaatgataaaagcagtgatgaaaagagaatgtacacctaggagtccttaattactctgtgaagtgccagcaataagtatgggacattgacgtgaaactccagttcattacatcaaaaaaaatattaatggtgagatgtctgacactgacaaaatacctagacataacaaagtgcttgtggaaaatgcttgaatttttttttttttttttttttttttttttgagacagtcttgctctgtctcccaggctgaagtgcagtggtgcagtctcggctcactgcaagctccgcctcctgggttcatgccattctcctgcctcagcctcccaagtagctgggactacaggcgcctgccaccatgcccggctaatttttttttgtatttttagtagagacggagtttcaccatgttagccaggatggtctcgatctcctgacctcgtgatccactcgccttggcctcccaaagtgctaggattacaggcgtaagccactgaatttttaaatttactcttaatatgtattcttgagctaattaatgagaaaattcaaacaatcatattcagtaaagttaaccatcaacacagtcgataagtttttcacaaatattctcccttttctttgaaataaagaaaccagatatagaaataagaagtttctattttaaatatttaatatttcttctggacaacattaaagctattaaacaatgccattggccaactatcaattgttaagtgtgtccaaaccctggcattcaatttttttccaagacacttaaacatttaaagtctgtttttaaaatcttaattatttttattaaaaaaggatttttttaagaaaaaatgattttttggtaacactttaggttgcaatttttttaattttaattttttttatttccataggttattgggaaacaggtggtatttggttacatgagtaacttctttagtggtgatttgtgagattttggtgcacccataacccaagtagtatacactgtactcaatatgtcgtcttttatccctcacccctctcccaccctttctccatgagtccctaaagtccgttgtgtcattctatgcctttgcattctcatagcttagctctcacttatgagagagaacatatgatgtttggttttccattcccgagttacttcacttagaagaatagtctccaatatcgtccaggttgctgtgaatgccattaattcattcctttttatggctgagcagtattccatcatatatatgtacaccgcagtttctttatccactcattgattaatggacatttgggttggttccatatttttgcaattgcaaattgtgatgctataaacatttttgtgcaagtatctttttcatttagtgactcatttacctctgggtagatgcctagtagtggaattgctggatcaaatggtagttctacttttaattattcaaggaatctcctcactgttttccacagtggttgtacttgtttacattcccgctagcagtgtagaagtgttccctcttcactccatccacgccaacatctatgattttttgattttttgattatggccattcttgtaggagtaggtggtattgctttgtggttttgatttgcgtttgatttgcatttccctaattattagtgatgttgagcattttttcatatatttgttggccatttatacgcctttgagaattgtttattgaccttagcccactctttgataggattgttcgtttttttctaggctgccactgttttaataaaatagtttttttcttttttactagatcattcttatgattcagttttactagcatttggcaattagcaattattgtatataaataaagttgtttcgttctctgaagaacctgcagagaaccctcgtctggagaaaaattctgtcaggtctaatatttgttaagttcttaacaaagaacctggaacacaggcaaagctcaataattttattaaattcaaactgcattcttgctggtgagcaaaaccagtgtctaaggacttacatgctacatagttctttgatgccaacattagatatagaatgattagcaaatacgttccaaaatgcttaattcttgtgaaaaatgtttcaaggtatacttgaggtattatccttttttgtaaaggccatttgagatgacaatttttgaactactttattttaaaagcatttattattaagaaattcattaattagtactcactgcaccctacttttagtcctgcataatgcacctgtatttttgtactaaaaggtaaatacaaataaatgaaaatgaaaatattgaactctaagtatgtcaggattcctatagacatttcacactctgagattatgcaaattatgataatcatgttaataaagatttggatgaattaattgttattcaaaatggattagtttgcaaaacttcaaattagtctaaaatggagagatttttctggcctcattctatcttcttcgcaggtctttgaagacagctgtgtagtatagttactgtgatgatattgtcacagaaataagttgaagcattttgtgtattttgtgtactaccaatgcctaaataactaactgaaaaatgtatatatattcatagaaagataccagggacaagtggaaagttacttaacaatgatgtgaactttgacatacttaaactctttcggtctcaaatttattgttcagtacaatggttaacaataaggtggttataactattttataatcatcctataacaattgagtgactgtaaaaatgaaataagataaactttcattaaagaacctagcatagtataatgacaggtacataaaagtcctcaagttttaattcttatccaaattcccgtaactctatttccaaggcctcaattttctcacgaaaggcctcttactttctgaaattctatgatttagtttttagttcaattaatattttagcaaatgagtaagttaatgaattaatatatttcctttagagtttactttctaatgcacatgctgttatggtcctatatgaggaaatgtcttttaatgtgcaatattaaaattcacggtcacataaaatgaataaagttttaatgtagaatataacatttttgaattctagaattcaacttaccagagaaagaaaatcttagaaaacctggttaaaatggcttttgataagcacattgaatataaaaacagggtatttatatatatatatggatatgttttctatcttattttcagatcgtaattagccactatataggttttgtccttcacagaggtagaaaaaatacatttaatcacttccaaaaatctgtttgagtcctgatagcctgatatcctttgaaatgcttaaactttgtatttggtatgattcgagatttcactaaattctctattgtccccacgaaaatgacttatttgggtagggggtatttcttatcttgttggaagctttataaaggatcagttattgtatctttgagctgatgaaatagtttaacactgctcaaaacttgtccaagatgctgatatgtatcttcagttagaccatttgaacacatgactaatacacagaccaaagagaacattgtttaaaagaaatcttatcaagaatcatgtaatagatcttaggctatttggatttcctcacaggaaaatagaagcaaaggcagtgacagcaatactcaaagtaggaattgagctctgctccatgtggataatgacaacatctgcatctgttgtgaacttgctcccaaatcggagccctgtgtttttcagcttcctgatgaacatttctactttgtactgcacaatcgcctcactgttaacattctgaaatccactcatttttcctctccatatttctttcttacacacctgttcttcttgtctgccagatgtttgctttatatcacaattgtcttttccccctaatcttggcaactcagcatcatctttgattctgttactgattgggtctgagatggagataagtatgcaggaggtttagcgtgtaggagcatgtaggggtgctcttgggatcactacctgtggaaaggaagggaaggaaagaaagaaggattgggaagagataaaacttgggatgcaatgtactcttaccaaagcctagagctgacctcgttagcagttttaaatctaggatgtcccttcagtactggcctgtgttggggtgatgggactgaggcttttgtctccactttggccagtcactggatacaggttgccccaggaaacaagtagtagatgtaggacaaagtgactttttctcagccaaagaaatttggctaaaagggctaagaagttcttcagtcaggaagagatcttgtcagcacataacagtatccactggagactcctttaacacaaacaaacaaacaaacccacaaaaagctattatacatgatcagatcttgttttcttcatgattttaaatttccaaatctcatctcttgctgcccaaccaccaatctaggttaggagcttatagtgcctaacataggcacttatgaataagtaggacctcctaaatcagatctatccaatccatcccttatccatcgcatttttcaacctcatgaaatgcttccatgagcccataattagcccgtttagtaactcgttggctctccattggcaacagaataaaatgcatttcttagcttatgattcaagaacaaccactgtctgtctaaataatataggtgttgtcaccccaatcttccaagcacatgttttgctttgttagtgccattgattttttttttttacatttaacacctaaaataaaagatctacttggcttatatggaaatcaaatatcacatagttatctggtcatatttacagggatattatgtccaataagccatatttacctacaattttacttaggtcctgtagagaaaaataaaaaataaaaaaaaaggggttgaggatttgcaagaggacatagttacacagatctaatgtacaatgatatttgaacttctgtggacttgttcttatgagtaacatcttccattttaattaaggtcagatgaaaactttggcattatccatgctgagtcctgagtctcaatcattcaatgaatgagttgctaggacacttagttcaattagctatgaggtatacacatggacagaatgttttacaaaacttggccctactgacttgagactctcacatgtattacaaaaacaagtgtatccccatggaggtctgactgtatatctgccttgtaagatcatggaatgttagttgtgtttaagttcctttaaccttctttctcaatttataccttgtttaccactaaaaatagacacctagccttagttgttttggttttaagattgtttcatttatgagtatatactattctgtggctgatttttttttctccctgatttctcttcccctgagttccaagtacttttcacaaagaaaaccttgttcataattaaacatttcttacctcaggcttggtttcagagagaaaccattcaatcaaaagagtgatggaattctgtcactctgatgttatttttagaagttgtttgggttttgattgacacatgttttgtggtctgtgtgtatgttgctggggataatttaattttaagacattaataagaaaagctcattgactcagtcaaagggaaaatgactttttgaagtcaccacacagttttaagaagggatcatagacaaggagaaaacggccaaggaaactttggtttagctggagtgtcgtgccatagtcagaggattctgggggaaatagaaagccctaagaattagttcatatgtgaaaccccacctgccattttggttgatttcctttcttatatcctataggcaaatttccagtgcctactggtttcagtttaataggtgagaaaagcataacacacataaataaggtttaaaaaacttttaaaggctcaagaaagaactaaatgcattcagaaaaaaagaaaaaattagatctagcccagtctgaaaggaaaaataatggcagttgaaatgttgaaatttgattgaaagatttgagatatagtatttgaaatatagtattctaaatcatttaatttagaataccattaatttttaaatattttgggattgaaatcagttcataatgtagctagagaatttaattcaaatgtaaaggaaggacacctgatatgcacttcaatatcattaaatttagaggtcagaatgaaggcagaagaagagagaaatgattctgcaggaccaacccatgtggtaacatatttatgcagaccaccccaacatgatcggaatattactgccacagtggggcacaccttgaaatatgatgaaatgtttcaaggttgttaaataagaaagaagttacgaacagaattgttttcatcaaattttcactgtgtaataacacattgtaaaaccaatataggagtggatttacaaattctgggcatacataagcctctctgatgacttagctaagctggttttgaaaagaaagtgcaacataatggtgaagattattcaattttgctcgtggaaacaattgggcacataatgaatcaagaaaaatgctgagatcgttgaacaacaaaactcaacacgatcattttttgaaatcttccgtgttgttatggtgatttgtgtatttagaacttaacaatgtgaatggcatgaagaataagtgattatgcattgctgaatgcctttacaagagttcgctaagaagaaattactgctttatcataaatgtattgttactgcttgaatgatgatagctgtatatttgtccctttactcactcagcaaacactattcatttcaaggttttggtgttacatcaagcaaaagactccaactgagaaatggtactattatatacacacacatctcccttggagggtttctgctatgaatcaatattatggaatgactgtgtagcataaacagtacatagcatcttttagataatcatatttagaaacagaaatccttttatatgtgtattgttatagtttcatgttaaagaaggtaaaaatcagcagaactacttttaaaaaaaatcttagagtaatacctccttcccatgagcgttagtaaagataggaaagatgatcgttttatgctacatattttcctattgccaggtcaagtattataaaatttaatacatattgttgtaggactttctccttagttcagctggaaacagtgttcttgtcacacaaccatgaaaaattaggctcacagacactttgaagggtgagaatggcagggtttattgggtaaaaacaaataaaaaggaacagggactctcagcaaagccggagtcctgctaccaggtttcctgcctcatagattgaatcccaggttccaccccagaacaggagaggccaggctcctgccccctgcaaatggaaagaacttaccggctccaccccattctccctgtacacaggccaattagagtttctctggggacccctttgtacctggctgtctcaatatgaagaaaaagtagtcatactaagattttttttttctagaaccaactatctaacataactgtcaataattagaaacaaaactgtacaaaaatacttattatataaatttttaaataaatccttgctaggactttgctctctgaaatttgaaagtatattttaaaacaaattaatgctttatctccttcctaggaatgtattcctcacattgtaacaagttgataaccagaattataattgctagtgaatccgttttcttattctattctctgctcacacatgttttaagatgccatgcggttaccagcagtgaatccgtatgggtctgcagcaacctcagttcttgcctcctccaaagaaagaattcaaccaaggaggcagaacgcaggagagatggaggcaatagagcatgagtaaaagtttatcataaaagctttagcgaaggaatgaaaggaaataaaatacacttggaagaaggccaagcgggtgacttgagagatcaagtgccctatttgaccttctgacttggggttggcatatttctagggtcttgcatctcttctcccctgattcttgccttggggtgggctgtctgcatgtgcagtgggctgctggcacttgggaggtgagcaagtgcagtgtgtttactggacttgtatgcgtgctcaggtgaggcattcttcccttacaaatcgaatgaacctagaaggtcatataacaagtaaactctgccattttgcttcttaaagctcatgcttgagtccactccctgaactcctgctgattgcatcaccagtttcaggttttttttctatctattgggagactgccttttcctggcgctggctgtgaccagttattattttagagaggcagttaacaaccacctgcccatcacctgatggtggcccgacattcctggtggagagcagggagagctccctcctgccccgctcaagccttgttactacctactgtaacagtgctatatagattgtcatgatgattttacaggtgtatacgtatccccaaattcatgaagttgtacatattaaatatgtacagcttttttaataccttattaaagtggtgtaaaaatagtcgtgctacatatgactattttgtcatggccactactgtcatcttgagcattgcaaattagttattctagatgaaacaaaaaaggcttgcctttgacaatttctcaacatgtttagtattttccaggttcaaccaataccactttgaactgctctaaatcaagtaagccagaatgtgtctggcagctgaactactgtgaacctaataaatattatcatcattttctattgctaatcaggagttgcattttaggcaatgcaaagtgggtggggtactcactttctgtagatgattcatggaactaacaatacataatacagcatcaaattaaaaacttatttaagtccaatctatgtgaaatagaacaagtgacaaatgacataggttactagtagtaagtggtaagggagctgggttttgatttttttttaaacaaattcttttctaatgcatttattgcaggcacagagcaagtaatcttaccatcagagtttttgtactgcactctattttccttttcaagaaaggaatttcatgaattgttttaagcacagctgagtgttattgttcctattttgtgcattactgttaaagttctcatttccttttcaaatgtgtaattttaaagacgtgatgaattcttaagaataattttatgatgattaggaaagcaatttttcgagctatatacaatttaaattttatagtgacaatcatgaaaaatagaaatacactttgcagcaaatttgcgaaattatttctgctaaatgagtgactcacataaagcaatttgggtttgttttattttattttttgtcattacatcatgcagctgttttcctctatcccaagaatgtaactagtgattgtaggatcatttcaaatactcaattgtaaaatggcagttttacatatctgtggtgatttaaaactctcacacacatgggtgttaatggaaactagttactttatgagtattaagataatttattaatcttaaatataacttttctcattgtggatgtttttggtgaacaaatacattacttcacagttatttttgtggtgagaacacttaatatcaactctctttgtgttttttaagaatacaacatgattattatctatggttgccatactatacaatagatctctcctcctatttagctgtaattatgtttcatttgagaacatctccacattcttccctccaaaccactccagcctctgttaaccaccattctattctctacttctatgagatcatttgttttttgattctacatatgagtgagatcatgtgacatttttctttgtgtgcctagcttatgtcactaaacatactgtcctccagattgattcgatttgtgataaatgacacgatttccttcatttttatggctgaacagtattccattgtgtatatatactatgttttaaaaatccattcatccattggtaacatttaggttgattccacatcttggctattgtgaatagacgctgtaataaaaatgagagcagatacctcttcaacataatgactttatttcctttggatctataccattaacaaaagtgttagatcatgcggtagttcaatatttaatttattctggaacatccatactattttctataatgactatattaatgtatattcccatcaacagttgataagacttctgttttctccacatccttgccaacacttgttatcttttttctttctgataatagccattctaacaggagtgacataatatctcattttggttttgatttgcattgctgtgatgaataatgatattgaacatttttatatgcctgttagtcctcttttgggaaatgtgtgttaatgtctttgcccattttaaattgagttatttgtattcttgctattgagttgtttcagtttcttatacattttgaatattgacaaaatttaacctacatttatcataaaagcactccatgaatgtatcagatgtgtagttaaccagatgtatagtttgcaaatattttctcccattcagtaggttgtttcttctgtcgattttctcctttgctatgcagaaacatttcagattttggtaattccacttgtctatttttttgcatttgttgtctgtgtttttggaggcatatttaaaacaaaacaaaacaaaacaaaacaaaccttgcccagaccaatgtcatggagttttctcctgttttgtttttgtttttgtttttttttagcagctttatagttttgcatcttatgtttaagtcttgttccatttttaattgattttatatatggtgagaaataaggatttagttttattctctgcatatgtatatccaatttatccaataccatttattaaagagactgttttttcccccattttgtggtcttagtgcctttgtaggaaatcaattggctgtgaaaaagtaaatttatgatttttttttatttctgtgaagaatgtcattggtcctttgatagggatcgaattgcattgtagatgactttaagtagtatagacattttaacaatattactactttcaatctacgaacataaagtcttcctttttatttgtgtcttcttcaatatgtttcaccaatttttcataattttcagcgtagagatctttcacctccctggttaaaatttttggagtatttttttatacctatcaaaaaggagattattttcttgatttctttttcaggtagtttactgttagtgtacagaaacactactgattttgatttttgtgttaatttttatcctgcacctttaataaatgtgtttgttagttccgacaacttttggtggagtctttagagttttctataaaacggatcatgtcagctgcaaacaaggatactttaactttttttttccaatttgaattccttatattacttccttttgcctaattgttctggctaggacttctagtaccatgttaatagaagcggtgaaagcagatgatatggtttggctgtgtccccacccaaatctcatcttgaattgtagcttccgtaattcccacttgttgtgggagggaccccgtggggagataacggaatcataggggtggtttcccccatactgttctcgtggcagtgaataagtctcacaatatctgacagttttataaggggaggctcctttcgcttggctctcattctctctcttgcctgctgccatgtaagaagtgacttttaccttccaccatgattgtgaggcctccccagccacatggaactctgagtccattaaacctctttttctttataaattatccagtctcaggtatatctttatcaacagcgtgaaaacaaactaatacagtggatgtccttgttttgttctagatctcaggggaaaagatttcatctttcccatttaatatgttagttgtgggattttcatatatggactttattatgttgaggtatttgtctatacctaattcatggagtgtttttatgatgaatgcatgttaaattttgtaaaaaggtttcttctgcatctattgaagtgatcatattatttttgttgtccactctgttagtgtgatgtgtcacatttattaattcgcatatggtaagccatcctttcatctctgaggtaaatctaacgtatcacaatgaatgatgttttccatttgctgttgaatttggtttactagtattttgttaaggatttcaaacctatgttcatcaggaatattggccagtagtttgtgttcagatttaattgtatcaggataatgctggcctcatctaatgggtttggaagtatttttttcctgtttcaattttttagaaaaatctgagaattgatattagttctttaaatgtctggtagaattcagcagtgaagccatgaggtcctgggctttttactgatgggagactttttatttctttttaatctccttattcaatattggtctgttcagagattctacttcttcataattcaatcttggtaagttgtgtatgttcagaatttattgatttctcctaggttatccaatttgttggaatataattgttcataatgttctcttatactattttgtatacctatggcattggttgtaatgtctgcttacttgtctctgaatatgtgttgagtattctctttttttcttactctagctaatggtttgtctacttcatttatcaattcaaaaaactaactcagttttgttgatcttttctaaggcttttgtagtctgtattttatttatttttgctctatctttattatttcctcccttccttcttattttagatatgggtttttttctttagtagttctttgagatacaagattaggttgttggagatttttcatatactctgatgtaggcatttattgctataaacttcttttttagaactacttttgctatatcccgcagaatatgttgtgttcccatttatatttgtctgaagaatattttaaatttcatttttaaattttttcattgtcccattgtttgttcagggacatgctttttatttccatttatttgggaattttccaacgttccccctgttattgatttctagttttatgtcactgtggtctgaaaagatacgtgatatgactttaatcttaaacttgtggaggcttgtttgatggtctaatatagcatctatcctggagaatattccctgtgcaagtaagaaggaggtgtattctgcagctgttggatggcttgttcttatgtctgtatacctgctatattcatttagtcagtaggacagtttcaacatgatgtttctatgttgattttcagtctggatgaactatccattgctgaaagtgaggtgatgaagtcgcttactcttagtgtatttcagcctatcgcttccattttattaatatttactttatatatttaggtggtcctatgttgggtgtatatatttataattattatatcatcttatcgaattgactactttataatgacctttttgtctcttttcacagattttggcttaaagtctattttatctgatataactatacctagccttgcactttaatggtttccattccctcatttttagtccatatgtgcccttacctgtgaaactgtctcttgtagtgcatttcaacatataattgagtcatttttttaaattcattcagctattcagtgtcttttcattagagaatttttttattatttatatgtaggaacttactgctgtctttttgttacttgttttctagttgttatacagattcattcttcctttctttcttactgctttcctttgtgattaagtaattttcatgaaaattgttttattctttgctttttctgttagcgtatctgttataggcttttgagttaatgttaccatgaggcttatgaaaatcatcttattgttgtaacaagttattttaacctgataacagcttaagtttgattgcaaaaaaaaaaaaaaagacaaagcaaaagcaaaaatgtttacatttttactcgactcctccctaacagtttgaatttttgatgtcacaatttacatcattttatattgcatatcgattaacaaataattttagttattattattttaataattttgtgtcttaactgtcatattaaaatgtttggttgctacaccatcatagagtaataaaatattctgaatttttgtgtacttacattacagtgagttttgtactttcagtgatttttgttttactcactggtgtcctttcctttcagcttgaagaactccttgtagcattctttgtaaggtggtgactaactctctgcttgtgtttgtctgggaaattatttatttatcttatttctgaaaaacagctttgcagggcatagtattttttgttgacagttttttcccccagcactttgaatatatcatcctgctctctcttagcccgtaagatttttcttcagatgtctgctattggcttattagagctctcgtcatttgtggtttgcttcttcgctcctgctgctttccaaatcctcttttttctttgattttgacagttgcagtataacttgagggtaatcttttttaaattaaatcagaatgaagactttttaccttcctgtaaatatttctatctttctccaagtttggaaagttttctccttcaatttttaaaataatattttacctttaactgtcattgcttttttttgaatgccaatgattattatatttgctcatttaaggttatcccagaaatcctgtaggctttctgcattttctttatttttatttcctttttcccctttgtatattttcaaataacttgtgtatcagtttagagaatcctcttccacttacgaagttcttctgttgatactctctatagatttttaaaatttcatttgttgtaatttttagctctaggatttctgtttgatttaatattattattatttcaatttattatttcctcatcatagtcacaatgttttcttcatacctttagctgtttttctgtatttttttgacatttgttgagcttccttaaaacagttatttttactttatcgtgaggcatttttcatacatctccatcttttcagggttagttgttgccaattacttttgtccctttggtgacttcatgttttcctgattattcttgatttttttggtcatgtgctgatgtctgcatactgtagaagtagatacttattccagtctttgcagtctgcctttgtctatgaatatccttcagtgttaagcctgtccagaggttaagagtgggccacctggtgtgatccttaagcccgtgaccactgcagctattgcagtactagggggtgccctatatcctgaaccaccatggctggtatagtgactggtcagaattttatggatacagagcctgccacaatgcagggctaaaagtccatgaattctataattagtgcggtgctagggtgtgcttgaagcccatagttgctgaggctagtgcagcagtgggtcatgtctaaatcccatgacctctgaggtctgcctgttgtggtaggttatttagaatccaaggctgctatagttggccagtagttatgtgaactagaatttgagtcattcttgcagggcctgggggttcctatcttgcactatggtgggtctaaaggatcaggctacagataccaggctaaaatcagagatcatgcaggtctacctaatgctggtttttactgtggtgggcctggtatttgtgtccaaggcaaagttctacgattgcttacctctctttctcccaagtgaacagtgtctctctctgctctgtgctacctggggttggaggttgggtaacatgggaaatgcaaaaatgtccgttctaccttttttggtgtgtcttttctaattattgtgctatgacaaggtacagtcatcttttacttggttttcgtagctcttgtgagatatttttacctatggatagttgtcgaaattgatgtttcttccggtgggtgatcactggagagtcttaattgacagtcttgctcggccctcctcaggtttgactattcttaatgtcctttttctattgggcacctttaaatggaacacttaaaacagacacgcatcttttaattattttacagatgagtaaaagaatcaaatgtgaatttattcaaggtaataaatattggtttaaagaaattaccatagatcttaatatagagaaaatcataattgtggcttacctataaagaaggcttggtgctgggcattttcttcttcattttttaaattctgtacgtctttccaacacaaatgccttctaaacactgatgatgctgtaattcttatctccagccatgaattcttcataaaatctgagacttatttccaaattcctctagttagaggactctagaaatcttaccaccccatgaggatagttataatgatctgaagtccaggttcccctgtaacaaagcttgtcaggtatttgaaaaaaaagaaaagatgtaacactgaataaaaaagaaacaaaatataaggaaaaaataacttggaataaatagaaattgtacaggggaaggaaagcttaaaaaattaatatttttagatagatccaaataatttatttaaaaatgctataataaatagtgtttggaaattaaaaataagacatggtaaattaaaaatgtaataggagacatttaaaaaaatagtcaatatgtttagagaaataaagttgagaaaggaaatcatccattaagtaaaacaacataaggcaatgtaatagaaatatataataggtagggtaataaagtgtgataacaaatattaaaataatgaaaattatacaaagagaaactttaaaagatgcatttattatataataatttactgtgagctatgtgttttcagaattaaaaataaaaagagaatgtccagccaaatggatgaacatacactcacatagagacatgtaattatgaaacttcagaaccataagagtaaaatgaaggttctgcagcttcctgtggggacaaaaacaacagcaaacagaaaatatatcacatacaaaggatcgaaactcaaaatggctttggactttccaacagcgatactggaagctagaagataatccagttgtgcctatagaattctgaaggagattatctccagtatagaattctatagtgagctaattattaatgagttgttagaatgaacacatacattctcagacaaacaaaacgtcacgaaatttaccccctttactttcatgccaagcaagctactagaggattatttccatccatttgggctgctataacaaaataccataaactatcaataacagaaatttatttctcacagttctgggggtcaagaagtccaagatcaaagtatgagcagattcattgtttggtgagggcttgctttctggctgatagatggtgccttctagctgtgtccttacatgtggaagaatctaacttgctctattgggtctcttcattagggcgctaatcctaatcatgagggcacttaccttagaaccttaacagctcataaactccccacctcccagtatcattatcttgcaggttagggtttcaacaaataaattttgggggacacaaacattcagaacatagcaaggatgttccttccaaaaaaaaaaaaaaaaaaaaaaagaagaagcagcaaactggaaaagaagacaaggatttagaaaaccaaaggactaacagaaaagggttgtatctctagcattatgaggaagagaagtcccagagtgactatctgtcctttcaaacaaagaaatgaataaggaagatattagagggagcataaagagagtgctacataaaaggcaaattaaattctgaggctgacaaaaaatgaaagtcctatattgacagctgtatagcatgactagagcagaatcaattccgatagaactgagttctccatgtaggattgcaagtagattacattatgtgattgatcttgtacgtaattataatgagagactactaaaacataagaataggcaaaccaaccccccccaaaaaagtagcaagttaaaaaggggctataaacaaaaagcgagaaaaaaataattattgtacactacactgataaattttgaataatacttgcaaagttatattaatacaaatatctaatattattaaaccaaaaaaggcaggataactaaactgctatgataaaaaatggggaatagaggaaataacaacgtaagagttaaaatctcaactaaaatcagtcaatagaaaatatttaaaattaataaatcaacaaatagatacgcatgcatattatttagagatatatataagatatatatacaagaatgccacagtaaagagtggataatggtgattttgagagataaagcaaagaaatgtctacttttgttaggaaccgtttaatgccatttaactggttgggtgcagtggctcatgtctgtaagcccagagttacgggaggctgagtgaggtggaaggactgtttgaggctgggagttcaagaccagtctggactaatatagtgagcccccatatttacaaataattttttaaaaattatccaggcatgatggtgcatatctgtagtcctagctactcaggtggctgaggcagaaagattccttaagcacaggaattaaaaattactgtgagctatgtttatgccattgcactttagcctgagtgacagagaccctgtctcagaaatttcaaaatatcatttaactttgtttttgcttgttaattaggtacaataacaatacattcaaaataagaatatatttccatgatatttggcgaggaaatatatttggttagatgtacaaaaaactattgaagaataaaatcgatgaattcaataatattaaaacttaaaactcatataccaaaaaaaaaaaaaaagaaaaagaaaaacggtaacaaaaataacaagaaaactacaggaagaaaatgaagccattacatagattgggataatataattgaaacttaaacaacaaatgaaatatttattttcagaatatacaaagttctaaaaataaaccagaaaataattgaccttgtagaaaaatgagcaattggtcataacagaagaaaaaattcaaatgtccaataaatataggaaaatttacaaatgcaaattaaacaaaaacatgacacttcttattggctatataggtaaaaatataaatttccggaataccaaatatttactggcaagtggggaagagaaattttgcctcatatactacttaaaagtctaggttggtacaatcacttttacaaatagttaaactgtcatcgtatggcggagttgaaagttaatattcctgataagataaatgttcctgataagagaatatttacactaacagaatcttagtttaattcacatatactgatctaattactgcaactcacacttttattattgcctttattttgtagatgagaaattgaagcatacagaattaattagcttctccaaggctacctagctagttttgcttgtgttaaaacgaatcaactagataatatggaatatactggaaaatatattgttgagtaagaagtaaaaacaaattgttgagagcacataacagtgataaatgtataaagttttaaaacacaaaataaagttttatgtgtatttaaataatacagtgacttattccaaaatcagaaaagcacagatgtggaagacacccaccaaactgaagatagtattggtctctccggaggcaggatcaaaatatcaggaagagcttcaaagctatgtcatattttattttttaaaatgatccaaaatatatggtaagattcaaatacttgttaaatctgggaggtgtgacatagttatttttgtattattctctctgattttctatccacgggaataggaatatttcataactttaaaaagggaaatgatgtaatcggtaacattgttgtctcctctttaatctcacagatattcctaggagcaacccttgttattttttatgatccatacacaataaccaatattttaaatatattatacaaaagtattgtagagaaggaaaaataatttttttctctaccctactgggttcctagctggaatagacccctgcaacaaaggacaaatgaagaacataaaagcaaaaagaagtttattaacttgtatacctcatttacatgtgggagatacccagaaaaatgagtaagtcaaagacatggcttagagattaggcctaaataccaccttcaactgaaacaaagaaagaaggatatgggccagggtgcagtgatggtaaggtgaccaagaaaagtatggtaatccatgataaattctattatgcagacttaaaccagtgccttctccactgaaaagagtctctggtgatttagttatccttttcttctgggtactgaaaggaagccacccttgcaaatggaacattcctttagagataagtatttctctttaaaaagagtaacttctacttcattttcagagcttctttgttgtctgcagtttctcaaaataatcagctcaaaataatccttatggagacatattttggggtatcctatcctggtttcctacagtatcatgtatcttattgtaggagggggatgatagtctttttattttacttattttagattctttttcttctactcatcatagagatggctctacccatctggctggagccctgtaaattacactggaaaaagacagattaacaagaaactaaaactaaatagaaatttattaacatgcacaccatgcacatgcatgtatataggagtacccagtaatgagtaatccaaaggggtagttagaatataggcttatataacatcttaggctcaaaaaagaaaaaagcgttttgggcttctgggcaaggggtactagttgggaaagtggctaggagaagtatactaaacaagggttgttttagtgaggtttgttatacagatttatgtaggtgtcttctcaatccataagatttaagagttatccattgcctgatatgggaaagggagatatcttttacaaatagaaatctcctttatacatgtaaatttattttacaaaatgaaaatttatgccctgtttttagagcttttctggtgtctgccattcctcaggggcctttagctcaaaataatgcatatgctaaagaggtgtattttggggttgcatattatgatacctttcaatataaatacaagaattaaatagatgacataaaatgcatattcagaaaaaaagaagattcctcctctcccacaagaaaaattaaatttattttctctaaactaaatcttttctgtattttgagttttaaagtgtgtgataataaggaaaatttatgagtataaaatatcttcatatacacttctagtcatcttccttttagactgtgagaacatgaggctcctgtcattttactatgtttccttgtaatgcttttgttactggggagtatggggtccttggttcctgtcttcttggaggaaagaattctgccaagtgacacacaggggcaattcagcaatggcaatgtttatttaaaggaaaaagtacatgctgaaagccgagtcagggtgggctgctccagaatgagatgcattgactgacactggggaaccccctttatgagagttttacatgaatatttacaaatgggcataaagaggtgttaccagtaagcacattttgggaggtctcaaaacatgtgtactacactagtacatatgtcgcatgtttcattagtattttaaatccccactcatgggtgtgttttttactattatgatgagcaaaatgttacctttagggtgagccaagtcaaaatgcacatgctcgctactggggaaagtccctattgaagtgatttttctgctagggccaggtaagtctcagtgagggctggataagcctaaccataagcccagatgtggctactgttaattctgattgctctaaccacagagcataaattttctttttgcattgattccaagtggtgcaaggtatttagagcttctggggctttctttcctgctatctgtctgtctatctacctgtctatctagctacctactctaatgcttttcttcatacaaataaatgcagtaacttgtcatgaaattttaaaaaataagaaaaaagccaccttttgtataattatagttatattattgaatttcattaacttcatcagattaatgtaaattaaatatctgagcatatttaatttctagtttcttggttgtgggttgtgggctgtgtaagtaagaaaaaagccacctttttttctgggtttcctataacctgactagaattactaaggtatctataattaatgtaaattcagctttcataaaattaaatatcttaaaatatctgagcatatttaatttctagtttcttggttgtgggttgtgtaagtacttcagaactatctttagtcacaccaacaaaagagaaaatcatactcactctccaataagtaaattacaaaaaaaatacttatttccttaatagcttttgacataataaaatacactaaaataaaataaatgaacttctctccctaatcatcaatggaaagaaaagctaagcttctaataaaataagtgcaagttcattttcctgtttcttgttaaaattatttaatatgacaagtgtctaatacattattgcatatcaacacaatattatccactaaggaaacacctaatttggggtggccccacgttttcaatagacccaattattcaacccctaacattctattcattatttttttaggatccattagcaaaatattctaaactatcatttgtagtaacaataaggaaagaccgtgacttgttaatcctggttataagcgtattgaatgacctactcaaggaaggaggagcagaaaataatgagaaccagctggttctaaatcttccattatttctaatatataaggagagaatgaactataatttttatggtcttcatctgacaatacttcaagaagaggtcgcttactatggtgattcattttcaaaatttacactttagtttactatacctggtgtgggaaccagtttgcttcaagaaattataattttaggaaatggaaaaaatatttttcctctattcatattaggtttattggttgggtccctgcaaattagactgaagaaagattagttaacaaaagaaaacaaacaaaataaaaaaaacaggagttttttaagacatacattgtgcatacacacgtaagtacgccgtcataagtaactcaaaggattggttacaatgtaggcttatatagcattctgacaaaaataattttatagataagcagcaaaacaaaagaaaaggactttgaacctctgcggccagcaaattgtggaaaggcaaatatgtagggagactaatggtagataaagcctagttcgtaaggtttatttatctggactttttctctgtaccttgttgtctcgggtgataaagtggttattctttttctgatacaaaaattgagaaagaggagagagacatagccttcacaaagagaagttgttttgtgtgttcaggtagatagggggagggcagagaggtcttctggtgtttggatttttttttttttcagttgccttaagttcaaaatatttttaatgctcaattgggctattttggggtaatattactccaaagcttttcattaaaaaatagaaaaattatacaaatgccttccaaagatctagattatgcatatatagaaaacacaaacacatacacaaacatacatataagtagcgcaagtttccatgtcaagtgtacctatctgtctttactttgttaaatgtatcacctcttgctaacatgtatgtcttactatttagtagtgggagtaattcaaaaacactaaggtcaatgttctgataatcatccgatttttccccattctgcttataaaacatcagatttataaaaacctaatgtctgattgagaaaaggactcatgaacaaaaatcaagccatataatgtctaacaaaattggtggttattatatggtagcagtttgacaaccgacagttttcatccagacttagtccgatatgtgcatttaccttggctgtagaactgtgttgtttatttcacttggagttgtgctgaattaataatttcccttcaaaagggtatcattagtagccagtggacttttcaagctgtttattttgaatttgcaattcaattgaatgaaaggaaatacatataaatatggatcatttcagataaaaataaggcttttgttttagtagggaaaatatagaatagcttaactcaacatctagtagaatatttatcaatctagttcccaacattaatgagagcttcaactagcagcaaattctatagacttccttctacctagagcttaagagataagtcatcagcttaaattttggagtgtgactgtcacaatgtttcaacaaaatcagtcagattctttagaagctacacagttttcacagttattaatgtatatagatgtatatgaaaatacatactgatgtaaatttctatgtagctctgcccagtggaagagcctaggagcaacaatgctccagtatgctccagtatcattgaacacaccaggcgtctatatcttggttcttttttttttttttttttttgagacaaagtattgctccatcaaccaggctggagtgcagtggcatgatctgggctcactgcaacttccacttcccgggttgaagtgattcttccacctcggcctcccgagtagctgggattacaggcatgcgcaaccacgccaagctgatttttgtatttttaatagagacacggtttccccatgttggccaggctggtcttgaactcctgacctcaggtgatccattcacctcagcctcccaaagtgctgggattacagacgtgagccaccattcctggcctagatcttggttctttagtatcatttttgattaatggattatgccttcttgaaaaaaatgatgaattttggttctttagtatcatttttgattaatggattatgccttcttgaaaaaaatgatgacttttggggctgaaacaagacacgtatatatgaatctaaaatatctatttgtgccagaaagtaaggaaataccagaggatgatggtaacctggcagaagtacatagcagtgagtttagaggggataccattggccaaatctggaacaatttgagcatcaaactatgtagtgatactaccgtattataactcactgaataaaataggaatctttcagttcatatagttatggacaaagacatgagtaaataaatggagagaagagaaagctttttcttgtagaagagtaccaactagtcagcgcagaagtaatgatggaatcaggaaatcaaaatatagcaatcattgtagtgataatcaatgctgctaagaaatatactggctgagaaaactagcaggttaaaatgtgatagggaatggaatatttacatcttctaaatgtacctccccccgccccaaataattcttaattgtaaagggaagaaatggtaccttccacagtagagaagctggcatgttatcaaagttagtatcaccataaatggaacaaattaatatcctgccccatctgaggaagcttcaccaccgtgtatttctgccaaaatacctaccctgaatttcatcctgaggaatcaaaagacaaacccaaattgatgcattgtcaatgggagaactggcctgtgatatagaactatcaaggctgggtgtgatggcttacacctgtactccctgccctttgggaggctgaggcaggtggatcacctgaggtcatcagttcaggaccattttggacaacatcatgaaaccccgtctctactaaaaatacaaaaattagcttgacgtggtgacacatgcctataatcccaggtacttggaaggctaaggtaggagaatcacttgaacctgggaggcgaggcgggggttgcaatgagccaagattgcaccacttcactccagcctggacaactgaatgacactccatctcaaaaaaaaaaaaaaaaaaaaaaaaaaggaacaaggttgtgagggtaacagaaagaaaagcaactgttctggattgaaagaggcataaaaactaaatgtgacatgggattctgaactggatccttttggtattgttggggctcagaaaaccatactcaaaagtgaaggcctcagaagcagcctcggaagcaaagtttatctctggcctcctattccgagccactcattctcctctgagacaagccatggaaactagaattcatctccccagagcaggtcttaggaaccagaagccctttttcccaaagccagccatacaagctaaaaatattgttgtcatattttcctgtcttatctgggtaagagctggccatagagaaagtctctgaccttcctcgtttgatggcagccattccagaaagtgtccagcaccatattcaggaggaaggaacaccgcatagagaggccaagaagaatccagataagcctggctgggtttccccacctgggtctactagaattagaccagatccttttgtctaatcacagttctgcatgcctgtccattcttcattgaacctaagcataaaaatggatacttttccctgttcctttaattcttcatcctgagggctcccatgttatgtaaaaccataatgaaatatatttgtgatgcttttctcttgttaatctgtattttgttataggaatgtcagtcatgacctttatgatggggtgggaaggagtcaccccttttctgctccaatattataaaaaatggtggtgccataattggggaactctaaataagctttgtgcattagatagtagtaatagatgtaaaaaccctcattctaaggtttgtcatggttatataagagcatattcttgtttgtagaaattacagagtaaaatactggggatgatgaaaagtcagccagcagcttacttttaagtgattcagaaggaataaaatgtgcttcatagtattcttaaaatttttgctgtaagtttaaaattgtctgaaaaagagaaaaatgagaaagtaattaggaagatgaagtagtacttttgaaaacgtactaatattaaggagtaaattttaatttgaaattgaacctaaatagtagttctaattgtggtcacaacttgaaagtaaatgacagattaattttagagagttttaattctatataaaatttaaaagttgatcagtatgaaacttgagaattgtgatatttgaggctagtcaagaatcaatgaaactaatttaggcttagaaatatctttgagaagttgtcatgccaaagcttttgaaaacataatttgtaattagattgaatgttttgatttggatataaaactgacttagaaataataagagcagagcaagtgaaagagctccccaatcctgcccaaaactatgtagataaataaataaatactgaggccttttgggacctgctagtattgcagccagtgtaaacacagatgtgtagtgatgtggaaaaatgtgtttaaaattgaatctccaagttgacaactcttatagatgataaaaatcaaattaatggatcaacatttaccaaagttcttttaaaaccattttgaccccccaaaatgacaaacaagcataatccaaatatgtgtagaaaaataattcaatgtgttttcttgaataatagtttattaaatattaattatatgatagcaagtatgttgtagaatgattaaaattaattttctaagtcattggtcctatttttgaatagattcaaatagatcaaggtaattttgacagaacgggtcaaccattttgctagtcactgagagatgtccctggaatgatggtttgcagttgtggtgtactaaatattgaggggtgtactagacctggagggaagtgaaggaaatattaaaacttccatttgtctttggaatgagaactaaacttttagctttgtgctaagtggtttcttcagtaaaatatcaatattttatttatgtttttcttacattaagcatccattttagctaacctcacaaaatatactgtccctaaaaactcagtcttcatgtaaacactttgataccagctgttcttccatctaaaattattttcttcctcctcattgccttttcttcctgaagatgatcctgtcttcaggatctagttctctttctgccttttcatggaacattgctacaatacttcatccgtgtccgtctatcccctctgaatatttacagcatatgttcttagcataatttattcagaaagtaatcatcattgtcttgtgacatataaggaagtattttcttaccgtttaactctatctatacttctgcaatacaatttgaggttcttgaaagaggaatcctgtcttattcctctttgggataaggggaatattggtagacccaatgtctaccatgacccaaatacagtgctaagagccgggaacagaaatctaattatttctctcttccgacatgctttgtgtttatatgaagttgtggacaagttaatgaaagatgcaaggtaaaaatatgaatgcacattagctaatttgtctatattagaagcacagtgagttatgaaatggaaaaagggatgtttgtggcatgagatcagagctctaacaatgcctctccacaaggagacttccagtgatgtttttctggcactcagcccttagatatcattgaattaattcactaaagcaatctgtatgctgtctatgctcattttaatgttaattattctgtgttccaaaacaaatgtattttctcagcaggaattaaaatttcaggaatataacataaaaaaccctgtatcgtttgaatttttcataggtttttttctaattaaaacatatattgttaagtgcatgtttgcttttctaaaataacacctagtaatttgtaatacattggtttgttctatgagtgtggtttatgatggtctaccttttatccactggtgtaatatcttacgttttatcagtaaccatggaaatgtttagtacatcatccaacaataaataaataggctaacttcccagaaatgaaagtaaataattatttatttaattcaaagtagagaacatagcatggatttaaaaatcttatgtaagatccaataatccaaatatttaatattttctctttggtttaacataatgttcaaatccgaaagcctgctttgctcaccaacacctcccacccaacaaaactgccaacatgccaaaccaagtggattgatttaacagcaacattaagctcccctgccagtgtttggtggaaaggcggttaatccggagtgaaaggcctcaaatcttgccaacaggaaacaaaaaaataaagaagaggccatctgtaatacatactcatagttagtcagtccctggagattcttcagctctttgtctgcagcattaagaaacacatgctaatatgttattctcttttgttgactgctctaattgagatgcctgacaaattaatacagaatattaagattattaatgccaaatggaaaaagaagccttactacaaaatgtcatataaaagttatttgtaaacgctaaggaattaatttcttaaattatttcagcaaatgttaactttaattgtgctcaatgaatgtttatggatgcttttgacacagtggtttttttttttttcttttttccctcagagtatatttttaggcagtttaggaaacaaaagataaatgaatgattagttgtttagtttgtctgattcaaggcatagattggatttaaaagagcaggaagcatgagctcttgaagtggctctgggcacactgccccaatttctggatctcattggtaaaatggacagagtagggttactgggggaactgtgataatataaagttcttagcacctgtctgacatttcttatttttagttatattgtattgttttgtcttcaaatgcagcagataatcattttttattctatagctaacatgctggcatcatccaaaaaagtgacttctattttttttaattaccattttgaaaacaccatgccctataacatctaaagacgcatttactttagtgagtgggaataatgataatataatcccatggcttattcataaaagagaaccttggagatgctgtggtaatgagcaggtggtaacaattcttgattatttatacatttttgaggatataatgggattgagtcattgaactgctgttgtatcaatatgtaaatttcacacatcagttttttttaaagctgttttcttttgaatttaagaagggtaaaaacacaccagaaatattttaaaagagaggcctcagatatctcttaaactatcatgttctgttcacattcgtcaccatcaaacttatattctatctctaatatatcctacacattggcacatggctcccaggaagtagtgtctacagtaagaaccgagaaggtaatatacttgctctcaatttcttccttcttaggaatgacaggcaaaataactgtcacttctgtcaagtagcaatagatactattatgaagtatatcgtgtggcaaaatctctgctttaactgagtactttaaaagtacttacctaattttcattgcttgagtactgtgctcacccctttgggaacaccagaaatttgataattttctatctgagttctaggagattgaaagctgtgcgacttttcaaaaactttctgacacatgagtgctaatttgagcagaatttagctagctctcacaagtgatgaaagcgcggaagaaccagtgagcactgtcagtcttttaatctagtatctgattgcttgtctaactgtcattggtgaaaagcaaatatctttgttcttcttctgagttcaagccggatgtgctcctgtatttagcatgacaggaaatctcaaacggcaaagaattacatggatttaaggaatctgatattcctgtattcaaatctcccctcttgttcatgatagagtcttctgtagaaaatctataaaatagcaagaattaaaaacatactataaagtatatgtttggcttatcagaaatccatacaaactactttttctcagggcctcttaataagaactggttccatttgatgagtgagttgcaaactcttgaaggcatattgacagatggtttcatctgaacaaactgattttcttgatttgccaaagtgcctaaaaattagttttcaaatttttgaattatatttaaggcattttgcttctgagaggtgacttttgacagacccatattgcttcttataagaaacttaggtgaataaggcacaaaatagtttctagaattacttaattgtttttcaaggaaaaatggggctcaaagtgaatgggccacagggaagttacagctggatcctgtagagatcactgagaaaggtctactccctaggtcactgtgcacagaaagacaggcctactgtgattccacagagaaaaatgtgtccggccaatggacactctgagcacataaactactgaaggaagagagattgatgatttgggatgcttgagaaaaattttcctgcatttattcttaataatatgttagtaatttaagctagtaaaaaaaaaaaaagaaatcaatgtaaaggatttcctgacttctcttttctactgcaaataaagtaggttgatacatttaaaaagggctattctccttctccttcaggtcctttatttctgcttcttcttctgtcatattttattttttttctcacgtcttttcccaccatcctcccagttgtcttccttcccaacatcgccatttatttcatattatattcttcagcattacacacacgttatttaactggaaagtataataactacagccatttcttaaaatacaacattaatgggatgtaatttgttataacatgccatttgaaaatactgcatttttttactttagtaggatttctctactagcaattgtaattattgtattgtgatgtttcctatgtatgctataatatatgctataactgcctaccttacctacagatgaaaactctacaaaatggtttctaaaagtatctcaagtaaaatttgattttgtttcaaattacctttaaatttttaacattcttaacttcttttttaaaaattacaatttttcataatgccaaagataggaaatagtgagtaaaggacagtaaactgatttatttagcgagtaaagaacagtaaacttatttttactaaacaactctttttacaatacactctcaagtctaaatttcaaaatgttaaaaaaatgattcttgtacaaatataaagtgagcatatatcaaagatttatttaacttattcatgaggaaactagcagaatactacagctggtttaaaaaataaaagatatgagagaatatgatcaatgaatgaaagattgttgagataaggttacttcaattagatacaaaattggctaataatgtcctataggcaataaatctgtaactgagccatcatttctgttggctggaaccactaacatctctatcagaaaaaaaatcttttgtaatttattagtcttctgtaagctgacatttatctgcggagaacctcagttctattcaatgataaaagaaaaatatgcatttctctagaaaatcagtgttttgtaaacaagtttgttagataattcttcagtatgataaggcacttagtaatctttttaccataatttcagttttggataatttatcttactaaactctgtgtatattccacataaaatccaataaaagtaccaattatactggttaggtacagaatttttcagtctgatagagagctgcaagacaagcccaatttctttcttgaaaactgaaacatagtgaagaagaatatttacctaactccttgtcctataatacccactctatgactctgtcatggcatgtgccctaaataaacactgtccatgtctgttatttgatttgcgtgagagaaatgtatcagattttaacccatattgcataaattactagggtcttaactggatgactggtttggatggggaaagggataagagaggaagaaagaatgaataggtgaaaatcttctcactctaatgctttattcagataaagttatttagttttgatagacaaactgaaattgtattcacattttttaaaagagagttttattcaaaaactgtttttggaaacccttaaacttctaaattaaaagtcatatgcaattgcaacaatttgaaaaactggctgcatgagccagttaaacaaatagtaaagtatttggataaccaggcactaaggagattaaataaagagccgctatgttctaaatgttgataagccaaagacaggatagtgtgtatgaacctgctagttcccttgaccaacaggcatctccttctaaaaaggagtttgagaccttatcttgagaataacaattaagggcagaatcagaactaatacctcagtgacaatttgtacaattaccagtgaagattagctgcccaagatgatctagatctccatactacaaatctcttttcagtgagtaatatcaaaattatctctgtgtaagaatgcgtgataagaatcaggacccaaagagttaaaaaatatagtttatggaaatcattatttgttgttttagtaatccctacattttctaagtagtactgagagtttgttgtccaattggaaattcacatttaaaactcttaatctcaaaaaatatatcactaaggaagtaattatcttctctcaagtgcagccagtttagctgagtgtcaaacagcatttctacatattatttttctctggtgtggtgctgtctccttgggcttgtcttataagttgtttcacgctttaacactcaataaatgcatgatagttgaccgaatgttaacttatgatatacgacatttttctctagatgtctcccaagttgggagtactaccaaaataattccccaaaaaagcaaaaataaacaaacacaaagtaaattcaaacaaaaaaaggccctgcatcagtatccatataaccttcctagaagggcttcctttataggttaaattttaattgtgtttggtgttgtgggtagagctgtcagtattggaatattcatcaggatcttgatattaaggacttattatttattactttattttatgctcaatgacccttctgcctattgcatgtaaggcagaaatctaggtagaaggaatgcaggtgaataaagatggttagtccctagtcaacatggttcaaacataatatgagaataaaacaagtgtgtgaatctttacagtacaaagcagaaagtactttgtgtaataatgatgtttcagagcaggaagaactcacaactaattagttctaatcaaaattggggtataaaagagatagttgctgatagaggtcatcaatgatacatagaatttagctagaaaaaaaataagtggacagaaatgtcctggctatagcaggtagcgtgagaaaatgaagaatataaaacaggattaagacaatggagtagtatagatatagtatggtatggtatggtatggtatagtacagtacagaatagatatagtatagtatagtacagtatattagtatagtatagctatagtgtagtatagatgaaatacataatgtttgtaggtgattgtagttgattgggaaaaatagattttgcacatatcatagatgatcccaaatcctaggatgagctattacacttgatgcaatcatcaccaacataccagtgaaggcttctatttatataagctgtttaaaaatatttaatagaatctatttttgaatatctttctgttgttctatagactttattgaactagtgtggaactggattttgaatgcctaattaggatgaatttcataacacaatagaaaggctacagggttaaagggtctagtctggaatgatagatgcgcacaaattatgtcttgaccttgattgttagttgtcttattgaaacactgtacagctcacaaaaccactgggccccatatctccttgttatatggagttctcctttatttgagttgatccacttaatgctgtcatctggaggaaaataccagactgccacactgtgctgcattcttagtgcatttgttgttattcatatacactccgtaaggcccagtttgataggaaatttagaccaatgaaataacacagctcacctcctgactcctataatgacccaggaatattgtgtcatcaacaacaggttttctaaataatattgcctttaaaaatactttttaaaatatatcaggggcttggaagtttgaacatagtttcagaagtcaattgaatatttccttcatcccagcataaatccaggaaaacagagaaaggcatggagtgggatacacatagtcagagaacactaaggttgggcaacaaagaaagaatgtagtttcatgttcttagaaatattattattaagatgcatttcttgttaccatttttcagtattttgtgattaaaataaatgaggcaacccagtacccgaggttttggatgcatgcttttgataaaaatcctgaaacgagtacatgattacataaggaatcacgcaagttcaatgagcatccaaaagtcccagaacgagcttgtccagcccagggtacgcaggctgcatgcagcccaggatggtttagaatgtggcccaacaccaatttgtaaactttattaaaaccttatgattttttttggcaattcttttttagctcatcagctatcattagtgtgtgtattttatgtatggcccaagacaattcttctttcaatgggcccagggaagccaaaagattggatgcctctattctagaagctgattcactctcagcatcccacatactcccttgttttttattacatattctatagacatcattatttcataggtccaattaaaatgctcagggcttttgttttgttttttagccagttctttgtatgatatatttctcagactaccactatcctgatcagtgtaaaagataagactattattccccttagcatgaatattttgtttctaataatttgctctaaggtcaaaatagtgttgtcatgtgtctcacttcactcacttttctcacagttataaaacaacctcaaggtttctccaaatcaagctgttcttacaacaattttcttcctcctcctactggtttaattcactttggaacttcaagatatttacacaaatattcaacaaacttaatcttattatgttttacctccttgtggtttttgttatttccaaatgttgcctcagtcatgtaacaccttgtttttctcctaagcttttaaccccttgaacatttgataacaatttcttatttgcattcatcaaacataaatcaatttttgacccatagagggttaaagatagaacactccaatcatgaaggacactcatgtacttgacatttatgtatttataaatatattttaggtatggctatgcaaccctattttctcttattttttattttttgtcatgaaaatatttttcaagtttttcttatttttatatatatgaaatattctatactcttttggccactttagctgtcctgtagaccctatctagaccttccggagttttgctatttctttgttgcagattgttgaccagaattacaaacagtatctcatagaaacactgatttctacaaagtgagataaagcttcccattttatttctttggtctgatttcattgtaagagttcagtgagtcattgcctgccaggagtcatctacagtgagtcctagatcagtccacagctgtgacgagttcactattccagaaatacaagtttgaagaacttcctacccaaccctcccttagaaaattacccaaaattgatcatgtaaagcccactttctgcttctccatattcatttttatggcaaagtttccccactggcctggattttcactatgcagaagtgttcagggttatctacaaacataatacctaaattgtatatatttataacacatatatatgtactctatatacacatatattgtactatatatgtgtttatgtactatacatatacgcacacatgtatatgtactatatatacacatacacaaacacatggtttttttttttttattactaacctaaatataaaataagatctctggagaaaattttgttaatgtgtttccatcatgaaaacacacaataaacttgtttattgttctatctataacaaaatatttaaactacttttatcccaattcgaatatcattcttgtggaatttgccaaagtatttttttccttcaaattggaaaacaaacatgggactcttcttgggagatatttatattcttaatcaaagaacttcattatattcatcaaacaccacagcgctggtcacttacatctgtctaatgaattatatttggtgttcattgactctattctttttaatagaggtcatggtttgttatctatggaaccgagaatcattaatcatgacttggaattaatttgaagagatgatttttaaaaacttgtcataggcctgccttttgcagtacagggttcagggttccttgcttcatgataaacatttgcataaaagattgaagcttttagaaccttatcgtgttgttcaaatttagggatattaaaagaggaagaagcctgagatgaacacgggcacggcaactgatagcttcatccactgaagagggattttccagttgcatgcttgtttctctccctacatgtgctaacatttgtttagaaattttatattatgttgagactaaaaaaaatcaactctgaggtataaattttgatagtgcaaggacccatttatcatgcttgacatataatcttttaaattaaatttttattgtgcaatgattacagtttcacctttctttgtaagaagactttagagagatgccgtgtatcctttttatccagtctcctccaatggcatcttgtaacactagagtcaccaccagtatattcactttgatgctttaagaatacaaaatacttccatcaccacaaggacctctcctgttgtcattttgtagcctcacatacttccacttgtattcctcctcaacccctagcaaccactaatttcttggcatcatgaaccagagaatttattcatcactaaatctgttctgccaggatctgccactcttcagccaaaactcctagttactcctgatgacttctaggcatctgccctccttgggcatcaagtttactgccagttgccttctgagtcacctgcagtcaccactggagatgtaattgagtcctcatgtgccaaacttatttggttttcaccttaaaattattttttaaaagactattattcccacattttccctctacacttggtttactaatttgcatgtgtagtttatagggccaagctggcaataagttactgttatactcctctctttatttcccgaatctcctattcatgttccagtttaaactcagctgggaacaccttgtctcattcagaacttaatcacagtctttagatatagtcttttttgttttctttatatgcttattattaacatgtagtatccagtatctaatccagtaacagtcacaaattggcccatcagtggcaagaaatttaaaaaatggacactatagtgaggactaaattcaaaaatgacagccaaactggattttctcaagcacattctgctaatttgtattacgtttaaagagaaaaaattacttttgggtaattgaacatctatatcgcaattgcaatggtggttacacgaatctatgcaactggtaaaacctgtttataacaaaaaaaaagtacataaaaactagttaaatcagaataaaatctgtagtttagttaattttattgtgacaatgccaattttctggctttcatgattgtaccgtatcgtgtagaatgttattattggaggaaacgggggaaggttacataggaactcaactgtattagtccattcttacattgttgtaaagaaatattgagactgggtaaattataaagaaaagaggcttaattggctcatagttccacaggcaggtgaaactgtaatcattgcacaataaaaatttaatttaaaagattatatgtcaagcatgatgaatgggtccttgcactatcaaaatttatacctcagagttgatttttttggtctcaaaatgatataaaatttctaaactaatgttaacacatgtagggagagaaacaagcatgcaattggaaactccctcctcagtggatgaagaggaatcatggtgctagcatctgctcagtttctggagaggcttcgggaaactgtcaatcatggcggaaggtgaaggggaagcaggtgcttctgatgattggactaacaggaagagagtaagggggaggtgccccacactttaaacaatcacatcacgtgagaactcactatcgcgaccaaggaggatcttgctaaaccattagaaagcacccatatgtggctgggcgccgtggctcaagcctgtaattctagcactttgggaggctgaggcaagtggatcacttgaggtcaggagttcagggccagcctgacttacatggtgaaaccccatctctactaaaaataccaaaaaattagccgggtgtggtggcacgcccctgtaatctcagctactccagaggctgagacaagagaatcgcttgaacccgggaagcggatgtttcagtaagccggaatcatgccactgcactccagccctggaaacagagtcagactctgtaagaaaagaaaggaaaggataggagaggggaggggtggggggcagggagaagaaaggggggaggggaggggaggggaagggagggggataggagaggggaggggaggaaggggagggggaagaagggggaggggaagggggaggggagggggaggggaggggaggggaggagggggaggggaggagggggagggggaggggacgggaggggaggggagggggacggggagaagaaagtggggaggggagggcaagggcaaagaaacctcccatatcatccaatcacctcccactaggtcccacctccaacgctgggaattacaattccatatgagatttgggcagggatacatatccaaactgtatcatcaactatttttgcaactactatgtgagtctaaaattatttcaaattaaaaaataaaggcaaaacccatcaaacttacagattattatgtgatttaaagttcctatctctctcattctgtatgtgtgtgtatacattacacgtatatatctcagatagctaaatgcatgtgcttgtttgacatacaggtgtgttgctgttgttttttttttttttaaatttttatatattttttaatttgttgagatcacccaaggtgaaatgcagtgacacgatctggactcactgcaacctccgcctcctgggctcaagcaattctcatgcctcagcctcctgagtagctgggatcacaggtgtgtgctaccacgcctggctaatttttgcctttttagtagagacagggtttcaccatgttggccaggacggtctggaatgcctgacctcaagtgatccacctgcctcagcatcccaaagtgctgggtgccaccgtgcccagcctgacatcgtttttatggatttcaaaatataaatgtatttacattgtttgaaagttcatagtgtatataaaattgaagataggatcctgagatacgtatgaaagcattataatgcacaggtgtttgtgtgaaacatagattgtatctgaggagaaagaaatgacagtagaatactaatatcaaaaatatataaataagatgataggatcccaaagtataattttgtttgctttttagactaacaaaatattaccacatctaaataaatgaaaaacatgaatgacatatgctttttccatcgatttaatttttgttaacaaatataaaatgttttagaattttacttatagaattcaaaaatgtttccttcatatttataataatacttaaatatggaaatgaatacatcatctcaaataacactgagttcattcttggaatgtctttttttttttctgttagagattttctttcattttctttttatttttccccaggatgctatcatgcctacgtttctcctggttagtttcacaggatattttccaaagagaacttgaataaaacagacttgattaccactgttttattctcaaaataagctaatggctattaagacttgttccttgatttgagggggctttttggtatacttattcaaaaaggcagattcaaaataagctctctacttctttattcctcagaatctctgtttgtatgtaattggctaacaaaacccattgcttattagctttgtctcagtgctaaaaaaaaaaaaaaaagtccttaaaattattgcaaacctgcatctgtcacacctgattactccaggaggaaaaacaaaacaaaacagaacagaaaaaaaaaaaaacaaaaaaaagaaaaaaaaaaacttgctttggataacattttatgacaatagctttgcatcaggggacttacttatcttcaatgtgtgctctattcctcatgtcactctttcttccccttaattgaggaaaatgtgttcagaagttaaagttgtggccatctatttaaagttttatattattcagcttagaaaacaaataaaattttcatacgtacaagggaatatagcatcactcaagtaatgcccatcacattgcacaagaagtggataatctttcattacaaaagaaaagatggaaactgcatagatcttctgtaaatcagaagctgtataaccagctacttaactcaaattctaaaagccacctaatgtttgtatgtggatgacaccaatataacaaacatattgcttcaattaagtcaattatgttaatttgttgaaaagaatctgttaactgaatcattcagtatcccttaaacaaaacatagggtgataattttgcaaattattatttcaacttattgagttggcaacgtatgaacaaaaggcaacctgcatctatgttttaggataagtaattaggttctcacagactgagattttcatttaaaaagatttcccttttggacagtttataaagtgaattggaagagagactggaagcagggagagcattctaagagctctcaggggagaaggagggtttggccaaatacagtggccagactcgtgaaaagccgttactggagaggcaggacctccagcacctgggacattgtgaatgtgagtgaggaagaacaagagccatggacatgacagagattctggctggagaactaggaggatggcagcatcagcaaatggtgtgggtggaaaatagaaaataaacacagttttgatgataaaaaggcattttgttaacatcttgtagccattcaaataaagatgtttaatagaaagttggaaattcaggcctagatctcaaaatccaacttagggctggagatgtggatatgggaatcagtctccaatatttagatgggaatgagacctcgtagaaggaggttgagttgaaaaagtcagccgttcttgtccaagaatacaaatgggatcacagtctcatggagaagaaggcattacaagaataccaactgcaccaaaaaggttccttagggttaaaactaataaagaaggcttagatttcactttattagtgcagaagactaattgtagcacagtagaagagagatggaaatgagcttctatccttgaaagtttggatatgaaattgtctcttcaagaagtttgggaggtcaatacaaaataatgcaatattgtaactgaagaagtgagttggaaaggtgagttagttaaaagacatttggtggagtttgttttctttattttttctctgaaatcaagactttaggcttgtttcattaaaagagttgaggccgagagagatgttaaggaatacaggggcaccgtagaggtatagctaatggaacaagggagaatagagttagatgagaagatgggattaaacagcccgagtaggatttgtcccctgttagactgtagaagaaggccagttgggtagtagactgtggctagaccacactttattaatccgtttgtcagtaaatacacatttgagatatttctagattagactgattatgcataaagctaccaggctctcaggaggtcagaaaataaatctaggtagtgaaggaaacagataataacaaaataacaggaataagcaaaatattcctgttgaacttacatttgaagacaaaaaagcagatgatgtcacttgtgagaaagtagcgagaacagcatgacctttaataatccatagaagaagaagaaaaatccaatgaagataaaggagaagcaatcacagatcaaatagacatatgcaaaataagatatgttcttttttttttttttttttttttgagacggagtctcgctctgtcgcccaggctggagggcagtggtgcgatctcggctcactgcaagctccgcctctcgggttcacgccattctcccgtctcagcctcgcgagtagctgggaccacaggcacccgccaccacgcccagctaattttttgtatttttagtagagacgggatttcaccatgttagccaggatggtctccatctcctgacctcatgatccacccgcctcggcctcccaaagtgctggaattacaggcgtgagccactgcgccgggcctaagatacattcttgagtgagaaagattccaggagaagatgactaagggagatattcaagaagaattttaaaaaagattatttcattatcatcagttacctcattatcatcagtgatttttctgatttgatttgaaagaagaaacagcaacgaacaaattgctaaagtttaagagagcatggaagaggagggaaaaactgagcaaacaccatctattagagaagttttgcagtgaaagggaatagaaaaccagacagtacaaatggagaaacataatgtaaaaagggttttttttttttcttcccaggaaagatgaaatccaaatatattggaaaaaatggcttctgtagacccaagaattgtcacttattttagctcttctatattttgaagaaacattacctggtattaatcatccaatagataataaaaatggaagcatatgaaattgaggaagagtaaaattgttaatgctcaaatcagacattacatttagtattagaattattaatatttcatggcataaatttatccaactaaagaatttcacattttgaaaaagataaaattgaaagatggtaatttaccttgctatcacaaataattctcacattaactaaaacttgataattttgttgattgtatgcttataaaaagctcttggttccacattcagaaaaatattttatcccaagtactttccaaagagtatatcatcatatttgctgccattaatacttaacaaatacctgcgaaaagcaatggttttggagggtaacctgagggcagtataatctatctgttcttctagatactgtaaacaatttctagagtaagcttgtcagtagggagctgaatatctatctgcatcaaaagtgttggttactgctataaatttgtgtttactgagctgaggtttggcatttttccatggggctacattgaggaaaactgtaatgtatttcctatgaaatttgttgctgtttttatatggattttcttgaacacttcattctttatgtagcatagtttcttttatgtgaggatttgggaagtttctttctgggctcagtaccttgagtattatgcttctgcaagcaactggttagattttatttaagatgagccttgaaactaattctgtctgcatttatgtgatatgccagaaattttaaagccaaatttttagacaccctcctatgcaacaattgtttttggtttttcatatttttatcaagctagtacatagataagtatttttaatcaatttgtagagaaataagttcatttaacggtaaagttctttttccccaatatcttcttatttcctgttccactctccctttatacttttatatcaatttgttcgcttataaatgtagaatttgcctattggttaatgacttcttgggtcaattactagttagctgacttacttttccacacatctgactacttttagaagttatattaaggccaggcatgatgattcatgtctgtaatcctagcactttaagaggccaaggtgggaggattgcttgagcccaggggtttgaggctgcagtgagctgtgattacaccactgcacttcagcctgggctacagcgcaagaccctgcctcaaaaaatatatataatagatatttttaattctctattggttaattttattacatttaataatatacttacaaataggtctactcttctgtcaaattttggtaatataatttgactcttcacttggaagatgagtatattatttaccacattatttcttctacattttcgtatccatttctacctccaaacctctgcttcttaggttgtattttaacattgccaagattgataatgttagatttgtatttctgtttgtctaaatatttatttaacatatcacaaaatggatagcatttatctaattattttcatcctttcttatggcttgacatgaaggataaagaaaaaattataggaggtttggaaagaaaaataatatatttgagtaaaatttaaaatagatttctgatgctatattagattatcatctgaaaaaatttatttgtcaatatcttagaaattcaaatatgcatccattatataatccagaaattcttctcctaggcatttgtaacaaatgctcacagcaattttatttgtaatagtaaaaaaacctggaaacatcccagtatctatcaatacaaaaatgggtacaggttatagtaaacttagacaatgaaatagtacacagaaaaatagaaatgtgctactgataataacgatatgagggaatcttaacaaaattgttctgagtgaaagaagccagtgatgtttgattactttattatgaagttcaagaaaagtcacaattggctgggtgcagaggcccatgcctgtaatcccagcactttgggaggccaagctgggcagatcacttgaggtcaggagttccagaccagcctgggcaatgtggtgaaacctcatctctactaaaaatacaaaaattagccgggcgtggtggcctgtgcctgtagtcccagctactcaggaggctgaggtggaagaatcacttgaacctgggagatggaggtttctgtgagttgagaccatgccactgcattccagcccggacaacagaaaaagactctgtcaaaacaaaaggcaaaattaactatggttatagaaatcagaaaagtgtatacacacggtgaggagtggcattaattgaaaagaatattgactgaggggattgatgagactaatttctgggataataaaatgttctatatcttgatagggagtgagggtcacgtgagtgatcacatttctcaaaactaatcaaactattcactggttttcagtttactgtattaaaaattattatcattctttttaaaaaaatgacgtattgctccctgaacagtctgcagtttcactgagagatcaaatagtaaacattataattttactattcattataaaatgtattatgatataggtaagcacagaatttcagaatgagcatcaagtaaccccactatgcatttatcaaatctgtttcactttccttctgtggcacatattccagtctcttggacactaaggttaagatcaatatgatacatgaccaatggaatgtatgcagaagtgatattttcttcatcaaatctggccataaatcctaagttcattcctatatgtttgtcttctgtttctgtggtggacttgagaatcagatgttgatgacaaaaaccaaatgaagtgagcccggatccctgaatgactatgtggaacagtgctcctctgtccttttctttctatactgaaatgtgatgtgggcaaaaatcaatcatgtattatagtaaaacgctggaaagaaggaaacaagaaaggaggggaggaaggaaataaagaagaaaagaaagatggaaggaaggaaagaaagagagaaaaaaaggagagagaaaaaggaaggaagttggagagaaggaagaagagggagtcagagagtaagaaaagaattgatggttcttctgccagtgacttagactggagataaataaactatgggaggcaataaagccattaaaaagacagtccacttgttgagtaggctgagaacaaatgatcacaaagaaggaaacctattgaataccatcatcatgtgatgcccctaaagaataaagagaaggaatcaagaatcagatttttaagattttactttattaattttcaaagtcaaattattgcttgcaaaataatgctgttcttaatgcttctagtacgattattctaaaatgctttcacaacattgacaacattaagaagacaagatgtatttatttgggtaaagagcagtagggtctagagaggatattgctgcatatatatatatgtatatatatatatatatatatatatatatatatatatatatatggaatatgttggcatgtctcacaatgtttgacatgattttgcaataaaaaagagtgtatttttagcatagttcaagtgaattacccaagtgaacaagctaaatttgattggggtggggggttaatttttacatctctcctggcagttctctcaagatttttccatgattgttttctttttatcccatgatctctgacatctagccacattacataattataacgacatccccctacaactaggaaacccttacacattaccctggtgtctttttgagtcagtctagcatgctctattttttttcctgtaagatattatcaaatatatggtttttaactaccaatggtaatagaactggtttttgtacatccagaaataacaagacctatgaaatgtagatagatgggaatttggaaatgcacatttatattcatttacttaagcacatttattgaccactgaacactgtggtcatcagatacacagggaccaaagaggtatggtctgaaacctcacagctgacttacatacttctgaatcagttagggagttaatcaaaaacataatgaagtaatcacaattgagtgaagaggggaaaaaaaaaaaaaaaacacaggatgctcttgatacaggcaaactcccaaattggggcttagccaggagagttattggcttcatacaggaaagaactcaagagtacaccaacagaataaagtgcaagcaaagcaagtttattagagtaacagagtagggaaaaacggctgctccatagacagagcaggacatatgcagagtagcacttgtagattgctggctagctatatttatagctactccttaattatatgctaaataagggccaggtaattcatgaattttctagaaaaggagtggggacttcctggaaccaaggattcctctctttttataccatgtaaggtaatttccgggcattgccatgccatctgtaaactgtcttggtgctggcaggagtgccttttagcaagctaatgaaatataatttgtggataacaaacaatgaggacaactagaggttgctttctttgccgtcttcgttttagcttgtttattttctgcatttgaaacaggagttttcccttttcctcttcacagggcaagtgataggggtgtggctcacttcttcagtgctcccctgctcaaacccatagggagagcgtgcagatgggcatgtcatggagctcaaaccccatggcggtgtctagggtttagtgtttacagctcctgaagccctagtgggtgtgtgttaccttgtgctctcttagttttgccatctgcaggtggcttgtgttaatcggttcaattagaccccctgccttactgcaaggacagagagctttctgtaccctgggttcttgccttggtgtatcagaaaaatcggatcacatgtggtcttcaagaatgggtgtaaggttttactgaatggaggcgggtctcagcgaggtggatggggaggtcagaagggggatggagtgggaagctggtcctcccctggagctgggccacccagctgccagactctcctccagcgtcccttggctgaatccggtgtgcttttccactcctctgctcctctcgatgtccagacacttgtggctgtgtccactagggtctcagggtttttgtaggcacaggatgaagggtgtggagggccagagtggtcttagaaaatgcaacatttgagcgcaaaaacagaaatgcctgtctgcacttagttccgtgggcacaggccccagggtggagccccaccaggaccctgcccttctctatccagcacttctctgccctcctcccatatcgcattctgttttgaccagatcctgctttaatcagtagagtcctgactggtgctcagaaaaaaagtcctgctgatctcctactatgaggcaccctatggaacgaggggattgaggggtggcgaggcaaggtccctcctgtcaggaagtgctgtctgagctgagtcctacaagatgtggaaggccagccagatgaaactaatgagcagagactccaggggaagaggccagattggaagggtaacaggtgcagtattttatgaaggtccttcttatcttcctgcctcagcagggaatatagctagtcctggaaactcacatcaaggccgcaaaatggaaaatctatttctacattttgacataagttgttagcatggggaaaataaaatctaaaatctggcaagaaataaaatttcaattaaagggaagtgattgtaatgatcacaggtttagtatattaacataaagaatagtcaatatgtgtttcaatgccacagagtcattttatgttttaagcaagtaagatctctcactttagggaacattcacgtcattctcacataagttcccacctatgagacctgttgtcagtagcgaaaagctcttcctagatttagttacacaatagctaattgttttaggcacttttttttagtcttaagtaaaacctttacatgaagatacagagtctcattcattcgctataggagcttgtgatcttttatgttaggtctcctaaaaagtgaggatttagttaggaataaatatacttattctcatcataaaataatttgtgttacacttcaaaccccataatagtaaatttgagaaaaaaaaaatgttagttcatgcatcatacatagcatacttctagtactttatatagtctcctccagtttgataaattatattttccaagtgattacaaaatacttttccaaagtttactggttcttaactgtcaactggctggaaagtcttagacttgtgcatcctgtctaacttgcaagaaagatttaatttcaaagactcttagtccatgggctggcaaactgtagcccatgggacaaatcttgtccacgcctgttcttttaaagtttgtgagctatgaataatttttacatttcacaagtgtattttttaaaaaaaggaagaataataatatgggacagaggagcatgtgacctgcaaagcctaaaatatttactgtctggtactttgcagaaatgctttgcttcactacctcttagaccatctgaaatattgttttagctagaaaaaacagtgcacctagtggaaaattttcagttattaaaacttcagggatgtttattctaaaattaacattgtggatgacttacaatatgttaaaaaagttctaaattttggtatgtatttgtacaatttataagacaagaactctaaaagtagaaccataggtttaacattttattatattgattttaactttccttaacatcaagctttgtgagatacatatatgctatcttaattataataataaaccctattctaagcatatatacaaatcactgcctctaagagagatttaatagccagaacatgaaattcacaagttgttgtaaatggattttttattctttcaatgataaatttggctggcattttttatgtatctgcaaagcacttgtatactatttgtctaaatgaaggtttgattataaagagtattgttctatgcaagaaagattcaactttgctttaagtttttaatttttgatgcaggtttccaaatcttaaagattgtataaaaactcagctgtgtatctttttttccttttcacacctatatgaaaaactgtaaatgagtttttaaaagagccaagtgatatgaaaaaatgctccttttcaagacctatgatagtttattctttactttagtatttactaaataagatgccccctagctgacaaattcttctttccttttaggaaacagtgtcattcaaacttttaaattacttgtattaaaactgcagaggactttgggtgctgataatcacaaaagaagcttgatttaggtaaatgtgtgagaaaacataatattattgattttgtaaaaatttgtagaaataaaaaataaggagagaagtaaaatatgaacactatattagatgtactatctaataaatagaccagatatcaaatgtgtatctaaaaagtgatatgataaaaagcatccatcagactttaaatttgatattcaaatatataacattaaatatcaaaaataaaatatattgtatataaatgggaagatatttatttctagttgacaatttgattctcaaatgaagagagtggaagaacttgttactttgtcccaagtttgtctttactaggtattcgacatccagttttgttttttttttcccttttttttttttttttttttattgagatggagtttcgctcttgttgtccaggccagagtgcagtggtgcgatcttggctcactgcaacctccacctcccaggttcaagtgattctcctgcctcagcctcctgagtagctgggattacaggtgcatgccaccatgcctggctaattttttgtatttttggcagagacggggtttcaccatgttggccaacttctctgagtctgtttcctgatttgaaaaaatagcatccctgacaattttagagttttctttgaggcacaaacaatacagactatactagaaccgtttaaataatagatatatacatgttagacgttgtttttattaaatcaacggctacatctccttttatgtttcctaccttatcaaatactgatatttatggagacatttcacatatatttacagctttgtaatcaagacaatcaatggttcacgcctatggtattcttttgaaatatttaaagcttcagttaggaaaatgtcttaaatctcaatatgcttggatgaaagaagtggaaaaatcacaatctattggcacacacctatagtcctagctactcaggaggctaaggtgggaggatcgtttgatcacaggaattcaagggttacagttagctatgactgtgccactgtactctagcctgggtgatagagccagaccctgtctctaaaaataaaatataacaataaaaataacaacagaagcacaaactattgattttgagaatcctgaagaaaatatatagcatgcatttttccataagtaaagcaaaggcaaaccttaggtaaagcactattattctaaacctcaaatgtccaataacatcttttaattttgctggtgaaatctcaaatgcagtatatctaaatcttcactaattatctttcccttcaaatattgttgtattagtcaatgttatttcagttgctcagaaacaaacaaataaggaaacagatcaaataatccaaaacaccttagcaagctctggatttagatttctcaaatgatgtcatcgcagatgtgcttactttgtctttctctgacttccactcctttgtaatatcaaaatggccaacagaagctcagtgggaagagcacctccattcctgcagttttgtttgttttcttttcactcagcgtgcattggagatcccaaggtgtggtagctgtcctgctgttcttccacaccaatgttccaaacctctcctccctgaacaacctctgaagcacttgtggccatattatttcatctatcattttgtattttacattatgcaatggtcttctactatcttcttgggaatttctctttactcagagagggggattttagtgctttcattgttaaaaattataagatgtataactttcttgcttaaaactctctagtagatttcccttccagcacacataaatgaaatctagagcgtgatcataatgtacaggccctcctcattctgtccttgacctctccatcttctcccctgttcattccttcttcacactcttccaacaatactgacttccttgctacccccacaaacaggcacagtatgctcatgccatttgcctttctggcctttgcataaacgatatatgtaattgtataattataggatttacatataaaaacatatataacaatatgtacatattacatataacatagtgtcagtattgtatgtgtaggtatacatatatgtgtatgtgtgtatgtgtatatatatagacacatattcaggttcaggagtacatgtgaaggtttgttacacaggtaaacactcatgtgacaggggtttgttgtacagattatttcatcacccaggtattaagcccagtacccaatagttatcctttctgctcctctccctccttccaccctccactctccaggagaccccagtgtctgctgtttccttctttgtgtttattagttctcatcatttagctcccacttacaaatgagaacatgtggtatttggttttctgttcctgcatttgtttgctaagtataatagactccagctccatctcattcttttttattgctgcataattttccatggtgtatatgtagcacattttcttcatccaatctgggttgattctatgcctttgctattgtgaatagtgccagagtgaacatttgcatgcatgtgtctttgtggtagaatgatttatattcctctgagtatattccccataatgggattgctgggtcaaatggtagtttttcttttagctctttgaggaatcatcatactgctttccacaatggttaaactaatttccatgctcaccaacagtgtataagtatttccttttctccaaaacctaaatgtaaaacccaaaattataaaaactctggaagacaacctaggcaataccatcctggacataggaatgggcaaagatttcatgccaaagacatgaaaagcaatcataacaaagcaaatattgacaaatgggatctaattaaacctaagagcttctgcacagcaaaagaagctgtcaacagagtataacagacaatctatagaatgggaaaaatatttgcaaactttgcacctgacaaaggtctaatatccagcatcgataaggaacttaaacaaatttacaagagtaaaacaaccctgctaaaaagtgggaaaaggatatgaacagacacttttcaaaagtggccaacaagcctatgaaaaaaagctcactatgtagtttaataatataaatgccatgaaaactgcaactctgtctacattgttgatttgaacaatatctgctacatagaagactctcaaatatctcctgagtgaatgaaaggtgaatgaataaatacgtaagtaaatgtatgaatgaagcattttagcagaagggctaaaactgagtctcattgagttaggtgcccacccctggtggtagggagtagtgtctgcctctctagcatcatatggattaagagtgaatttttttttttttttttttttttttttgagacagagtctggctctgtcacccaggctggagtacagtggcgtgatttcaactccctgaaacccctgcctcctgggttcaagtgattctcctgcctcagccttccaagtagctgggattacaggcgtgcatgaccacacctggctgatttttgtatttttagtagagatagggtatcagcatgttggccagactggtcttgaactcctgacctcaagcgatcagcccaccttggtctcccaaagtgctgtgattacaggtgtgagccactgcgcctggggaagagtagaatattaagagtgaactttttaaagaaaagccagatgctattactcaaagggaagaggttgctgagcagtcgagcaataaatgttcatcatatctttccctctcttcccttttctgtcaccaatgcctgcacactaatatcttggaataggttgattatatcttctactcccttctttcaagatgttaataattcttcttttgaaatatcaaatctgtcttttatttatttattgcccctaccaccacattggtgttgaccttcaattacttgttgctaatcttcttgctcccagtatgatttcccattaccctggatctcattaatatggcttttattgttatttcttaacaacaagaacaacaacaacaatacatgctatattattttgtctctaatcagacagaacctgttaaaagatttatgatttttttcaacataactactttctgccagtcagacttgtgtctttattcctattccttgtgtattcctgaacacccttggttcatgtttcccgagaatctacaatcttagttcaaaaattcattttaccaataagcgcatcaaatctttttgtgagagacatacaggggaaaggaaaagtattttttttaagtcctagagaggctacccatacaaagcaaaatttcagcataactatccctggactctgggtcttataccctaggtctgaaatcctcctttatgccaacctattcttcaatatatcctagcccctttctctcttgtctttcaaacaccactctgtccttctatgcagctgagctctaactctgtagaatttgcctgattacatagccttcagggaactccaaatatcggtaaaattactagttacgtaatgcacttccatagttccttttaatgctgccttttgcaatatctttttagattttattttaggcctcataagactgcagatgtcttagagacagtgtttcaggagagatttttgttgtttttctaaatattgacataaaacctagcaacatgctaagcatatagttaattttcaagttgaaattgtttggtggcttttgttgagtattatttaagatcataaattttggattaacccatatccaattgtagatttaattcaagtgattttggtcaaggattctaattgttcttgcatttgaagccagagaacccaatagagatctgaaaatatagccatggtttaatggaatgcttgtttagatttttagattctttgtaaaactaacagctggctagaaaagtacctacaaagaaaatgtctttttagaaattgtttttctgatgaaattttgtcaacaagatgcaatgaggatgctctattaagtgttaaaattcaagacatactgctcaaatagttttgttttatggattacagaagtgtatggctatttttaaaaggcagtggtagtacgcagctcatttgagaaaaccaagaagagcacagcaggaatcgtcacagaagaacatcccaatttttaaaacatgtaattgtccatgttatagactaaatattatccattatgtggattgctggtaccatctaaaggttacataaaattgtttcaatgcggaggaaatctttcagtatacttctcataattactaggccttacattacacattttgtatttcggagcgcaggaatttgaccggggaatgcgggttggataacagatctactacaaacttgcatttgtgttgcttggatgaacttaagccagtgctttcaattccgaagctactctgtatttttttttaattaaaaacatctctcgctctttactttgtatgagtagtctaactttaaaacatcattattaaagataatttttttaaaagacaaaactcctggttttagatagaagcaaattcagtccttaggcaaagaagacaacatactaacaatgtaatataatgcctgtgttgcatcttttcatgatttaaaaaataatttttaaaatttctatttgtatgattttaagataatttaaatctgaaagttaatatcttctaaaagataaggctaaaacctcaagttatctattatagggacatttagaatgcatatttgtatgattttaagataatttaaataaatcgaaaagagaatatcttctaaaagataatgctaaagcctcaacttgtctattatagggacatttagaatgcatatatgaagctgaaactgctcatgtttaaaatagcacaagctttcatttatttgaattatatcttctaaaatataatagtttctttctttaaatcttccttgaattataactttatactgacattttctttttcattagatggtaattttttgagagtcgagtctatggtttcacacatccttgaatatcccatattatcttgctctaacttatgaaatagatagtttgtaaatccttgttgaatgatcgttatgtatgcctcccaaaaaatccatttgttctccgctgagaggaaaaaaataaaaaataaaattaaaaaaaaagacaatgtgaactttcagtatcagataaaaattcatggataattattcttttgacagaatcttctataatgaaaaaaactgaattaacatgtttctgatccattgaacaaattctctaaatgtgtctactccaataaaaggtagaaaaccctgacctcttcacaacgtgttcaattgttcttcttctctcactaatgttgaaatgttatctttaaatttctaatggttttatgggagaaaatgtggaggagaattttagagagcaagacatatggttagatgctataaaaatcatttattgtataaattaaatgcaaaatattagaactcatttcaatgtgtatggaacacaacagtggatgccatttagtctttcattcttttaacgtatgtttacatggatgaaaagacccacagaaaatctgacctgttttccacttaaaactggacctattttcacattaagagtaaggaagcagctttcttcaaattatttacggtgtaagaaatcacaagccctaccattggatgacatttgtgtttattctagtagacagaggacatgattgtttctaaagtatttttcccaatttttaaaatactatttccttttccaggcatttcccggaaacattaactctgacggtgtggtccggcacgaattacagcatccgattattgcccgctatgtgcgcatagtgcctctggattggaatggagaaggtcgcattggactcagaattgaagtttatggctgttcttactgtgagtatcgtattgtttaaatttgtggcaggttttatctttatttaaatagtaagctgttttattttaaattatttaacattacttgctttctctgacaataaactaccttctcatttacatatatatgtatctatgcatagatacatatatatataataaaaggttgtgtctctatttgcatgttataaatgtatattataaacacgtacagagactgacatgtcatatatcttaattatactttaggttgaagatttggaaaggttttttttgttcaatagactaaataataaagcttattaataaaattgccttgccttatgaaatatttaaaaaggggaaacctatattgttatctatgtatttgggtctttattatgggttttgaaaacatttcgaagaacttccttcgggttcactaagtatctctcttcagttatgcctattcctatactaaagccaatcactgggttttaaagtcaatgacgctttctctaccaaatttaatttattttttcaaattgatttggtcatctaaagaggttattttcccttaaatatattttaaagctcccttgttatttcttaaatacattatgcatatatctaaggattccaacatatgaatttgggggattataattcttctgtctattgttgctgctaatttttgcaaatggtacttgttttctcctactcctcttcctctctctttttcttcttatcttgtttgcctgtctgtcctttttatccttatccttatgcttatccatattctttactgtgacctcaatttctttaaaattttatctgtggaaatttgtttgggccaaggttgatggtgaattcttcttgagaggatatatctttgcttatttgcttctgtgaaggcgataccaacacagaactgctttcaagattatctccagttgtggttgttgtttctttatgagactgctagatagtataaatttaatctacgaacacgtgatttgcaaacattggcttcaaaatatgaattccctagtaaaatatactttcctcattcccggaaatttttcttccagctgttacaattccctgggggaacaaagatgctgggtatgaacaaggaggggatttggtttctctatgttatgcaaaaagtctcttattagcccgtttcctactcattcctataaacccacaaaaatgagttcacactaagcagaaaatttcaaatgcccccgttggacaagctttctaaaatgccctagacacttagtattttatataaaagaatatatgaagctttcacctctgtacacatttagtaacagaaattggtcaaaatattagctataatagtgcccgaatactgtcttattaattcataggcaatagtgttatgtgcaaactacaataaaggggtcatggaggtcatttaaaaattctcaaaaactgtttatttggttaccattttattgtagcagataaaattagtagagagacaaaagatttagctcttcaggagaatgtagctctttaaaaggaaaatttagcatttctggtaaggcccaaaaagaggtctaacataaattagaatctttggtcctatgtggtctagacattcatgaacagagtgtcatgttcacacatagtcttgctctcagcatagcatcatgacgggaaggccagaagaaaatgtgatatttttgtgaccatcacaaattttgttaagagccatgtttaacttttagtaaataaatacagacacacacacacatatatataggtatatatacacacacatatacatacacacacacacatatacgtgcatatatatatatataatccttcatggagactacgtgtatgtgcaatttattttattagcaattatttaatgagcacttttcatgtgtgataaatatattaaatggtagcattaccacagtagatgagaaagacatggtctttgtgagatgaagtgggacaaataatttaatagagttaataataataaaaatagtaaaagttaaaatttacccaaaagcacatagcctgagtgataggtctgaaagggaacccaggtagtctggtacagtgccaaagctcactatcaccgttctgtttttaatcccagcaaaataagcacccacctgaccgtccacagtttaatcaaaacatcatgtcaacaccccgcaaccactgagtaggccttctcccagttactgcaactccttaaacataaaaattcacctgatttgtatcaccaaagattagttcttgtttttcaaaaaaatttcacacagatggagtcataaaagatgcattattttacacttgacttctttagttacaaatcatatttctgagaattatctgtgctgatattagagatattagtttcttttcctcagtattattctatcttgtgaatattctacaatcatttgtttatttcatgctgatgaacgtttgagttgtttctagatgttggctatttatacagaattactaaaaatgtttccaatgggtatagacttgggggggtaataacaaactagcatatatgtgtgttcacctttggccaataacaacacaaatttttctaatttggttatatcaatttaaagtctccaatgcaattaactggagttcctgatgcttacaaattaagatatttagtattgtttaaaagtttaggccgggcgcggtggctcacacctgtaatcccagcactttgggaggccaaggagggcggatcacgaggtcaggagatcgagaccatcctggataacacggtgaaaccccgtctctactaaaaatacaaaacaaaattaactgggcattgtggcgggcgcctgtagtcccagctactcaggaggctgaagcaggagaatggcgtgaacccgggaggtggagcttgcagtgagccaagattgcaccactgtactccaacctgggcgacagagccagactccgtgtcaaaaaaaaaaaaaaaaaaagtgtagccattctggtgagtgtttgtcatgtctcattttagttaagttatgtttctttttttttttttttttttttgagacgtagtctcgatttgccacccaggctggagtgcagttgtgcaatcttggctcactgcatgctctgcctcccgggttcatgccattgtcctgcctcagcctcccgagtagctgggactacaggtgaccaccaccacgcccggctaatttttttttttttttttttgtatttttactagagatggggtttcaccatattagccaggatggtcttgatttgctgacctcatgatccgcccacctgggcttgtttctgatttttgaaagaggttatgcttattggtcatacgtataccttttttttaagtgttcaagaatcttgctcatatttctatggattcccatttatctatctatttatatatctatcatctatatagcaatcatctgtttgattgttttaagtagtttttgcaggcaactcttcttcattctcattacaattgctagacacgtatttatttttgaggtgacatttttttaacaataataattttaaagcaaacattgtcaatgaagttacttaagatccacaggtgtagacttaaactgtgaccacatgttctgtaattgttacaagtagatttataaagttgtgagtttgtgctgtcatgggcttttccatcaagcctgggctttgacaattacaagacaagaaggaaaaataactgaagcaaatcaggaagcgagacttttccactgtataagtccctttgggggaaaatcatatagctttgggaaactgtattaacatttatatcaatagatgccagtggagtaagtaacttagcaacacaaaatttaaaaagtagcatttcagttggatgtagtaggttgggtaatggcctatcataacataaagcctttattcttggaagttgtaagcatataagtatttgcagatgtgactaagttaacaatcatgacacggagagacaatttttttttttttttttttttttttgagatggagtctcgctctgttgctcaggctggagtgcagtggcgtgatctcggctcactgcaagctctgcctcccgggttcacgccattctcctggggagaggcaattttacattagccaggtgggccctaagtgcaatcacatgtgtcattgtaaaaggtagacagggagagatttcacagatgggaaagaaggagagaatgtgaacaccttggaaccagaggctgtagtgatatggcgataagccaaggaaggccagcagctcaaaaggcagatttttctctggagggaatgtgatcttgccaacacatcgatttcactcagtgatgctgctttggaacttctgacctccgaagttgtgaaagaacaaatttctgttattttaagccactaagtttgggataatctgttatagcaacaacatgaaactaatacaagagtcaatatattttagaaaagaaaagacaaaaatcggcctgagcaatgttctctgatagaactttctacaaagatgtagatgttgtcaatatgctctagccactaaccatatgtggctactagcatgtgaaatatagctaagacaactgtggaaccaaatttttaatttaatttaatttttaattcatttaaattcaaatttaaataatgtgactactggctaccatattagacagtgcagcttagaggaaccaaaacatcatgtatgtttttcatgtctttttataacataaaggacctataaaagttatgttttaagtgtcagtctctattgttttttcttagtttggaaaacaaaaatttaatcatcctgaaaactgtctttactgtcaataatgtaataaccagtcatcttactaaccacacagtcttagtctgttttgtgttactataacagaatatctgagactgggtaatctagaaagaacacaggtgtatttcttaccgttctggaggctggggagctcaaggtcaagggacctgcatctggcgaaggccttcttttcccattgtctcataacaggaaacagagccctcgtgacctactcatgtcttaaaagtcccacctctcaacactgttgcattggggattaagtttccaaaacatgaactttgaaggacgcattcataccacagcgtacaccaaatgtccagataagattctttttcatttattatttttgaagaatgaaaattacacttatctcttttccaagaaaaatatacatgtttacattttaaaatatatatatgttaaacatatttgttacgaaacactttccaaaagttacttccaaaaatttactggctaatgtaaattttctatactagagttcaaactagaatgagtccttagaagatgatactctgttcttgagcttagtgaactgttgtctcaagagctttctttggatttttcaatgagaaaaggaatcatataactttgagtggggaatgtagattagacacagccccccattttggcttcctagagaatagcagtgctgtgtactctagggtctcagcaaggagaaacatagttttgatcctgcccgtggaagagagatgaattctctaatctgtctggaaactcctgaaagggtgtacctgggatctatcttaaacctgcaagagagggaatggggcttctttcactgcaaagtttgccagaaaactagagagagagagagaaatcacaatgtgagcactgtttctgtttgactgtgtgtctggtgcaactccccttgtgtttgtcatctttcctttgtgcagttcctccatgatcactttgtcatctgagaaatgaggtacttctcaaggctgaaataagacgctgactctattccaggtggagaatttcgttccaggccactgctctgaagcctttagggcttctattgttcctacttcctgacttgtcttgaatataatatgaattccaatttcaataaatctaaactcatttgaaatcattctgcttcctctacgtttggttttccctcaagtttagttgaaacaagtgcatgcagttatttttaaaacttagcaatatgtcccatgccttttgattcagtgagctttctcccacagcgcagacactaatcttcttacgcgataccagtgggacttcataaagcaaaaggaagaggtctcagattaataatttcaaaaaatcatttatggctgcattactcaaacattcattttaaaaagccaaacacagtgcactgattaaagtactgagcgtttttgatggcaaatacttaattagtttttagtcagagtcctcttaaaagtaaggacggcaccttgggaaaccaaggtacacacatcgaaactaatttttatataggcttttaatttggatgaataaataataaaacctgtatgtcattcaatgcaaatcgtgatggaaaactgtcttgctgcctgagaaaaaaagaaaacatatcaggagaagttaaatacaaataagtaaaagacagtgtttggtcattttcatgctgtgttgatggcacgtctgcatctctagtgagaataccctcttctagggtcacacactaactcccctcactctcattcttcccaggcaagagatgctgccatgtacagatgtgttagtttcctggggtctctgtaaaacagttctgcaatcttaagatgaaatttaagacgatggaaaggtattctatcatggatctagagggcacagtctgaagtcaaggtgttagcaagggtagttccttctggaagcttggagagagaaacagttccatgtccctcgcccatctcctggtggtggccagaagtccttgatgttctttggctcattgctgcctcatttcaatctctcctttgggttcacattcacatgaacttcttcgcttttgtctgtgtctctgtgtcttcaaatagtcttcttctaaggacatcggttattggaattaggatctaccctaaaccaggatgaccttatcttaacaagctatatccacaaagacccacttttgaaataaggccacgctttgaggttttggctggacatggacttttggaaacactattaaacacaatattatatatacatatatatgtatatatatatatatatataaatcattaagaatttatgtttacatcagtttaagtgagcaaaaaataaaaaatcagttctggaagtcaacctgtgtgttcctacttaaattagatgtttaattttgtatcatacagaagcatcccagatacttatattttgtgtttataatttcttcaatttattcagtgaacctgtatcgcattcaggcatttagaaacaacctaaagcatgaactctgccctcaaggagatgaatttttggcagaataaatgaataagttaatagtttaaatactctatgataaatgctatgacagagaagcaagcctcgcctatgttgattaatgaaataaggtttcactaagaagcaacagaaattaggggtaaaggagcattcaagacaagaactaacattttcaaagactaagagacacagaggtaagaacataatttatttcatatttggagtttttagttagcaacataagtctcatttcagtgtacaaaaatatacaaattattatgttgcttagaggatcaatatatttgtgacagatttgttaatcttattaatattaataagaataaaaacattgaattatactattttaaaggcattttgctaattttaaatcttaagtgcaaatctgaccatattacatctgggctgactacacgttaatgatgctacattgcctataaagtccaagctgtttgtttgaaatttaatttctgcccacccactgactacctctgtagtcttaaatccagtcatattgtgttttatgctccaaatatgaatacaagctatatttcctaatacatgagtgacctgcttgtttaacaggcagtcattggagatactttctctaaccaaaatagcctctccatcatcctttacctgaccaatcttttttatctttcaagattcagttgaaatgcagtctttaatgagaatcatctgaatttccacaatgagtcatgtgtttattttcatatgaatatttatcagatatcatataccattatattacataaatatttccaatggaatatttaacaaaataattcaaaataaagtcaactgcaagatactgggaggaggagacagcaagtgtcaccttattcatcactagcatccccttaaatggcaggctccctgtacacaataaatgtttgctgaaatgaactgacatcaaatgtaaatgatacaggcgtaatttattccctcagtgaaaactgattactatttgaggatgcatagattcttttattggtggaacagggcatgattatattgtatcatattgaacagtgctctaaggggcctacaaaatattgaaataattaccaaactaaatataataatagatgttcaaacagagctatagacagcaaataactcagtgtttttttctaatttaaatatttgtataacttgtattattatttctggttattattttaaatcacacttttttgaggctgcttcatgggttatgtatatggattgcttatcagaggaaaaaaaaccacccaagatccagagtaatgtgaaaataaaagtaacttaacataaaaatagatttaataaatatcactgccaagttatacaagataaactgataattaatgaggtaattaaaattgtcatgtgctgtatgacatatttgggatatgctatgtttctaagttttcatgttattagatttaaaaaaaatactgtaagttgtaaccagagatgttcttgccattaagagatctggaacttagatttgagcacatgtagtattctttagtgcttttaagtatagtttgggtttcaaactagaattggagtgctttgtaatagacagctgtggattgtcattcagtgtcagtttgagataatgacttcctggtctgtacatataaatattattgtagggataaggctaatgatgaaagtgcacatgatagatactttcacataatttgggtataagccttttttgcaggggttggctaaggtagatagctagtggatcagatactcagtggatctcattcctgggttaccatttgagggtgacatttgaaatgaacaaatttaaagcatggaaatatatgttctaattttttattctatggggaaacagctatcagtatttaattgttttttttctagtgtaatttgtttacttggaagaaacttacaattgactttgttcagtgagagaacatggtgagcctacctttatatttaggaacaagacagttacaattggcagctagcttatattttggagaactatttaatatgtcactgatatagagctagagtcacatcatattactgtaaaatctaaatttaaatttactctcaagaactttcaaagttaaactgacatataaaatcaagagtgtcgatttaaaagcaaattaaaatttctggcagagagtaatatgcaattagacctatgtctgtcactctgaaatatgaataacagtatactttctagaataagggagggtataacttttattatacatattagtccaaaatttttcataaaataatttcccaagaaatgtaaacatattaaaacaaaagtatatatacacattttggtgcctggttaaagagaagaataaagtaatgaaaaagaactatgtttcactgtggtttataaataagatattttgattactacaaagaggagccatatgtgtactctataagaacttcaaagctgaaaagttcccaagagaccatccagcccaatcctctattttactaacgaggaaaccaaaacccacagagttatgcgacttgcataagcgaattaatcgcagacctagaaatcctgcataacaatctagagcatagcttcctctctgacatttaatacctctctcctctggttcattcttctttgtttcttcttcacccgtaagggctttttataatcttagtgatggcctacagaaaatacaattttgtgaattctaatgaccatagaaatgctttggcctatcaattatcaccgtaagaatatataggagatatccagtaagaaaagtatctcactagtactgtgcattctacatgtccagcagaaaaatttaaatgactaatcttcataatgtactcattggagaacagcttgcaaataaacataactcaagctttaattgcattttggtgcagaaagtttatcaatatcagttagtgtattttctcaggtaatcttacctcctgagatacgttaactactttttatatatatgttaatttttatttatgatagatgattgcagagagtactagagcctaaattacagttatacagtccatcaacatttcacttataatccgtttaatgtaaggaaagcaataaaatttaaaatgctgcaaatatatataagtgattcctttattagcttttattcttatgttgttagttttcattatcacctatttaaattagctagggagagaagagcaaatatttaagatggcagtaattgtcctcatgaattaaaagtaacaacataataaaataattatttagtatgcacactttaaaaatttcaagcaatttaaattacttgaattagaaatcagtgattttcagagattaaatattcttactcctatcagaatagtatcagatcttttatagttagacttgaaaagaagtaatccagattttcaatttgagatttttatattttctatgcttctaaatgaagcatgtatatttttctcacatgctcaaaatactgtcatattaggtttttcacctttcatgctcgtttggctggacaggaggagttaaagaaactgtcagtgttctcttttattaccaattaatgggggaataatctcaagaattaaagaaagcattcaacccgtaccaatcattttgtaaacatctgaatactctaccctcaggcacccccaaataataatatttgctaggaaaaaagtccttatttatggaatgtttttagcaagatatccctgtgttaggttgcttatggtaaacacttagcaactttagatttatgatcacggctctatggaaaatcacttatcagctagatgaccatggaggaatgaaatggagatgcttcataaccgaaatgcttctgcgtgaggcaataaactgcatagcttattaaggactgtccctattactctaggccagagagcacatgtctgatgaaagaagaaaaagcctgaggaactatgcagtgtgtatcagatcccaccttgctttgcttgtccctctgttttaattacctcctctttatcccatgggtaagggaggattcctgtcctggggttatgggtatgacggaacacctgacacctgacgtaaagcaactgagaccaacagcagtttattagtggcatttccacacaggctttgagagaaaggcatctcaagtctcgcaggggacatgggggttgtccttgggaacagagtgagcaatcagacactgcgggaggcaggatttgttgtatcaagagagtggtcttccccctggttcccaccggaggatgtgattggcttgttcgaataattctgtgggtgtagggtaggagggaacggaagcccaatactcaaggagaagtggaatatgcctgatccccgagggaagcagcgtctttttattggaggacatatccgcaggaacaaagttgggaggggagcttgcagtgaggtcactggagaccctccaggcttttcccagatgtcaaagcacacataaactgggccttacttttcggccttataccacaagctcttaatgttttgttttctacaattattaataatctttggctctacataagatgtttgctttgtgtaaatttgatttaacaatccgaatttaatatcaccgtataggttgcattaattactaactttagccaaatcaacaacatgaacaacatgtaaaatcccatataaaattttttcttccctgttatcagaacagaaaagaaaaacttccctgtttttcttccctgttataaaaattatttcttccttcttaaccaaccatttatcatgtctatttagctgtatgtgctcttttaaacttgctgtgttggctgtatttgtgtatcataaatataaactagaaaatggacaagtagcttcctaaactttgaagtgcaaatgttttattaagggaaaaaaaaaccctctttcccatggcattgcacttccatagaaaatataattatttcccccaaatccttttacagggttttgctatgttccaaaggacagggactgagctcactttgatttgagttggactctgaacatggttggattaacagcctcggtcattaatctctactccaaatttcagcatgctgtgtccatctattacaggtgtgggtgtgttttttgttgaaacaaaataatgtatacttactaatgctaaagttaacgaacaaaagcaaggttagtaatttttgcaacaaaacctacccagtgagggtcccagaaggctatctgagtaatacagtggggcaaatggtttcaattcaatctctggatgagctttgtttgtttgtttgttcatttgtttgtttgttttggagacattctcactctgtcaccgagtctgcagtgcagtggtatgatcatgactcactgtagcctcgacctcctgggcttaagcaatcctcctgccccagcctctgaagcaactgggactacaggtgcacaccaccatccctagcttattttttttatttatatttttgtagagatggggttattttttttttggtttgtttgtttgtttgttttccccacgttggttttagactcctgggcttaagcaatccttctaccttggcctcccaaagtgttgggattacaggtgtgagccactgcaccaggccaagatgatccttttcaacagcgtctaagttaaaatatgctacaaatttatttaagatcttgctgtaaaataaatcatttgaagtcgatatcatgaaacaacaggagaatgcaatgtgtttcctcctttgtcaaccaacagtgtggacccagcctggacttgcccacaaacagctgagcctaaagcctgcttcatccatcacctgaccttccataatgactctatatcacctcatttcttctattttttttaaaaattatgctgctctttctctttaatctagtttttcttcttcttatatcttctttctaaaataaaagagcacataaatgttttaaaacaaattagattttcaactttcagtaaagataaagttttgtcagtagggattaaagtttgccatcctcgacattgttgatatttctggctctataattcttggctttggaggaaagggctgtctcgtacactggaatcttttgcaacatccctggcttctacccattcaatactagaagtgcatcatatttccctcagttgtgacaaccaaaattaacccaaaagtctcctagtggcaaaactgcccctgggtaagaactgctgatatagatggtgctaaagtgtcacctagaaatcagttcattgtgttcctaggaactacgaaaggaaaattgacacattgtaagaattgactcaacattcatttgatttatatagcagtgtctgttatttgcagaaagcacgtactgcatgctgagatttccatagacttcatattgataaggacaatatttatggtgttaaagtatgcctacatatatagatctcctatatatgtactgcagataaaaatactattatgtcacctcatcagcataaatattgcaaaagaaaatgacctcttgaattctcatatcgtttgtctgtgatttgtggagaattacacaacattacttctaaacattttcaatctaagtggttttatttttattaattaggcattactttttattttgccattaaggatatcatcttttcaaccaggatcaatttgaatctgtaatctcctttggttaattggacattttccttattgtgaatttaagtttgggatcaagaggagattgattagatctgccacatagtttggccggggattatttatatagctgtttctttgcatttcacttttgctaaaaaagtagacattcaaaacaatataaatttgtagtctgttagcaaagtgtattctctaatattctattatagatatagtatgttctatagagtatattacactatattctattctattatagaatacactttgctaacagaataaaatttatattgttttcacgcactctattcacatttaagaaacattaaccttcataaatagcataaaggctgattttctctaaaacagagcaaacaaatcaataaaataactttgccccacttcttagcttccacctcaaagggttcttttttgttcgtttgttttgtttttgtttttgctttttgagatggagtctcgctctgtcatccaggctggagtgcagtggcgtgatctcggctcactgcaacctctgcctcccgggttcaagtgattctcttgcctcagcctcccaagtagctgggactacagatgtgtgccaccacgcccagctaatttttgtatttttagtagagacggggtttcaccatgttggacaggctggttttgagctcctgacctcgtgatccacctgccttggcctcccaaagtgctgggattacaggcatgagccaccattcccgtccctcaaagggctcttttcctactaaggaagtaaacgatgcaggcctgattgtgtgtttttttgcacttttaataacaccttcattgaccatgtgacaccacacaataccactccttggtgatgtgcttagcaatcccaaacaaacctttccaattcacataaaatgccacacaccctattcctccctacctcttagggttgtcataagaatttgaatgatacatgtgaatgctcttctgattttgaggatgaagtcactgtgtcatcttaatcatgcttatttggagttgtgcctagaggggcataatacacagtgtgaaaatatgttctattgaaagttcaaacgattgctttagtggttgatgccattaaattggtttggaggatgttttattgcatttaaattggactgaccacctcaaagagctatttggataactctaggcaacctcagtctggcacagataatccagttacttagtaagagtcttgagcacaaaactggggagggggttatatgataattctgattttttttttttttttttgcaaataaaaagatactcttgactgtgatcttatttccaattgtacaatgggttcaccttacaaaattaagtatagtactatccccatgcttgctttttaattgaggaaatagtgggtggtttggttaactaaacaaccatttgttagattaattctcactagcttgattcagaactatacctagtaggaaatattggagctaggaactgagcaataagcagcatttatttagggtgtctggctcatatatattgtgtccttacaacaaagatgcaaaacaggtaattattcccccattttgcaaatgacaaaaccgaagttgaagaagtgaattaacttactctcataacaagcaatgtcactttaatttttggcctttctaccaaagcatgttacctcttaaagacagcataaaatcagagcataacagattcatagaaagaatggttataataataattactatcattactactataattatagtttgtatccagaattgattaatcattgattataggtcagatattgtgctaagttccttatttaaaacctcacgatactgctacaactatcttcattaggaactatcttcattttaacaatatgaaaatgaaggacaaaataattttttgtttattcattcaatcactaagtgtaaaaataagagcgattatgtatttgcttgtttagtggtgccatattctcaaaggtcccaaagtaacaatttaaaaaaaaaaatgtatctgtccttgaggggaacacagtacatctatagtacaatttttcctaagagtagttatttgaaagtcatgacaaaaagggaagtggtcaaataaactgtgttgaacagccattgcaaattatttaaagcaattttaatggcaacaacaacaaaaatatgtattaggtgaagaaaagcagaatataaaattgttaatacagatcaatatctctttcacttagcagtttgatttcaaaatgtgcaggctgggcacgatggctcacgcatgtaatcccaacactttgggaggcaaacacaggtggagcacaaggtcaggagatcgagaccatcctggcaaacacggtgaaaccctgtctctactaaaagtacaaaaaaaatatctggggccgggcgcggtggctcacgcctgtaatctcagcactctgggaggccgaggcgggcggatcacgaggtcaggagatagagaccatctggctaacacggtgaaaccccgtctctactaaaaaatacaaaaaaattagccaggcgtggtggcgggcgcctgtagtcccagctactctggaggctgaggcaggagaatggcgtgaacctgggaggcggagcttgcagtgagccgagaccgcgccactgcactccagcctgggggacagagcgagactctgtctcaaaaaaaaaatagaaaaagaaaaagaaaaaaactgcgcaaaaattacatcaaaatactaatcatatttctgagatgtagtattatggataaccttttttatgtttttctgcattaatattcaataactttattactaatattcaaatattactataatcgctgaaagacaaatgctgtatgattcaacttatataaggcatctaaaatagtcacattgatagaatcaaagagttgagcggtgggtgccaggggccggggaggaagaggaaatgtagaattactattaatgggcatgaagttgagcaagatgaataaattctaggaatgtgctacacaccattgtacttacagtcagaaataatgcattgaacacttacaaatttgttaagagagtagatctcatgtgtttttaccattgtaaaataaaattaaaaaaatgattagtcaaaattgtgaaaaatacaaaacatatataatttgctttaaatatcattttaaaatatgtacaagatttgtatctcaatgtataaattcagatgcacataaaagttctcatccctttatttatcagttttaattttaagcttccatcttgctgttctttcgaaaggcttactctaagtcaatcctggtttcattttatttcagggtcttatcgtgtcattgtgtgcacacacttgtatgtacatacagtgatgcatgtgtgtatacactcatgtgttcccagagactagttgtgatacttacagtggcccctgtttgtatttcctcctccacgattcagtgattctctgctgcttttcctgcagtcttgggaacttgaatcaattgggaatgtgttgatggtccacctataaataattatcccaaaatagcaaccaattactttatttgaaaacaaaacaaaacaaaacaaaaaaacactagctgaataaactagtatacttagtattcggatactaataacataattcaaaaacagttctttggccgggcacggtggctcacgcctgtaatcccagcactttgggaggtgggcggatcacgaggtcaggagattgagaccatcctggctcacacggtgaaaccccatctctactaaaaatacaaaaatttagccaggcgtggtggcgggcgcctgtagtcccagctactcaggaggctgaggcaggagaatggagtgaacccgggaggcagagcttgcagtgagccgagatcgcaccactgcactccagcctgggcgacagagcgagactccgtctcaaaaaaaaaaaaaaaaaaaaaaaaaaaaaaaaaaaaaaaaaaaccagttctttatgatatatataaaattaaaaccatagacagtacctacaatctatattttcaatatcacattaaaaaagcagtgtaatatcagtatattattgtgatttatatgtcacaatttatccctgcttaaatatcatatagaatgcttaaaattgtattaattcaaagaattattcacaatgtcattcccaatgtcactttttagtttagagcagagtatgcatgcacagggattatttgtggtaaccatattatgaagtgtagcattatcttttattataaatgatatgatataatcaaaagagatggccttttgggtttaaagacaaaataaatgccacgtttactaaatgggtatatttgagatgattgcttaagctttccaaatcccatttttgccactcataataggaataagaatgcttacttcatagatttgtcatgaagattaaattagataataaatgccaagtgcttagcaccatggctggctgaaggtaaggatttatacatattagcccttattattattgctgctgttgttcttagttcttccctttggtagtgcatagagtcatgtagtaactgtttgtacttcctatattctcaactctgaaatgaattttattatctagcgtctgttcttaacctcacaagaaaacatgccttaaacattaaataagcataaaaatgaggtcttgatgctcacacagagaaataagcattttccagaaggagttgccttcaaatcaaaatataattgatactactcagaaaagagattttctctctgcactgattgacttgaaagcagaatagaagactggagtcacggagccagaaaatgtttagaggtggctggcttcacatgtattttctagtccaactattaagtttgcagatgaagaactgagaactccctgaaagaggaaacggctcctcctgagacttccccataaggaactagtagcagaaccgtattggatttggttttagtgcttagccccatgctcttccactatattacatttaaggtaacatgtacgttttcatttctattagaagtcatcaatgggtggactttgagtgtgagcattttgccttgcatgtaatagatattcttaaaatagttgtgaaagaatgaatccctcttttatctatcctatatatgaaatgactttgttggtaaaaaaaaatggccaattgctcagcaatttacactagaggataattttacaaccgcaggtatgggacacacttgggttcctttccacacttggacattttatagatgcatttttaagggaggaggagataacagcaatctcagtttttttctggaaaataaaaataattgttgtatgcccagtggaactatgaaggagcatattgggcccaagaaagtaaagaatgtctacacttaagctatttttaaataataaattaattcataggagaaacaggaatgagaggcaaaaatgtctagtaattaatataaagtccagcaaaatgacttaaaaacagttatatttgcaaagaagactcagcacacttatgtcataaaaatccttgtctagtcacagttttaatttatatataaaattaaaaccatagacagtacctaaaatctatattttcaatatcacattaaaaaagcagtgtaatataaaaaatataaaagcagtataaaaaatcttatctagtcacagtttcaatttctcacaattgtatgatcattttgacattataggagagtaaggatatgtaagttagctaagaattacagcagctttcgagaaagataagacagagaagtgagagatggaaagaaatagggacaactcatcgaaatcaatataaaatatgttagttaatagcactgtttgcaatctttaacaaatgtcctctagtggtttttaagtatagcacttcataagccttttgaaatggcatgttaaagtagtattaaaaggctgacttaccattagcatgctatttaatgtgtcattttaatttttaattttggagagttcctagaaatagtgtattgagtgagcattaacaaaagattattaaaactccaatgtcaacttaattgatatatcagaattcttatgacaaatagttcataaatttgtttcacacattatgaaatggaaaaaagtaacaggcacatgctctgtatattgctgttaagtgcatatcctaccataaaaacctctccattgtataacaagaggcttgtgagatacttgatgaaagggtagcatctcacctgctaaatgatgtggaagaattctttgactgaccacaccatctatagagatttgacattttccctgtgcctcacatagcattcttcacaaaaggtgagtgttgtttgtattaccttgaatgcacacacaccgcctttctttcctcccatttctttcccatctccagtcacagttcttatagtgtatttttctgtaagtagttgcaaaatattcaattaatagcagaggggacttattcaatgtcaatatatccttaaataaagaataataaagaagaaattactgtagggaatggaaaatcattctctccatctccaacaaaactatataaaacaaatccattttctaaaaatgttaaaatcttcccagttggctgaccttgtttcagtccagaaagacacagatttttagaactaagactgtgaagcccacatcaattttgcagtttcaagagctcaaattccttatgaaataagctgatgaaagtgtttaacctgtccaaatgaaaaataaaatgctgagtatttaaatgcctctgaaattaagtaaatctgttctatacatgtttttcttctaatttctgcttctgatagaaaatagtttagatgagattgttttaaatgcacaaatggacaagaaatctactgtaatataaagccctgtccaaattccagctcttcccttattagctatgaagccttaagcaagtcattgacctttttggagctcagtttcctatatgtaaggtgaatgtgataatagccgttatttaatattgttaattattaattgaaaagtttaatggaaaatgtcttgcacatagtaattattaagcaaatggcaaccatttgaatcttcactagaggctattttgtattctaagtcaagaaatatattggataagaatgaaattaagttgactacagatgaacttttgatgtaagtatgagcctatttgttctaactaactattcagaaattggggcagtgtaattcttaagtacaatttaagatgatcttttccaactctcatatttaaacaccaggtaaacaacattaggagtggctgtagtttgttggttgccaactagctggttagtggcagacacagatttgaacctacatgtctgttgtgtggataaagttttcctcttatatcctgtcacttatatgttcagtttcccttgtatcttaaaattttatgaggaattaattatgcttttttagtatattcttcaagtccattatcaatttcttaaagacacaaactggttattatactgaattcctactcttctcagcatctcaaaatgtaagttgcacaaagctaataggcatttttaagttgattgttagaagtagaaattattataagtaaaaatcattagaaatatatttctgattttacttacattttagtcaatattaaaattaggagttttaattaggaaaattaagaaaataaagacggtgattttctcatgaagttgactcatatcttttgtacctgtctcctttccaaactctgaagtataaaaaaggtggaaaaggtggttttataaaacaaaacaaaacaaaacaaaaaacaaagaaacaaaaaaccttacaagttaattcagaggtctaaaagcaaaagcttgatatctgcaacaggagcttgatgtacagaaactagaaggcaacaaaggtcacactgacctattatttaattagaaagaacaaaagttttctcaatgaccctaacagttctttaaactgaattgaagatgctggtagactgtaactttcagcagatcgtcgtcagttctaaggttatttcgtcagttctgttaccattacagccaagacatcatacgacagactacttcaaatctcacctctacttgccaaatccgggatgagaacaggacaggtgacacagcagacggtggcttctccacgctcatggttggctgaagttgccttctagatgggctttcctttttataaaactaaacagcatatcacactggaaattgtttttgccttgtagatatatctggtaacaaattctgacatattggattttataaattctatttaagccttacaggagattttaagtttcctaaaattcttgctgtgttcattcccaattatagactagtaagtgttcacacagactctaacgagtttttcttactgagaaagggtgcacaaactcataatgggggagaatagtcaagataaaaaatgttggcatcagtaattaaacaggtttgctttccctaatgccaaccatggtgggtatttatttcctctttattttgaagaccacatgttagactgtcttttagtcaggtaagattgctgtaacaaattaccatagattgggtgattgtaaacaatataaatttatttcttatagttttggggactggaaatctaagatcagggtgctagcatcatcgagtttgggtgaaggccctgtacaaggttgcagactgctagttccttgttgtatcaccatatagcgaagagaacgagctagctgtctggtcacttcttaaggtgggactaggctgggcgcattggctgacgcctgtaatcccagcactttgggaggctgaggtgggtggatcacgaggtcaagagaccgaggccatcctggccaacatggtgaaaccccatctctactaaaaatacaaaaattagccgggcatggtggcacacacctgtaatctcagctactcaggaggctgaagcaggagaatcactggaactcatgaggcggaagttgcagtgagccaaggtcacgccaatgcactccagcctggtgacagagtgagactccgtctcaaaaaaaaaaaaaaaaaaaaaaaaggactaatcccattcataaggcctccaccctcatgacctaattaactcacaaaggccccacctccaaatgctgttttattgggggtcagatttcaacatgaattttgggaggggacaccaacatttgggcaatgagggattagatctactaaactcaaaaaactgtgtattgctattccaaagaatggtattttttcataattcttttttatgagtatgctataatatttacaatgtagcagtgactaatcaaaaacccacctgtccgacattaattcaggcatccataagaagagataatctgaactgtccctagaatacaaatcttgaatctgacaggtactatttcactttgggcaaactacttaatttttgagcttcaacttctttatccttaaagatgaaacaaagaaattcttcattgatagaaagaaaataatttcaacaagcattctgttgagtatcttatgaagtctcctcagctcagtgccacacttacctaatcctctcgattcgcattcggttgttctcttcccattccattttgtgttagtttcttatatggcacaatttccacaaacttatgccttagaacagacatttattattttactgtttttgtggaccaggtgtctgggcatggcctagcccatcggcgtgtcagcctaggctgtggtctgggctgagattcaggcttcttgtgcaagctcgaatactgttggcagaagtctttttatcgcagctatagaactcaggatggtttacttcttcagggatggcaggagagacagcctttgttgctacaaatctcaaatctctgtatcctcttttaaaggggtcatctgcctaactcaggcccactaaggatggtcactcttctgacctaaaatcaactaattggagacctgtgagcatcagttgtatgtgtccatttggcaaggctaccttcttgggttggccaatcaaacattaacttaggtgttgtatggaagtattttatagacaagattaaactccataataaattgactttatttatttatttgtttgtttgttttttccaagacatagtcttgctctgtcgcccaggctgaagtgcagtgactcaatctcagctcactgcaacctccgcctcccaggttcaagctgattctcctgcctccacctcccaagcagctgggattacaggcatatgccaccacgccaagctaacttttgtatttttagtagagatggggtttcaccatgttgaccaggctggtctcgagctcctggactcgtgatccgccaacctcagcctcccaaagtgctggaactacaggcatgagccactgcgcttggccacaaactccataataaatttactttaagtaaaggaggctatctccaatagtctagctggtcctgggcttcttcccaagagtttccagtctgcctttcctgacagcctgtcctatggacttcagaactgccaaatcatcccctacattgcataagccaatttcgtgaaatacatcttaatatttgtgtatcctcccgtgtgttagtcctttctgcattgctgtaaaggaatacctgcagctaggtcatttataaaacaaaagagtttatttggctcatggttctgcaggctgtacaggaagtgctggcgtcttctggtgagacctcagaaacttttactcgtggcagaaggcaagggaaatctgttttcacatggcgagagagggagtgaaagagagaggaagtgccaggccatttttaacaatcagatctcatggggaaaatatagagcaagaattcactcatcacccggggaagggcacagagccatttatgagggatccacccccatgacccaaacacctctcactaggccccacctccaacattaggaattacatttcaatgttagaatggcagggtagggggagagcataaatatgcaaactctatcatcctggttctgtttcttcagtgaatccctggctgatataggaccttaattacatatactaaatccacttactatgctgtataacataaccataatcagaaaagaaaacccatcatattcacagattctgttcaccctcagaagaaggggattatacaggtcacctgtcccagaggcaaggacatataggggccatctcagaattctgtcttccacatattctccaactatttactttttattttctaataaattctattcacggagaacaaacagtatgactttctgggatgggacagtaagaaagcagttggtaggggagggaagaggtcacataaataatggaattaaagctttacgtaacatagagattgagtaaagatataaaagctggccctttctgacaatcggagatccagttccccaaactcattagctgctaatctcaaagttgcttacttactatcattctctgttttctagtaggtagagttgtccaatagaattttctgtgatagaggaaatattccacttctgctttgttcaatacagtagccactagccatatgtagctatggagcattcaaaatgtggctatagtggctgagaaacagaatttttgttattaactaatttaaatttaagttcaattaatcatattgggatagtggctgcagtattagacaacacagcatagaggaataatctatcggtcacagctggatttctacaggaaacttgacagctttggctataaataagacctgtgatatgtctgcagtttcaacatttgttttattaatgtgtacctgacaaacaaatgacctgaaaatctcttttcaaccagaaacaaaatagactggctcagtactatgctttttacatattgcaattttatgtgctttgttttcactttaaagaaaatatattgtgcctatctacaatctcagagggaaattaggtatatagcatagtctcttttcacgtggaatcttttgagggggactagattcatccgaaacactcaaataaaaatataaatagacataaatgcagaggcagaaaaagcacattgcctgtcggggaaaaatgagctatcaattcttctgtagccaaaaccacatatggttagctcattttcaaggttcaaatgctctgagaagtgtcatcgtattaaccacacctaagaacggatattcggggaattctgagatcctaactgacagtctgatcagaagttgggtcctagagagctcagaaggactgttagaatgctgatctgatccagagattacccaatgctaggattttagtctttgatttctatatagcctacctgtggttccagggaatttgaagagctttgcatttgtcattaaactgaaagagtcatatagccttgccagggaaagaagacagggatgcaactgctgattaaggccccatgtttttatgtccttcttagagtacggattccatgtcaggcaactttaactagctttcacaaatttctcttgaatatactcatattgttggctggaaggtttaaggaattatttgagaaggcttctcatttacgatggaaatgtatcagaacatgatttaaaactaaatagcagagacctctgttttcaaaagaagcataattaaaggaaatttaccactggcagtgtgtgtgtgtgtgtgtgtatttgcttcactccaggcccaggacctgggtatatggtttggcctctctttttctcccaggacctcattatgtatccctctgtgtcttcaactctgtgggactcttgcttgacttcttccagctgtttcaccatagacacattccttttattttgctgtgtaaagcaattcaacccagccttctgactggtgctctagggcctataatttcatcggcaaatggcccatcaaagtgtttagttaaattttctccataacagaaattttcaagcaatgttttaaaatagtgactttttcttctttttaacaaataatgaagtgatacttttaaagttattcagctaacaggtataaagcagattatcctgcaaaaaaaaaaaaaagatgtatacattcctccaaccatactctgtgggaacagcagcaggactgccccgtgcatctttcagcaagcaggagatgcatccctctcttgtaccatttatattaggctttaattatctctctacataactgcagtccccaaatatgaaatgagttcctgatggcagaaaaagcttcatatcaatttttgtaaccccaggccctagtatgctctctggcacctaattatagcaatcagtgaatacttgatagggtcatcattcacttaacagatattccctggccacatatgagaaagtgacatttaagctgagatctgtaaaatgagtaagagtgagacatgtggaaaagaagatacgggtagttaaggctgagggagtggcacagaatgaatcaactagcaagttaatgaatgaccaaaaatgctggtctatgtagtactagacagaggatcacaaatatcttgtttcaagtcattcttgagagttctggccatctgtatcaaaaacttttgtttggtcataataacaatcattgattcagtaacaatgactaagaaccaaccatgtactaggggctggatatgcccagggtatcatgatgaaaataaaaaccagtctctgcctttgtggggagactgacattacagatctgcacagtggaggtcatattgcacctgtactcatcctggaggatggtagtgctctcaaggtaatagaagccaacggaaatgtgacttcagtagtgatctgagggagaacttctccagggaggtgatggctggttgagctttggaaagtaggtgaaggtaggaggaagggtcatatttcaggtaaacaaaagagcataaacagaactcttggggcagaaagacaaggctggtgtggctgcagcaccgagattgaagggtgatttggtatgaaataaggctggagagttgacaaatcctgcaatagatggctttttaggcaatgttcctgatttctggttttgattccattagaaacccaaagagatgccaccaaactatcttaagccaacagtttgtatgtgttggagtgatggacatggaggaagcatatcatgatcatgtctgctctgggtaagccttgctctggctgtggtgtagaggacaggtctgaaggcagaaagagaagacttggtaacacctgtcacaggatatgactgcagtgccagggtgagacctggcagcctagactaggatggtggtagcagagtggaaatatctgggaggattgaagagctattagaaggtaaaatctacagaacttggttgtgggttacatgtgggctgtggtggaaaaaagtgctggaaatgcctcccatgtgtcagtctggttttacctggtattgggcaataccatgcaggtatggactgatgggagagactcagatttaaagaaaggatcacacatctgttgttttttttatttttgaggaggtgaacttaacactctgggtctttatttccttttcttcctttattcttttttttttttttttttttttgagatggagtcttgctctgttgcccaggctggagtgcagtggtgtgatctcggctcactgcaagctccacctcctgggttcacaccattctcctgcctcagcctcccaagtagctgggactacaggcacccgccaccacgcccggctaattttttgcatttttagtagagatggggtttcaccgtgttagccaggatggtctcgatctcctgacctcatgatccacccgcctcggcctcccaaagccttttcttttttttttttttttaacttttattttaagttcaggactacatatgcaggtttgttttatggataagaaaatgtggtacatatattccacaaaatactatgtagccataaaaagaatgagatcatgtcctttgcagggacacggatgaaactggagagcatcatccttagtaaactaatgcaggaatgtaaaaaaaaaaaaaaaaccacaaatactgtatgttctcgcttgtaagtggcagctaaataatgagcacacatggtaaatgttgaatccgaagtgcctttacggcatctacaaggtgttgcgtggataactaaataaaggagtcaagatctcagcttggataggacaaacgacaaattgtgacttagctatgcataggagaggtaattgaaaccgtgtttggatgagatcacctaagggtgagaatagagggtgagaaaagaagagcatctaagactggtccttagatctaaaaataatggctgaataatggaacataagcttcaaagcagacagagaatgagtggcaggtaggtcaggggaaatctagaagggagatgtgacaagaaagcatgccaggaagacagaaatgggcaccagggatgagcactgctaagagatcatgcaagatgaggactaaaatattgtccaggaaattagtaaaattgaagttgttggtgaccatagcatgagttgtttatggaagggacggaaatttaaacctgggtgatgtgaatggagtatggggatgaagggtggggttaggagattgagtcagaaaatgcagtgtggcatttccaaatgaaacacagcatcagataataggataaagatgaggcatttcatttgttcgctcttttaaacagcctgcttttggaatcaagatggtgaattcaattaacctattattatttcttggtatatgacagttcactagctattgcactccgtagaatttatttcattctattcaccctggctgaagaaccataggtaagatccaacattttcagtggcagcccctcaaaaccaacgtgtttccctgataatcattctgcttcccttcttttgttgtttctggagatctccatctgctcttccatttatcatctgcttgatattcttggatggtgtgcttggttggcctatgctatgggttcagataggcaagtaactatattccccttccccattacagatgatgtgcctcatttagctatgataaatatttgctcatttcctcacatctgcatatggcactgctaccaatccatcttttcctccccatcctcatctctgctaagttcttttcctgccaccatttctatggttgaccagttagcatttaagaaaatatgctgacagtagccgcatcatggattagcatttcttcatgttcataatgcaaaagccccattagatgtaaaaaacttgctttcttatctttcctttgttacacttatatggaaccttttagaagttctatttataagtagaatgatatgaataaatagaaatgtgccagtgaaatagaataggccaaaatatacatcatattaaaaatgaaaatcaatcatttaaataatattatggctctttgaaataatattataccctatatcaggaggtttgtgttttgtcttatttcattttcagtatgtttctattgaaagtgagattgccatcaagaattctcaaaaccttctggggtgagatttcagagcttcaactatgttaatagctgtgcttggcatatctaatggtgttttgctccttctgaagcattttttttaattagacaatacatttataaccaagctcagtgagggtccagattgtggatgaggattaaattgagattaagatataagtgtctggtccattttaggaagttgtcaaacaccgttaagagtacacagtaatgttattctctgattgttgaatataggcaagtttcaaaaggacccttcacagttatgaaacttttaagtttgctatagtgaaaagattgatacatgggaataaaaattcactcatgaatctcattttataaataaatgcttcatttatgtaaattgtttgtactttgtgtgggtaaacaatattgattgcacatctagttgaaattactggatgagaagtattagtatcctattcttatgtgtcgatttaacctacagcctgggttctcttgactgccacattcctttaatttcctttacttttatatactcatttatctagaacttaagaaatccccatggcttgtggtaacatgaactgaagatggtattacaacacatttccttctagctctacccagcacgaaagctttattataaggattctggttcttcttgctatttggggagtaatattttgaaaattcataagattatgtccatcaagcattccagactaacaataataatagtatatgaatgtatgaaataccataacatttttaatatgatatttttaaatgaataaatttcttcttttttcttttttttaaattatactttaagttctagggtacatgtgtacaacgtgcaggtttgttacatatgtatacatgtgccatgttggtgtgctacacccattaactggtcatttacattaggtatatctcctaatgctatccctcccccttccccctaccccacgataggccccagtgtgtgatgttccccaccctgtgtccaaatattctcattgttcaattcccatctatgagtgagaacatgtggtgtttggttttctgtacctgcgatagtttgctcagaatgatggtttccagcttcatccatttccctacaaagaacctgaactcatccttttttatggctgcgtagtattccatggtgtatatatgccacattttcttaatccagtctatcattgatggacatttgggttggttccaagtctttgctattgtgaatagtgctgcagtaaacatacgtgtgcaagtgtctttatagcagcatgatttataatcctttgggtatatacccagtaatgggacagctgggtcaaatagtatttctagttctagatccttgaggaatcgccacactgtcttccacaaaggttgaactagtttacagtcccaccaacagtgtaaaagtgttcctatttctccacatcctctccagcaccggttgtttcctgacttgttaatgaacaccattctaactggtgtgagatggtatctcattgtggttttgatttgcatttccccgatggccagtgatgatgagcattttttcatgtgtctgttggctgcataaatgtcttcttttgagaagtgtctgttcatatcctttgcccactttttgatggggttgtttgattttttcttgcaaatttgtttaagttctttgtagattctggatattagccctttgtcagatgggtagtatttttaagtgaataaatttctaagtgaaatcagttatgactttcaaagcaatttttaatctgctgcatttttattagtgatgaaaagtatatgagttttaatcatgaacacaatttaaaaagtcaaccaaagacttcaggatgttgttccttgttacttctgtcagtgtaaatttcattaatactatgggtgatgaataatatgcaatgtttaagctgtttatattttctactttaatagacgttctggctttactatcaaaaagaatgcaagatttataatttagaaaacaagaagaaaaagagcattgtgaaggtcaaactagctatttgcattttaaaatagctacttctcttttaatggacgttgctacaaatgtatagcaataacccctcagctggcaaataaggaacattgtattagtttcctgagtttctttaaaacacaactgcttcgtttcctcccacagatactatggtattagatgttttaattgaattacttagaaaatatatcgtttagcttcttaatataaaactaattttaatctgagaaaatttaaaaaagtattttctcatccttaaattcttttttccattgttttccaatttagccctattgtgtctacaactcagattttaatcttttttttactaaaacaaatttattatttaaaaaaattaacttttctttttttccttataaaagtaacctacatttgtatctttagttctaaaattacaggtggccctaattcttttctctttggtatctggagaaagtgaatgcaattatgattagcagaaatgcttttttttcaattgcacactttatttagtggaaacaaaagatgcatgtatgattcaacttcacaaaaggaaaagactcaaagcaacactggtgatgagccgtttcatattcttaggtagacgcaagatccccgtacttcctgaaaccttatctaatagtaaaatattttctgactgtttctccagtcttttaccactcttgtcaatggatacacaccaaatacataaataatgtatgcaggttcattttgggtaccatctagctacacagcccagtggagtggttgagtacaaaagccagcctagcttgaaatttcaagctttgacattttctagcttccttgggcaagttacttagcctttctgtgcctcagttttcttacctataaaatgagaataatgatagtaccctcataatagggtgattatgaggattgcatcaggtaactttgtaaaggttctggaacatatagcaagtactatataaatgtaatacgtatgcaattaaaataggcttcaagatacacagattacagataaagaaatagctgtagacagaacatatcactttattcactccacattattactttttacattttcaggcttcttactaccaactaacagggtatattattagttctcttgtctatgacatctgatataccttccttcctttcaaagagtgccaaacattttaaatgatacttacatttttctccaatgtatgctgcacaattaagtagattgatagatatttttcatcagcacaaagagaggatcgcaatacatataagactttatctctgctgcaaaatataccttgaaagaattacatgtataatgaaaataaccctgacaatgccaactttatctgcgaaatcactggccgttgactttctgtgaaagagttaagtacgttgctgtatcaaatattcagttactcattaattaaagtagaacaaagtcaatactttttttgttcagcagattaaccaaaaactaccatgtaccatgtttgcaatttatattcatcctataaactgcatatgcattaaacatttccatctggagccccgatgactgtttttctcccatctcatgcttgataagctgttactgattagacagggaattctgaagctgttgaaagcacagatttttttaaagctctatcaccttggtattctttatctcttaacagaccttgcttgatgcctgcaggttccattttggctgcaatccagataggaactataggtcccctggccacgatggtctaacacagacaacgttatttggtatctatctaattattcctccattaaaaaaaactctctatctagtctaatttctaatattgaatttttcttctttaattgtctcatttaatttttttttttttgagatagagtctcactgtgtcccccaggctggagtgcagtggtgagatctcagttcactgcaacttctgcctcccagattcaagcaattctcctacgtcagtctcccgagtagctgggattacaggtgtgcgccaccatgcccagctaattttttttattttcagtagagacagggtttcaccatgttggccaggttggtctcgaacttctgacctcaggtgatctgctcaccttggcctcccagagtgctgggattacaggtgtgagccactggcctggccgtcttatttaatttgatgtcaaaccttaatttagtctgtgacatactctgtaatataacataactagcatattttggtgcatggtgttttctaactattgttataaagattttacgcattttgactgatttaatcctcactaactgtgctacgaggtagatgttattattatccccatttagtaggaaaactgaggtcacagggaggttgagtaacacagctaggaggcagtagagctcagccaggaacccagagcttctaattctgggacctgtgctacctgccaccacaccacggcctgacagagctgtcttcatcccaccgttagtgggacatgcagtttgggatgttgctcccgtgaaaaacagtattcaaaagacccacagcctgactccttctttataatacacaccctggatagcattaggagatatacctaatgctaaatgacaagttaatggttgcggcacaccaacatggcatatgtatacatatgtaacaaaactgcatgttgtgcacatgtaccctaaaacttaaagtataataataataataatgataataataataataatgctaataataataaattaattataatacactccctgcctgactccttctttataatacacaccctgccactttgtgctacctgataggaatcatttaatagattaaaaatggagtatataatctgtgtgctattaataattaaaaacaatgacaacagcaaacacaataacaatcccatagctgctgtttgttgagaatccccacgtgtttgtcctttcacagtgtctgtaagccgcgagacttactgtcatgtgtcatcagcacctgatgagatattttaaatatcacttcatactgagactcagaaaagtgctctttcttgtaaaagggcacaaagttagtaagtagtagaaccagaattcaaagcctagtccttttttttttttttttttgcatagccatatgctctcttatatactaattggttagaaccctctagcttgaaagcaactcagctagccagcaaatatccccccaattaggaggtgactgatgtcataaccagattgctccctgttctctttttgtttgctataaacttgatcctttggatttgtgcatattctaaagatcaccctgtcaccatgcctggaggcaattaagtataagggagtagtgtttcaagataatctcccactgtgaaaacatgggaataattatccaacgtaaacatgtcatttcttttctaaattacatggattccttttttgcactttaaacctggattatacatcttactcaacttcgtatccagacccaggcatataccagccaggtgtatagcatgaacttaataaatgttgattaagtgaagagacttaataattaataattaactaatatatgatgaaagaattttaaaaattcacttgtttgtccatagtttcatgtagtcaacaaatgcaatcaaaaggccaatgatatccatgaagataacatttattttttaactaaaatcctatgttttctgtaattgtatggtagcatagaattttatatatataacatacattcatatataacatatataacatgtatatgacatatatataacatatatatctatatataaaataaatatatataaatatatatataaaactttgtgtcatttcaatcctgagctattttttatttttctgcctcatgtcaattagaatcagtctccccctttgattccagtcaattcaaccaccagtcgttttcctacctcttcctgacctcctcaccaatattgactctggctatgtatcctgaaaagtgagaaagattgaactgatatgaatgaaaattagaataaatgtaaaattcacacataatattgtttatttctcctcatatggtacacaaatatacacttaaattttatttcatatgacatcaacatagtgtatattcaacaaaatataactcctgatcctgtcttaaggagtatataatctaatgaaagattgaacacacaacagtgctaagaaccaacagctatgaagaaggtgcaatattcacaaagaaactgtctttgtgatttcaggtagtgctccttagtatcggattgttgagccacatttgaaagaatgattgtgaatttatgagaacatacaccaacgagtggacagtgggatgcctctatccagcaacacaggccactgtctcatagttcctcatcagctgctacaggattcactccaaatttcactataggacctgccagcttgtatttttgtctcttgagtctacgccaaaaccaaaactggcaatcccaaccactcatcacttaaaaactaagagattcttttttttttttttttctgagacagagtctcactctgtcgccaggctggagtgcagtggcgcaatctcagctcaccaccttctccgcctcccgggttcaagcgattctcctccctcagactcctgagtagctgggactacaggcgcaccaccacacccggctaatttgtgtgtgtgtgtgtgtgtgtgtgtgtgtgtgtgtgtgtgtgtgtatttttaatagagatggggtttcaccatattggccaggatgatattgatctcctgaccttgtgatctgcccacctcagcctctgaaagtgctgggattacaggcgtgagccaccgcacccggccgagattcattaatcttaaaggcttggtcaaagagcaagtattaaaacaggaatgtcactttcagtttcatcttgtgccgttggccattcataccttcctgctacatctgtacagtcttccacgcccagcttgtgcttctagaaggaaatcaaatgagacgatttgtatgctggtgctctgaaaaggagggagctagaggatcaataggctctagctaatagttttttggatccgaataataatgtttatagaactggaagactgcagtttagaatggtccttgatcacttattcattggtctgttcaagcaggaaatacaatggtttcattgagtgctaggaaaaaaaagaaaggtaaagggtgttgaattcagccactggctgggctttgaccagaagggaaaatcagggattggatgctgctatttaaacattagcatttacaaattaattggtaccacgaagaaaggaaaaagaaactgaaaactgtgattaccaaagaatagtttaggaccaacatgctccccttttctttacatttgcttaggccttttatcgctgcctctttgaactgaggctgagattcacttttttgtttataagggcttacttgttactgagaacagagccaaaatgggcttgcagcatctgctcataactcattaaccagaacttggtcgtgtgaccaccaacacttagatgcaaaggagaatagaaaactagtctgagttctgtagccacgtacccagctaaaagctgcaatttgtatcactaaagtaaagctcaccttgcgctttcattgaacagctagcagtctctgccgtgcgatttacttcctcgcccctagacaaatggaggagagaattcctcctcttctgtgctttgaaagatcacaattgtcataatttttaagaggaaatttaaaatatacatttaaggaaggtttaatctttagttcttactaaaaattctgatctgactcaaactgattcaaaaagcaaggaaattcagtttcctatatgatggaagtgtcagggtggaacagatctcaggaattagttgacccactgacctgatgctttgggagccatttgggagccattccggcatcactgcgtgtcctgagcctggctcccatcttggggtcaagatggccacaccctttcagttctcacagacacacactgcaatttccagaggcagggtgaggccatctgctctgccgccatgttcttctcaggaatcggcggccttcccaaaggtgttctcagcacgcctctcatcctctctcgctgtagctgagtcacatccccatgtttcatccaagtagcggcaaggaaatgggattgcctcggttgacttggatagttcaggactggctcccttgcagagaaaagagagtcgcttcccttgaattatatgaggactggatggacactggacacccaatgagtaaaatcaaggcttgtctgaggtcaacagtaacaccaccaaaagcaacaaagaggaaatggatgttaggtcggcaaacactgtctgctacagttcataacgtagtttcgagagccttcaaaagtattaatgacaaactaacgtttggaatatggggaacactgtattttgcttctagtgatttggagaagtaggcaataatgtcgctcacctctactaaatgtatattgtaatgtgtacattaaatttaaaattgtacaaatgatttctcatcctcaaaagactaactcgttttcaggttaaaagtaaacatcattttatatatatatatacatatatatatatgtatatatatatatacacatatatatgtatatatatatacacacacacgtctataatgctatatataaaaaatatatctgtatgtgtgtatatatctataatgctatatatacatatataatacatattatatatgatacatagatatataatgtattatatatttatatagcatgtgtatatacatatatgctatatataggattatatatgtgtatacacatatatgtatatattatatatacatatacacatgtatgtacatattatatacatatacacatgtatgtacatattatatacatatacacatgtatgtacatattatatacatatacacatgtatgtatatattatatgcatatatacatatacacatgtatgtatatattatatagcattatatatagcattatatatgtgtatacacatatatgtatatataatacatatatacataatgctatatatgtatatataatacatatatgcataatgctatatatgtatatataatacatatatgcataatgctatatatgtatatataatacatatatgcataatgctatatatgtatatataatacatatatgcataatgctatatatgtatatataatacatatatgcataatgctatatatgtatatataatacatatatgcataatgctatatatgtatatataatacatatatgcataatgctatatatgtatatataatacatatatgcataatgctatatatgtatatataatccatatatgcataatgctatatatgtatatataatatatgcataatgctatatatgtatatataatatatgcataatgctatatatgtatatataatacatatatgcataatgctatatatgtatatataatacatatatgcataatgctatatatgtatatacacatatatgcacatagcatgcttataaatgctctatattgtatatacatataatactatatataatatataataatataataatatatacatgtatatacatatgtacatatagcatatataatgctatataagcatgctatatgtatatatgtatatacatgtatacgttataccatatactatataatatatagcatatataagcatgctatatgtatacataatgcatatataatatataatgctgtatgataattatatataatgtatataatatgtgatatatgatatataatatgtaacatgatgatgtaatacatataattttatgtattttattatatataatttatatatatgctatgtataggcacacacatatagtgtttgtgtgtgtatatatatgtagcatgaggttgtgagctagtcaaactttagtcatatcatttaatatctcaagtttacattgatgaaatatttataatgaaatcctttgctacccactaactctgagaggtttgagtacttataaaatcaggcttatttttttctcaaagttgagaaaagcattttttctccaagttagaaaagcattttttgttgtttattaataaaccaatcaaagctgatgtcttttggtttgagaaaaacaaataattttcttaagaaaagtgtgatgaaaattatagcatctttaatgactttgttctccatctcctagtattgttatctttgtatgtatcccttttgcctgggctgggaaaactgtactgtaggtcaggggttcccagcctccaggccacggacctatactggtccatggcttgttaggaacccggccacagcatcagaaggtgcccagtgggcaagcgaatgttcccacctgagctctgcctcctgtcagatgagtgcccgcattagattctcataggagcactaaccctactgtgaactgcacatgcaagggatctaggatgaacactcatgagaatctagtgcctgatgatctgaagtggaacaacttcatcccaaaacccacccccaagcccaacctgtccgtggaaaaattgtctcccaaaacactggccctggtgccagaaaggttggagatcgctgccataggtgatatctctcctagaaccatacacctctggttttaagagctaaaaacatacagacttattctgtaagtgtaaacattttactgtgtgttacctggccaattcttcacagctgatcattgtatatttttaaattctcttcatgtctcatcgttttattagcgtgtttcttcccattatgccattctgaaatccttttacaagttgtcctctggtccagtgatctggtgatacaaatgattgatagcaataaacatatcatttgcatctgcaacccaaatgtcctgtgtgttcctgtagaaattatgtagctaagacacgcacacgaaagctctgtaagtcaaagagtagcgtcgtgtttttccaaataaatttttctttaaaccttggagcctcattgaagcacaacttgaaatggtagaaaaacccagtggggcatgtcaccaaaagcagtttcctaccgcagcttccaagagaacttcattagtgttttcaacctgaatactaatcaatggcataaactctaaggaaattttaatatgaatatttttaaaggagcattttaatgtgaacgtagtgaaaatacaaaatcatatttaaataggaaagaaagggatatctctgggctcaatgagttttgaaagaggagaggtttgaagaataaatgagtttacagaaaataaacaaaaatatgaaacaaagaagaaaatagatacagagaagcaaaagtataaaaatagcaacatttaaaatttttatctatgctctttttgatacatccacagaaaatatgtttctctttctttttcttttcataaaatttatttttatttttaatttttttaaattacttttttgagacagatttctctctatcacccagaatggagtgcaatggcatgatcatggctcatggcagcctcagtttcctggctcagtcagtaatcccacctcagcctcctaagtagctgaaaacaggcatgcaccaccatatgtagctaatattttttaaattatttctgtggagacagggtctctctatgttgcccaggctggctcaaactcctgggctccagcgattctccaccccagcctcccaaatcgctggaattataagcatgaccacctagtctggccatacagaagatacataatcttagacccccttcctcatgtaacatgtagcactttctctaactatatcaaataatgtctgggaaacagcaattttaaatctttagtatggtataattattgtcaaagcaaaacaagatgaaacttcagaaaagtctagtacagagcttcaacgaattcaagttaagttttacacctgttactccctgatacttagaaaagttttatgcttgcctctattgtgcttagagagaatgttgtggtttgtaggaaaatagacactggtaagtgtaactgtatctgaaatttgcacacttcaccagtgtgtctggttattatctacatggtggaccttcagtgactggaggacctctctttccattcaagctgtctttttattaaccgttctctggggcctcaagttccctctgcagcatttatttccctttgagttaagtattgttcccattattgtcttagaaacgttaagtatcattagatacagtatctcattgtggattatgttatcagattctttgcaatgtgtctcttaacaaaaggatattgagtggcagagtggggagtggaaaatcactgaaaaaagaggacaccgaagagacacatgaattttctttgttctgttttttttaaccagtggtcatccctagcaaagatgtgtgtaagtgcattaaaaacatttgtgtgtagcgaaagtggtgaatttctctatgcaacatatttaaaagtcattgtttgtacctcacttgcatggctatttggccctataaatattggctcttgtctaatgacattttctatttcactttttaatagaatttgctgtaaaatggatactacagaaacagcattttattttcattcttggcaaaatcatttccacccaaagtgggggagctcctaacaatggttgcttctactttatttataagaaaaataatcaaggccgggcatggtggctcatgcctgtaatcccagcactttgggaggccaaggtaggtggatcatatgaggtcagagtttgaaaccagcctggacaacatggtgaaaccccatctctactaaaaaatacaaaaattagctgggcatggtggcgcacacctgtagtcccagctacttgggaggctgaggcaggagatccccttgaacccgggaggtagaggttgcagtaggccgagattgtgccactgcactccagcctaggcaacacagccagactccacctcaaaaacaaaaaaacaaaaaaaacagccatcaagcagacatggtcatcttttgcctgtagtgcaacagaactgtttaaaacacagtttaggccttaacgtggaaattcttgcttgcagcttccactaatcaatctcgctaacctcaggactctaactttcattttcctaattcacatttcaaaacctttctaaatttcaagagggaatgatttatcaaatcatctaactctttcaaattttggagaaataaatctcacttggatcactaaaaataaagaaaaggatcactatggaataatgaccctttaatagaaaaagaaaatatttctaacataaatattggagcttttctgtggtagctgtcaaatccaggagtttggaaattggaaaactagaaattagaaaagaacaaaaaatagatgttttaaagttgcaaagctccttttctaaccttaaattttgaggttacaatcagtttaaattttaaggtttaaagccagtttctaaatcttaaaactatattatttacaagacaattcaagtgacaaaatacatagtagtcagtcataaactaaatcagattctaaaatattatgtcatattatgaagcagtatgtaactaaagggctggtgattgagccctgaagggccgtgtcaggtcttctacttgttttcaaaatcaaggctgaagctgggtgcagttcccacctgtaattccaacactttggaaggccaaggcaggaaaatggcttgagcctacgagttcaagatcagcctgcaacatagagagaccccatctctacacaaaaatacaaaaattagctggacatggtggtgcctccctgtaatcctagctactcaggaggctgaggcaggaagattgcttgagccccggagttcaaggctgcagtgggctgtgatcataccacttcaatccagcctgggtgacagagcaagatgctgtctccaaataaataaatgaaagaagaaagaaagagaaagagagaaagagagacagagagatagagagagaaagagagaaagagaaagagaaagagaaagaaaagcaagactgcttctcccagcaatttgttaggatcctggctgtccgcccaagatgggttagatgaatggctgacaaggaatttgttttctaccactgtcacatgggagctacattaccccagctgttgcccctgcagagagaattatctgtatgttccgtgtatgcatcccaccttttcaacatcttgtagcagttccacttgagaagtttcaagtgatcggagtcctggccctcccacttcattgtctccataatccctagcattgcacttctctgtttgtcaatgtctataaatggtctctttgcaaggcttctcatgctatgtataaaacctttataaatagcatccactgcgactcacacagagccacttggaaaaacattcttgtcttgtttttctcacatatgtctaaaattttacactttttcctttatttttacttgatttagctaatttattcttaaccacagcattgtggtttagtaattgagacattttcttcattttgaactccagagtctcatcaactttagtcatgaaatacaaaaattggaaataagtctttgttataaatctaggccttgggtaggagttaactaagtttggtagtttgaaagttatagaaaccaaagtttacattgaatacatacagccaaccaggtgttatgacactgaattcctatattcaataaatattagttgttttctgggtggcaaattcataagctataaagaaattctggcttatattatgctgatgtggacagaattacagatgatggacttgaaggtgttcatataagcacccgtcctcactctgcaccaaaggtgtctcagggcctagtgagggggcagtgccagaagcctccaaaatacttgtttctctgaaatgttcttcagtacagaaagcagtggaagcagagtagactgaattatgtattttttcagctttcactttatgtctctacagtttgctctcttcctcactggggagaaaataaaccagctacctcagggaagtcagcacaaatacagaacagtaagggagggtcccatagtcaccaagcaagacgcccaatttgtcctaaatccattcatgcatgttatggtaaaaatatggccctgttctccttccaggcatgagtcaatgttgctaagtgggtggattagaatagtcattatttcaaatcaattagacaaatacttaatatgttgccactccagctactgtgaaccagatcttgatttagtaaagaagactgatatagaacatataagcgtgtgtgtgtgtgtgtgtgtgtgtgtgtgttacaattctctggtatttacaacaagggctgtactgttgtgctaggctaaatattagcaaaaagagagggaaatatgacatgttttacctgaatgggattaaatcttttattttacacttgctcaaggtcatacatttattcttactggtcccaggtaactgcagccatgaatatttttcttaatttattcagatacttttttaatgttctagaattaaaataatttaatcttcagaaatgtgtatctcttttagcattatcaagcaactaagaatataagtaataattataaattgttgtgttagattttacttctaacaccttccaattgtttattaaaacaattgatataattattctttgtaaaaattaacaatattgacaattatatgtggtttttaggatgtaatatttttgctgcaattggctaattttgatacttttcttacataaattttaagtgattgtccagtcacccgtgaaagcgtttcaatgtctgtggattttatgttttaaaattgcatttgaaatagtccaattcataatgtgctaaaataatcaagaaatgttctctaaaatcctgaattcttccatttaggatctaacttaaaattcaaaattaaaaataaatgaaaaattaagcttgggcaagtcaatcagaataagagatgcttaatttctgtagttgaagggagaaaattaaagtgatgtcagctttctcatgacccaagaagtatgtagttgaatcaatagcatcatgaacgccccatcggatgatcatggagtctcttagattcctcgtccccttccttctttccttaaacagacccagaaagtgaatcggtttcctcatgggcaaataaaccaagcctagatcctgatctctgggctcagagccaatgctcttctgtatcctgatgggatggtcatgatgctattgactcaactacgtatttcttcggtcatgagaaagctggcatcactttaattttctgaaaaatgctctgcctcagcatgctctttgtcgtgccaacccttggaatgaaggcatgtgctatgattctaagtttatattaaagaaactcaaccatatacttttttcttttttctttttttgagacaagagtctcgctctatcaccaggctggagtgcagtggcacgatctcggctcactgcaacctccgcctacggggttcaaaagattctcttgcctcagcttccctagtagctgggactacaggtgcgcaccaccacacccagctaatttttttttttttttcttgctctgttgcccaggctggagtgcagtggtgcgatctcggctcactgcaagctccgcctcccaggttgaagccattctcctgcctcagcgtcccgggtagctgggactacaggtcccctccatcatgcccggctattttttttgtatttttagtagagacggaatttcaccatgttagccaggatgatctcgatctcctgacctcgtgatccacctgtctgggcctcccaaagtgctgggattacaggcgtgagccaccgcgccaggccattttttgtatttttaatagagacggggtttcaccatgtcagtcaggatggtgtcgatctcctgacctcgtgatctgcccacctccacctcccaaagtgctgggactagaggcgtgagccaccactcctggccaaccattgtcattttaaggacttaaccaccctactataaatagcacttgtaacagcactatatctgtcatgccttgggaaatgcataaattgttaagattgacctaagctgtaaaaatgcaggaagttgaaacacagatgtgtaggcactgtatcaaatgtatcctgtttccaagttcagttcctttcccaatgaccccctcaaaaatgtttttctaaaattaactggatttgtgatatatctgtccttatattttctgaattcaaaataatttccttcttgaagctacagaattctgcaactttgcaataggtttctaatatttccaatatctcaggcctttattcaaaagaaaatgccagatcttttcaagagaaaccctgaatttatgttagaaagagaaattcaagctataaattgtacaaaataatatctaaaattcttatagtataagaagtcaacttcaagcttatttatagctttaaagtaatttagggtttagagagaagagagattaatgttcctattctagtagactcaataaaatatttgtttttatgttgcaatttttaagcagaatattttctacaaagtcaggaaaagtaggcaatcatcaaatagctttaaaaaattctgagcttcaccatagagggaatgtaaattgaaaaatgtgatttggattctgtgattctttaggaatctcagattctacatacctctgtactacaaaaactaaacttattgttgatatagtggttagtgaattttaataattaggtatataaaccacagtgtttagttgcagcaagcatgtcaggaatgagtgattggcctttgtatgttctacttgtaagttgcatgtactaaatggcacgtccatgctgtggaaggaaaaggggtatggccgggcgcggtggctcacgcctgtaatcccagcactttgggaggccgaggcaggcggatcacgacgtcaggagatcgagaccatcctggctaacacggtgaaaccctgtctctactaaaaatacaaatacatatatatatatatatatattagccgggcgtggtggcggatgcctgtagtcccagctactcaggaggctgaggcaggagaatggcgtgaactcgggaggcggagcttgcagtgagctgagatcgcaccactgcactccagcctgggcgaaagagcgagactccatctcaaaaaaaaaaaaaaaaaaagaaaaagaaaaggtgtacgtatgtcagatgatacaatgcagcattatacttatttttgaagagatttgctgtttgttaatcatttgcctcaagattaaattaaatatttattatattctgctgacatatatgtggtagtttgaaatggttctctactttcttgtgtaaaggtaaataaatgcaacgtaaacacaagcagtcttcattattgatagtaattatgtgctataaagttgccaggaacactgatttagcgaatactgaattatttctcctaggggaagtataggtttaggtttcagtgagcctctggtcactacagtttttgagaggacacaaacactcataccgtagcgttctgccccaaaaccccaaaattcacacaattctcacacacaaaatgcgtttattccatctcaatagccccaacagtcttaattcatttcaacatcaattttaaattctaactccaaagtctcatctaaataacatctaaatcagatgtgggtgagactcaaggtgtgattcatccagggcaaactgctctcctgctgtgaacttgtgaaatcaaacaagttgtgtacttcgaaaatacaatgtgggacacacatagaatagacattatcactttaaaaggaaaaaaaataggaaagaagaaaaaggtaacaggtcccaatttaaagtcccaagccccgaatatcctgccacctagatggttctctgcagtagccccacctccatggtggctctgtgcctgggtcaccagctcacggctctttcatgctagaatcacacactggtggcttctaccggttttgatggcggcaaaacttggggcagccgcaaccccatggcacctctatacattgccctagaagggactctgtggagatcttgcagagcaacagatctcttcctgagttctgcaacttcccagggcatcctcatttctgtctgagacctcatcggaatggcctttatcacccaaatttctatcaacattctgttcacggccacttaggtataccttaagaagattgaggttctttctacagctctcctcttttcttcttaagtcctcaccagaattacccttaaaggtccattcagaataatgtagccttttattattattattccttttttttttttttttcttttggagaaggagtcttgctgtcacccaggctggagtgcggtgccgcgatctcggctcactgcaagctccgcctcctgggttcacgccattctcctgcctcagcctcccgcgtagctgggactacaggcgtccgccaccacgcctggctattttttttttttgtatttttagtagagacggggtttcactgtgttagccagtatgatctctatctcctgacctcgtgatccgcctgtctcggcctccgaaagtgctgggattattattattatttttttaaagcatgaactttgtaagccttccagcctctgcccatggccatgctccaaaaatgttcctacgtttttagtatttgctgcagcaggactctacttgagtagcaattttctgtcttagtctgtttggcctgctataacagaataatataaactagatagcttataaataacagaaatctaattttgcaagttctaatgtctgagaagtccaaaatctaggtaccaagagatttggtatctgatgagggtccactttctggttcttagatgatgccttcttgctgtgtgcaagggcaacgcatctttctggggcaactttattttttttgtttttgtttttagagacagagtcttgctctgtcacccaggctggagtgcaatggcgcagtctcggctcactgcaaccttcgtctaccgggttcaagcgattctcctgcctgagcctcccgagtagctgggactataggcatgcaccaccacgcctggctaatttttttttttttttttttttgtattttcagtacagatggggtttcaccatgttggtcaggctggtctcgaactctttacctgaaatgatcctcccacctcggcctcccaaagtgctgggatttcaggcgtgagccaccgcacccagcctctggggcagcttttatgagagaactaatttcattcatgaggacttcaccatcataacctaatcacatctaaaggccccaactcctaacactgtaacattaagaataaggttttaacataggaattttgggaggacacaaacattcagaacatagcagttaataaaatatttgtaaaatttatatatgtatatatatatattttctttttagtaagttctatttcaaatctcagtgaataagtttcagatgtatgttgtttcattgtctttcattgtttttcttgcttctttctttttttcttttgaatctgacatcactacaatattgatttttgtttctaccttcattttataatcatataccttaccaagctacagaaacgaggcagaaaaacaatttccattttatttcagtacatcttcctaaaactggatcctggtttgcttagttgttattaacaacacttgatgagctattattaattaaataattatcttttatctcaaatgtggaggttcttgttcctatgaagcccacccttccctttagcagcagcaacaacaaaacgacaggcagcttctcccttcatatgggtcctgacagatgagccttttggacccctcgtaaaagtagtaaatgcacctttttcttttatttacattaacatttgttttttcttaaccatgctctctctattgatttagcattaatcatgttgtttcctacagaatttaccttttgaaaaataaaaacacaggcagatacatactggttattcacaggaaaattagggtgtaattattagcagactaattgtttcagatttactatgatccatgaagtcttgtatttgacagcttaaagaactatgtggccaagaagacataaatgtgggccagtagctagcagcctctgcataatacaactccaaatcaactggtgaacatttaaattggagtaatttaattaaaaatttgaatttctgggcttccttgaaaatgtattgtttgaataacaccagcattcctgcatatcataagttacctccatgtgaatagggacagccccttttatccacaacatatcccaaacactgcatgaatcctctgccatcatggctgagcttttaatctcttcattagaatctctttttggttgattttctaatcagggaaatatgtctctcttggtcatattgctatcaaaagtaagaaagtaaaagatcaatagaacgacatgatatttataaccagccagcatcacacatttgtataaactgcttgtcttctctgagcattgaagttgtgacttctaattttagaagctacaaatcattttatctctgtcaggactggttctcgccacaagttgtgtaagtactgctcatttatgaaaataaattaattcaacctcttcttcatggccccagtgagtgtgcaggtgtcatgaagtaatggacagcacccaagttcacagtgaatcagattccctccaatgcccaaatcactgaggtgtgttcacgagcagaccacagagtactgtttttagtgttttaccagacaggacctaactgctctagcaaagaggaaagagaacattatctcacaacatgtgtaccttttgagctttactaagcctattttatggttgaggtaaaattttcacccaaaggtatgtgaaatcaaaccaaaattacagaattgttgtaatatattgcaccatatgcataacctcaaaagatactgcacacatatgtcccaatctctcacaaataagagaaaatcatttgtaccaactaatttagctttcaggaaagcacagaaagtaaaataaataaaaatgacattttttcctaatcacctattacatattgctactcgtcctgacaaatttgtaggggttgttgatggatgtatagcgttcagaacattaatgattttacaagtttaaagtaatggtgtttgttcatgtacatatgtgtggatgaatagttgtatggatggatggatgatgtattagttggttttcatgctgctgataaagatgtacccaacactgggcactttacaaaagaaagaggtttaatggacttacaattcctcatggctagggaggcctcaccatcatggcggaaggtggaggggaccttgaacatggcggcagcaagagaaagaatgagagccaagagaaacgggtttccctttatcaaaccatcagacgttgtgagacttattcactcccactagaacagtatgagggaaacggtccctatgattcagttatctcccaccagatccctcccacaacacgtgggaattatgggagtacaattcaagatgagatttgggtggagaaacagagacaaagcatatcagatgaatttgaaaaggatagcgcatagaaattttggatagctaaagaagtaacaaactaagattctgtgtaaaaattaagatggtgggaaaatgaattcgaatatgtagcgtgtttcaaagaggaatttttgacattttgtttttgttttcagggtactgtcaatttcattttaaattctgaggctttgtaatattggatttatcatacacctggagtcagccacaactgtaaattttgatctgaaattcttcagttagtataaaatccctaactgctttgaaattctgtgtagtgataatgcatcatctgaatgctttgcatcctttaatgacataggtatcttctgaattctggctttgcgtaactgttgccaacactgtaagaacatcagctcgtttgaggctgggtctttgttctctctgtttctgggccctttccacgccctttctcctctccctcactagcacaggagttatctttccaatgcaaacctggacatgcattttccacttagaataccatcattacacacatgggccctcagcttcctcagggagcattaagtctttaatcttccaattctcaccctgcacatgaattgtaagccttatgtagtaaagtcacaaacaactgagcgtttttagaacagtcgaatgtgctattcccctatctgtctgaatttatcttactcagtcttaattctcttttcactggaaagttcctgtattgttttttgtttgttttttaactcaccccattacttccacaaccccagtcttgacacaatgttatggatgtagaagatacttcagagtccagaagttgatcttagacatttaataatggtttctaaaatttgctttaaaggagctttttgcaggtctatggactaacttttgccaacaattcctaggcttttgtttgatcaaaactgatttttcacttcttttctaagatatggtaaaataattttctgtactgagtgttttctaatatagtttattagtagaaaatttgagacacagtaaggccaacatatcagaaaacacctaccgtgaaaagatactaatattttattactttattaatactttatattattgatacgatatttataaccagccagcatcacacatttgtataaactgcttgtcttctctgagcattgaagttattttattttatataaatacaattattactttattaaaatacatgacatttatttactttattacttttattactgtggcaggccatcccacagggtgtagaccagaggtagggagctcagggaagcaccaggatctgtcaggaggtagaggggatgagggaactgtgggcaaggtcctttattgtagtttccatgggaagggataggtgcagcagggtaagcaggcttaggtctggctaactggaataattattccagtgagttctggggcacagaggctgatcctagttgtcttgtacctgattctgggatgaatagggaagacggatcatggtccagaagagagaaagctggataaaggaagcagttggggtgtggactctggattgattgctttatatttggaaagtgtgcttaccatctctagaaattggctaactctgggaagaccagtccctctagggtcagcaaggccccagatgtcaaagcattggagcacagagattaaaatacatggtcaggatagaggggaagttgaagccatggcagctccaagaaatgacacaggtggctgccattacccctgctcccaccctccacagctaccagcctccgtttactcatagggataattgattttttcctcaatattatataaattactatgaaaagagtgcctaaaaacaagttgcttatcactatttgtaactaaactgctatctttatatagtatcaaaatttggacagaacactgacaatgatattttaaatggaattagaaggtgaactgaatagagattttaaaaattccgaaataaatgttgggaataatttaaatcaaaagacattctgaggagtttcttgatgtctggtttctttcctcatctgtgtagcatttacttaggatttataattctagatagtcttttcgccagcaaaaaaactagattttgtgtggtcaaaagttgtagagctattttcagtaaacagcgaaggcgagaaggcgagtctaatttatttgactttttgatttacaaaaataaataaaaacagcttccacatggatttcctacaaatagattatatgctaattttcagaaattgttattatttctgcattattggatatatgagagttataaccctgcttagaaatagatcactctgattttctgatatcttgtgggtaatgagtggatgagagcgaggacagaatataggtgtgtgcatgtgtttgtgtgtatgtgtatggggggtgtatgtgtgtgtgaatgtccattttgggaggcatagggtacctcagtgggcttttttgtctcttcacgttgaataatgtgatatctaatgctataactttaaaaagttactaatattttcctgtgtctgttttttgtgattcattgggccaaccagatgattagccatttatggtttatcatatatacattttttatggagtaagtcaaaaattaaaatatgtaggagtcaattgatcttgcctctgaaaatcaataaccatttcagattagcatacaatgactgctctaaaaggtgtttaaaacttagtgactttaatcttggaatatgcaagttcctcattaatgcatttaattcaaaggaaattatatattctttatttaaactcatacaggagttcaatgttttggcctttgacttataaacaaataactccagtgtaagtataataaaagcatgttatgtttaaaccatttattcatatcagacactcatagttgtaagagttgtgtagccttaaatcatgtataaatctgtactcttagaaagtaaactgcacggtcacaggcatagtttagaggggaaataataacacagtggaattctccttttgccttgtttcaaacctaaatgatgtttcaatcagtttagaaagtgtttatgctgccaggaatccaaaacggaacaatccaaagcctgtatcctagaagagcttcaagtccacaggaaaaatcacgcccaaaagaagataacttcaatataatgtgagaagtaaaatgataaaagtatgcaaggaactaggggacaatagaccaaggctgtttcacacaggcaggctttctagtggtgaggcttatctgaggcttagaagatgcctaaaagtaaactagaacaagaaaaatggctgctcactgaagaaagtgagcatagcccgaggaaaggtgctatgtgaagtttgcgaggaattcaatccgtttaccatcaggagcacataaaaagaaagatggcactaaaaatgagcctggacgggaaggcaggagctatatcattgagggtggtataggccacactgaagaacctggcttttgatcttttttggaaagagtttatttcaaaaaggtctttccagcttctgtgtgatggttttaagacgggagagttccctggaccccttcacgggacttgcaacaagggtgtggctccatttctcgctcaagccccttttgggaggaggagcatgcaggtgagctggagcgagcgcttttgggccctggctccacggcagtgtctaggggtgttgcagtgctcttttagctttgccatctgtggatggttaagtgttaaccagttcagtggagagtcagggtgacagccttttataccctgtcctcttgatacgcaggtccttgtctggcattcagaaagaatcaggtcacatggacttgaaggatggtgaatgcagggattttactgagtgatggaggtggctctcagcgggatggatggggagctggaaaggagatggagtgggaagatgatcttcccctggagttcaaccaccccacggccattctcctatctgactgtccccagccaaacccctcttgatgtacagacgcttcctctcttctctccttctctgctgtgccgctcttctgttctactgctcgtctgttcatggagcctggggtttggatttatgagtataggatggggagcacggcaggccagggtggttttgaaagaagcaacaattgggcaggaaaacaggataactgttctcatttagcaccacggtttgcgggcttgagggcggagcctttgccggggaaccaccctcttgtctcctgttcatatcagttggatttaagagaaataagaccaaaggatgagaattggtcatttaacaatgttaatacaataggcaacatgtgaggtaatggtaggctcatgatagtacatataaaagtaaactatgagttttaaaaatatcaaagtgaaatatcaaattgaaatatcaaatttcaattaacaatcattgcacctcaaatgaactcattggctatatgatactgccactgcacaaagctctatatttcacaggtcttggaagtcgctaaatgtaggtaggcaaaaagaaaaaaaaaaaaaaagaagctcaagaaagttccagatctctggcttgagtgactggataatggatataataaaagtagtggggcccagagaaagaattatatgttgagcaggtagagtgagatgtgcctgtggaatatccatgtggatcagccttccaagttactggattggaatctaaatggtatgcagaaatgaaatcagagtcctttgatattgttgtcactgtcctagggaatatcaagcactgaaggggaaagcaacatattttaagcagaaatattgcacaaactgtgagatgctggccttcaggaaagaagagccttgaggttttttgttttgttccattttccccaaagtagaagtgattttcagattctatctctagatcatttttaaaggatctggagaaggctcatttgctactattactctaaattagctataatgacattttgaaattattttatctgtttaggtttatatcatagatacattgaaaaaaagaaaggcagtgggttaggaggaagaaagtattcagataaaagcaatgtgtagatggaatgagattgagtccaccagagttgtgtctgttctaggactgagtcaatttaaaataatggaatacattcttgcccaccaccacagctccccaaaagtaacctaatgttaccagtcttttcatctgactattgaaacctcaagtatatttgtagttgtagcaccaagatgggtcagcgagattcttgaaatttcttccaatctagtgactctaattttttaatgaagtatgaaataatagtgtttattataccttaatccaattaatagaaatatgagtgacaacattcacacattctacaaatatttaataaatattcactgtttttcaggcactgttttaagtgctgggctttagaatggaacaaaactaagtctcagaggagatatgctgtaaatatacaaacatcaatgtatcaggtagagataaattccataaaaatgaataaagctgcgtgaatagagaggaggtaaagttggcagtcacactttttataaagaatgatcaatgtatctaaaatattgacatctgacaatgaaaataatacacagatttgcatgtgtgtgaaacttgcaaaataagcaaattctatcttctagtatttttaaacttcagtttcagaaatgaaatgtatttcaaactcttgaagtgacttggtatttatttgcataaactatatagtattcgattctgtactaactggttaatatacatttttactatttttttagattcatatgctttatatgtatttgagaaatatatatgcttttacaaaatttaaagttccaaatttactagtttttaattagtttattttttataaaagaagtctttaattttgtttccttttttctctaaaaatctatataattttttacctttattgaattattatataattgaaaaataaaaattgtatatatttgagatatatgattccacaactctgtgatattctccccaaatatcaataatgcagtctagtcctaagaaaacgtcagacaaatccaaactgagaaagattctacaaagcacctggctggtgctcttctagagggtcaaggttatgaaagacaaggaaagaattggaaactgttgcagattagaagtgactagggaggcatcataactaaatgcaatctgagatcctggattgaatcctagaacagcaacaaaaaagtattagtgaaaccctggtgaagtccaagtataatctgtatttgagtgaatgccacttaagttagtattttcattttgacaaatgtgccaggttatataaaatgttaatattagaggaagctgggtgaaacatatgagaattctatctttccaactaccttttcagcttttctctaaatctaaaatttttccaaaataaaaagtttgtgaaaataaaaacaaaacttccaccacaatttttattgaagaagttggacatttaactaatggtacatttttagctaatcaaaatcctgttttagaaaacaaaattatgaaataaggtttaaaaaatgtacagtaacaaaaatcaaacacaaactatatacagtattatccatatgtgtatctatgtacatacgtaaagattctttatatgcaatttaaaataatcacaaatagtatattatcattggttatttcagtaaaaaatgaaataatgccttttaaattttttttctttaaacctttttgtttctttcggatcccctataaaagtaactgaaaacatttgatggggaaacggtattaaaagtaactcttgaatatttatttgttgatatgctatatttacatactttttaattttttcaaataagtagactacagtttcaaattatatattcttttataagtgtcttttattaagattaataaaaaattttaattaaaccatgcaatttccctgtactataaatattatatcaccccaaactcaaattattagtgtacattttggaccatgactaactgaaatgaaattctccctctctctctcccactgtctttattcttctcccttcctccctcatatatatatatatatatatatatatatatatatatatatatatgaattattccataccttatatagttggatagatatttaggtaaatatgtaaaatgtaggatatgcaccagttaagtacccattaacactggtgatttttcgtggttgggattcactctctactttctatatttctgtattgcttaatttcttttgatcaatagacatagtttgtaataaaatatatagcaaagatatcttttaaaattaaaatatcaaataaacttaaaattttaatattaaaatgtttatatggtaaacacttcttcaaattatcttattcaaagttagaaagtgaagactaaggaacaataaaatgtttttgaaaaagcgttttctaccatgatgatttgatgaattgggcatattaccagcttgctgagcttttgttaggaacaaaattgtggaaacactatgattttgcattcattttttgactagccattattgttcagattgcttaaacagttcaaccatacatatttaatcaccgcatcgaaaacttaattctagggagtgataagcaatcaggataatagaagaaaaaagtggcttgtccccaaataagcacagcgcattattagatatcaaatgaaattttaatctatttttgtaggaaacagagccaaactgtgatggatgttctttacattgttgtagaatatcccagactttttaaagagtacatggtatgtgttaaagtgtaaatatcatagattacttctagaaattttataattttcaagccagctctgagcttacatccacaagaggatgtgctgatattttggaagcatttaacccattcatagaataacaacttttaaattttgttttagatagatggatagataggtgggaaaatatgttgaaactttttctttttctttgtagggaatctaggttacagagaattttgtttcccagctgaccctgacaacttaccatttgtaaagtgagacttggtctacatgaatagctgtccttcctgtttttattaatatcttaggattgtctgaaaaaaataagccatcttcatcttttctgtcacattttctcattgctctaaaagtaagacaggaatgcattaacatttgcgtaaatcattactctgtacctagaactaaatgtgttttgatttagaagaaagtatagaggaggtgattcttgttccctgagtaaaagctcagggaacgtttacttcctgaaagatgaattagaaatattttatgtcaattaaaatatgctaaaggtgtataaaacaagatgtgtctattatttaactgtcactgataggaaattgactgcaaaactactgtctagagttcagaatttactgtcatctgtttttcttttattcacttttcaagataaaaagtatcatcaactgctggattatacgttctcctttatttctcattgcacatgaaaaagatattgccattgaaattcagctgtgacagtatataggattaagctgaagtttaattggctttgcagtgttagcagaagccaaaattaaacgattgattttttccctcatattaaaataaacctctgtgattcacagtctcagagaacagaattctgttgattaagaaagtctttttatgggcaataaagagctgattataagaattaaaatttaaagtttaaggtcatattttttctgaatgttttataatataacattgtacaaacttatttaaaagcataaatatttgagatactagcatagatattttcaaagtatgtgaaagccatcaatgatttgaaaggcatgcttagatttcattttattcgaagtaactgtatgcacaacaattcactttatagaattaagtaaactcaacacaaaaaaggagtggatgtggttctggcagccctgcatctctactgtggcccccaaaggaatttatttggtggtatgctccacttacaaggcaaaccaaagtgttcctcgtggtgattggagtaaacaagtgccagagaactaggacatgaaatgagaaaatatttctctgacaggctttaaactggctattatttttctccaatgtctccctctggagttctttagccagaccttacccaaaacctagaggctagctttgtccagacttgtaattctaaagttattagagctgttccgtttgactaggctttctatgatttaaaaatgaaaagcttacagaaatagtctattgaaaagatttttaacagtgaagatttgatcatggtaacgaagcttctatttgaactcaatatttgatttgaatggttacattgcattttgaatcattctatgaatcgagaatgcattgaccaatagtgcctaataaataatatcatctcatttttatttctggtgtgaaataaatagtagttatcaaatgaatcctcacagtcacatatttctgatcatatttcccattttttaaaaagtttacatactttccttattttaatctattcccctgaaactaaaattagagctgctgtagtcatacgctggatatttgttctttaaactcatatatggataagtgaagatatctgtgtccaatgtagtgaaaaaacaaacaatggtgcccaattctccattccaaatgcaaggaggtaataagaaatttgagacacactgcttcctaagaataaatggtaagaagtttctgaaaattcgattggttgtaaactctgaatactacaacaaggtttactaaaattgtggtgaaatataaaaaccatttaaaaaaaagagaatagcataaaagattacattccaagtgccttcattcttacatcaaagaaaacaactttttgaataaaatatatacttaaaatcatgaagaattatcattaaggaatcaaacatttaagtctcataatctgtttgagatttaaaaattttacgattttggtctaaactctagatttctaagttaagatttgaagcatataacccattgaatttatattactaattttgtaattaaagtaaaatgttcaactgatagagcttttatgagcatttttatcaatactctccataaaacctcctttaaaacaaacacagtaaatcaaaagaaggaatagaagaaaaacagaggactgtcaatttctcaagaaaaacacttacttaattctcatttattctttgcagacacctgttggaagtggatggtaacatacatggctgaactaatatgttatttttttttttgttttaggggctgatgttatcaactttgatggccatgttgtattaccatatagattcagaaacaagaagatgaaaacactgaaagatgtcattgccttgaactttaagacgtctgaaagtgaaggagtaatcctgcacggagaaggacagcaaggagattacattaccttggaactgaaaaaagccaagctggtcctcagtttaaacttaggtgtgttctgactgtcagttctattctttccgttatggatgttcccattaggaatatgttcatgttgctcaattctttaaaatgtaaattataaaaagagctcatgttatatttcaattcatacttaatctataacagtaggtatataatgaaacacctagtcattcaaaaaatatttattaaacacctctactatacaagttactatactagtctttggcctacagcaaggaacaaatagacaagatccttaagctcattaagttcatgacctaacggaggaatcagaccatatagcatttattattcttattttaaaacaactaagcaaaaatgaatgtcttcaaataatatatattatgaaccagttgaacagattaatatgataaagggactaggttaatacgtcctgttcaaaggcaacagggctaatattagaatgtgtggtgaagaaagactgctctggggagaaaatatttaagatgagatcagagtgatgaaaaggaattagccatgaaaacatgagagaaagaagattacataggaagagaacatggaagaccaaaagcacgctcaagaagcaggaaggatgccgccgtgcataaatgctgtgagttattaagacaaaagatgaagtccaagaggtggaaattgcccaaatcctgtgggatcctgcagggcattacaaattgtttagatattatttttaagaataggaagctgttggaagtcattaaactgtatggctttatcatcttattttttatcaagcgcattgagacttctgtaagaagaattacttgtgtagatatgagagtcgcagcagaacttctgcatagtttgggtgagagatagtactgcttgtatgaggtggttatcaggggagatgcagagaaatatgtcaattaaggaaataattttagtggtacattcagcatgacttatgatgggttggatatagcctaagaagaaaagagtagaaataaagaatgagccctaggatttgggcttgagcaccaaatggacattagtgccattttcagaaatagagaagactttaggaggaattctagagatcagtttggacatggttaatttgagctgcttatgaaacatctaagtagaactttcgattatggaagttgatatatgagactgagagaggaagactaaaatggagactaagtaattgtgaatattgagtaggagaaaatgaagaaagtgtagtatcacagaaatcaaggaaacaaaagaggttgtcaactgttgaattcatctaaatgtcatgtaagatgaagacagagaggcaaatattgggcttaacaacatggaggttactgttaatttctactctgtggaatagaaaagacaaattttgtaggtaaaaaagagaatgaaaggcgttaagtaaatattttgactaactagagaggaagaacagttagttaactgttaactagaaagaaagaacatagagaaatgaaatgttggctgctgaaagatctgaactcaaattactgttttatgtggggttgttgttatttgtatttatttatttatttatttatttatttatttatttacttatttttgagtcagagtctcaccctgtcacccaggctggagtgcagtggcatgatctctgctcactgccacctctgcctcccaggcttaagtgatgctcctgcctcagcctcccgagtagctgggattacaggcacctaccaccatgcccggttaatttttgtatttttagtagagatggggtttcaccatgttggccaggttgttttcaaactcctgacctcaaatgatccacctgccttggccttccaaagtgctgggattacaagccaccgtgcctggccctgttgttgtttttaaatggacaagaccaatgtatgtttgtatgttgatgatgtagctaggatttacttaaagctaaagtgaagatctgcaagattggtactggcattcaaaattacagtttaggcaaagtaatggtacctttttcttttttttttttaaatttaagttcatgaatgcatgggcaggatgtacaactttgttacataggtaaacgtgtgccgtgacggttgtctgcacagatcatcccatcacctaagtattaaggctggcatccattagctattattcttgatgctttccttcctcaccacctaaacctccgacagaccccatgtgtgttgttcctctctatgtgtccatatgttctcatcattcagttctcacttataagtgagaacatgtggtatttggctttctgttcctgcattagtttgctgaggacaatagcctccagctccatccatgtgcccgcaaaggacaggatctcattcctttttatggctgcgtagtattccatggtgtatatgtaccacattttctttacccagtctatcattgatgggcatttaggttgatttcatgtctttgctattgtgaatagtgctgcaatgaacatatgtatgcatgtatctttataatagaataaattatattcctttgggtttatatccagtaatgggattgctgggtcaaatggtatttctgcctctaggtctttgaggaatcttcacgctgtcttccacaatgattgaactaatttcccctcccaccaacagcataaaagctttcctttttctctgcagcatcaccagcatctgttgttttttgactttttaataatagtcattttgactggtgtgagatggtatctcattgcagttttgatttgcatttctctaatgatcagtgatgtagagattttttttcatgtttgttggccacatgtatatcttcttttgagaattgtctgttcatgtcctttgcccacatttttatgaggttgtttttgtcttgtaaatttaagttccttgcagaagctagatattagacctttgtcagatggatagattgcaaaatttgtttctcattctgtaggttgtctgttcactctgatgacagtttcttttactgtgcagaagcacttcagtttaattatatcccatctgtcaatttttgcttttgttgcaattgcttttggcatctccatcatgaaatctttgcctgtgcccatgtcctgaatggaattgcctatatagtcttctaaggtttttagagttttgggttttaaattaaagtctttaattcattttgaattgatttttttgtacagtgtaaggaaggggtccagtttcaattttctgcatatgactagccagttcttccagcaccatttattcaatgaggaatccttttcccattgcttgtttttgtcaggtttgttgaagatcaggtggttataggtgtatggtcttatttctgagttctatactgtgtcccattggtctatgtgtctgttcatatcagtaccatgctgttttggttacagtagccttgcagtagagtttgaagttgggtagtgtgatgcctccagctttgttcttttttcttaggattgtgttggccattggactcttttttggttccatgtgaatttttaaatagtttttttaaattctctgaagaatggtcaatggtagtttaatgggaatagtattgaatctatgtattgctttgggcaatatggccattttcatgatgttgattattcctattctccctatccatgagcatggaatgtttttccatttatttgtgtcatctctgatttctttgagcagaggtttgtagttcttcttaataaggtccttcacttcccttgttagctatatcttaggtattttatattatttttggcaattgtgaatgagagttcattcataatttgactctctgattgcttattgttggcttataggaatgcttgtgatttttatacattgattttgtatcctgagactttgctgaagttgcttatcggcttaagaatcttttgggctgagatgatgaggtttcctagttacaggatcatgacatctgcaaagataatttgacttcctttcttcctatttgaataccctttgtttctttctcttgtctgattgccctggccaggatagccaatactgtgttgaatagtcacggtgagagaaggcatccttgtcttgtgacagttttctgtggaatgcttccagcttttccccattcagtatgatattggctgtgggtttgtcatagatggctcttactattttgaggtatgttccttcaaaacctagttaactgagagtttttaatataaagggatgttgaattttattcaagaacttttctgcatctactgagataatcatgtggtttttgtctttagatctctttgtgtgattaatcacatttattgatatgtgtatgttgaaccaaccctacatctcagggatgaggcctacatgattacagtgaatacccattttgatgtgctgctggattcagtttgccataactttgttaagcatttttgcatagatgttcatcaaaaatatttgcccgaagttttgttgttgttgttgttgttgttgttgttgtatatccaccaggttttggtaccaggatgatgctggcctcatagagtgtgctagagaggagtccttccttttcaggtttttggaatagtttgaataggcatgttatcagctcttctttggacctctggtagaatgcagctgtgagtctgtctcgtcctgggctttttctggttggtaggctatttattactgcctcaatttcagaagtcattattggtctggcttagggaatcaatttctttctggttcagtcttgggagggtgcatgtgtccagaaattttccatttcttctagattttctagtttatgtgcatagaggtgttcatagcattctctgatggtacagagaatactataaaaataatagagaaatacaaacatatttctatagggaaatacaaatgtatttctgtgaggtcagtggtgatgccccccttacgatttctggttgtgtttatttgaatcgtctctcttttcttctttattattctagctaatggactattttattaattatttcaaaaaaccagtgtattaaattctcacactggtataaagaactgcccaagactgagtgatttattaaaaaaaaaaaagaggtttacttgacttacagtttcacatggctggagaggcctcaggaaacttacaatcagggccgaaagggaagcaaacacatccttcttcacatggcggcaggagagagaagtgcagagtgaagtcggggaaagccctttataaaaacaccagatgtcatgagaactcaatcactatgatgagaacagcaaggggaaccacccccatgacgtccctcccccaacacatggggattataatttggattacaattcaagatacgatttgggtgggaacacagagccagatcatatcaaccagctccaggatttattgattttttgaaggatttttttgtgtgtgcctctctattccacttcagtttagctctgatcttggttatttcttgtcttctactagctttggggtttgtttgctcttggttctctaattcttttagttgtgatgctaggttgctaacttgaggtacttctagctgtttgatgtgggcatttagggccacaaatttccctcttaacactgctttaactgcatcccagagattctggtactttgtatctttgttctcattagtttcaaagaaattcttgatttctgccttaatttcattatttacccaagagtcactaaggagcaggttgttcactttccatgtagttgtgtcgttttgagagaatttcttaatcataagttctaatttgattgtgctgtggtctgagagactgttatgatttcagtcctttttcatttgctgttgagtgttttactttcaattatgtcatcaattttagagtaagtgctgtgtagtgatgagaagtatgcatattctgttgtcttgggatggagaattctgtatatatctatcaggtctacttgatccaaagctgagttcaagtcctggatgtctttgttaattttctgcctcgatgatctgtctaatattgtcagtggggtattaaagtctcccactattattgtgtaggaatctaagtctctttgaagatctctaagaacttgctttatgaatctgggtgctcctgtactgggtgcatatatatttatgatagttaactcttcttgttgaatttagccttttaccattaggtaatgcccttctttgtgttttttgatctttggtgggttaaagtctgttttgtcagaaactacaattgcaacccctgcttttttctgttttccatttgcttggtacatttttctccatcctttattttgagcttatgtgtgtgtttgcatgtgagatgggtctcttgaagacagcataccattgggtcttggctctttatccagcttgccagtctgtgtcttttaactggggcatttaacccatttacatttaaggttagtattgttatgtgtggatttgatcctgtcatcatgctgctagctggttagtttgcaggcttgtttatgtgattgcttcatagtgtcactggtctgtgtatttcgatgtgtttctgtagtggctggtaatggtttttccttttcatatttagtgctttcttcaggagctcttgcaaggcaggactggtggtaataaattctctcagcatttgcttgtctgaaaaggatcttatttctccttcacttatgaagcttagtttgactggatgtgaagttctgggttggaaattcttttctttaagaatattgattattggcccccaatctcttctagcttgtagagtttctgctgagagggctgcttttagtcagatgggcttcccttagtgggtgacctggcctttcagcctttctctctggctgcctttaacattttttctttaatttcaacctcagagaatctgatgattatgtgtcttggggatgatcatcttgtggagtatcttactgaggttctctgcatttcctgaatttgaatgttggccttcttcctaggttggggaagttctcctggatcatatcctgaagtatgttttccaacttgattccattctcccggtctctcccaggtacaccaatcagttgaaggtttagtttctttacataattccatatttctcagaggttttgttaattccttttcattcttttttctctattcttgtctgcctgtcttatttcagaaagttaggcttcaagctctgagatttcttcctctgcttggtctgcctgctattaatacttgtgattgcattgtagtagtgtgtttttcagctctaacatgtcaattatattcctctctaacctgggtgttctggctatcagatcccatattgtattaccatgattcttagcttctctgcatggggtacaacatgctcctttacttcagtgaagtttgttattacccaccttctgcagcctacttctgtcatttcagccatctcagccttagcccagttctgagcgcttgctggagaggtgttgcaatcatttggaggaaaaggggcactcggctttttgatttttcagaattttttgcattgattgcttctcatctttggtgtcttatctaccttcaatgtttgaagttgctgatttggagatggagttttgtggggtttgttgttgttgttgttttgtgtttgtttttcttttaatagccctgtagaagtctggccactcatccatagggctattgtggtttgctgggagtccactcgagacactagttgcctctgtttttcctgtacctggaagtataatatcagcaatgaagcctgcaggacagcaaagttggcagcctgctgcttcctctggaagttccatgctagggataactgacctattgctggcccaagtgtgcctggaggaagtggttggagactactgttgggaggtctcattcagtcaggaggaatgaggtcagggattgacttaaaaaagcagtctggctgctttttgatagagccactgtgctgtgttggagatttcttcagcccctaatcggtttgggctctccaaggcccacaggctggactagctgagaagcctgaatgtccaagttggtgacctgccccacccttcaggcactttgtcccgtggagaacacaggcaggggtggccagaggccccagctgggacaacctgccctgggaagaagaatggatggggggatggggcagttaaagaaacagtctggtcacaccttgacaaaacagctatgttgtggtgaggaactgcctctgcccccatcagcttggactctccaaagcccacaggctgtggaatgactgaattgtccaaacaacccaggtggtgaccctcccctcccttggtcactccatcccagggatagaaaatagctctgtcatgcaggcaggtgtggttggagggccccagctgggaggtcccacccagtaggaagaatggatcagggctctgcttaaagaagcagtctggccatgatctggcaaagccactgtgttacgctgctggggaaaccttcctccttgtctggactctttggactctccaaagcccacaggctgcaaaggcccagtcgaccaaatagcagagatggtgtctgtacctctcctcgaggctccatctggtctcaagaaggctttgtcctgatgacagtggctggctgaaattccaagccagtgggtcttttcttgtagggtgccatggaaatggggcccacagaacaatgccattcggctccctggattctgcccccttcctaggagtatgtgcagacctcccgccttgcctgagttgcagacacctttgttggaaatcccagggtggagtttgtaaagctccaccctgtctctgtgcatgattgagcagttgttctgccaagactccacacagctctgtgtgtcagacccaaggctctggtgtcatgggctcacaagatctcctaatctgtgagttgcagaaatccatgggagaagcatggtttcttggggtcacatagtcactcactgcttcccttggcaggggttgggggttcccttggctccacgtcgctcctgggtaggctgtagccccatcctgctttccttcattctccttgtgtgaagttgtttccctaatccgtctccatgtgagaacctgaatatttcatttgaaaaggctgtatttactgatcccttccattcctctccttgagcactgcagacttcagctgcttctcatcagccatcttggcccctgtctcacctgtttctcttgattggctaaaaattctaggctatttgatttatttggcaattaccaatttgagtggtccaaacattcctgaatatgacttgtatctcatatattaacttttattactttgaaattcagtattatactaaaaattgcaacttcacttaggctatttttgtaggtaatgatacattaccttaaagatgtacccttgattataaaacttttcacattaaagatctgatctgatagacacaatagcttctataacaaagaagaaaagtcacacaaaattcgccatcacttagttacataaaatattattttttacattaaaataaaagtaacattaaaatgcatgcaaaacctgggaaatacaaatgtcaaatatactggtttaatataaatcatgaataagaaattataccactgcataataataccaagacattaggagaaaatataggcaaatgatatacaagataactcataaaagaaaaaaatattatataaacacccaatgcttaatttttatcaagtaagtaaatacattttaaagtgatactttcagtgttggtatttgacaaaatggatcctttgtattgttctgcaagtcagaaaatactttcaggaaaatagctagacagtatgtcttcggacacttgaaatctcttacaatacagtattttggtccaaaaatcataaggcaaaaaaagaaatgaccactaggatttaagtccaaatatgtaatttgcaacattaattacaatgtcaaaaattgggaaaaaattaaacacatagaaatatgttgatagcatttaaaatgtgctaacttttaattgtatggggaaatatataatattaagtaaaacttgtaggatacaaaatgtatcaatctatcgatctaattaaatatatgcagtcatgtgtcactttaaaatggggatgcgttctgagaaattctgtgtgagtttcaacactttgtaaatacaagagtctgcaaagacaaacgtaaattgtatagcctattacacacctaggctatatggtagagcttattgctcctagtgtagaaatctgtatagcatgttactgtactgaatactttaggcaactgtgtaaaaaactggtaagtatttgcatatcaaaaaatagaatggatacagtgaaaatacagtattaaatttgatgttaacaccattatatatgaagcccatcgttgaaagaaatgtcattatgtggtgcatgactgtttgtggaaaacatatgaaagaaaatagaccaaattatttttagaggtggaaatatttttgcattacatttcacttgtttcttcataatattctctgcttctaataacgaacgtgtattcattgtgctaccaggggaaaatagcctgaaattatttttaaaacaagacccaatagaggaaaagaaggaagagcagggggagagtaaccagaaacaaaagacatttttgttttttgtacacataaaaacattttatgtgtacttccataaaatatgcacacatgcacacgtgtgcacacacacacactgcagttgaattatatctaaagatgtttattttttcaaacttttcattttttatcccaaatgaaacatgtagagtaaccttttaaaatcaactgtggcttatagcagtgtgacattactgttttcaaagaagtaactgactttgtgaccttaccaaaaaaagtttattagctttacattggaaagcagtttactgatggagttttactgactgactggaatttacaacagccagggagaaatatccactcaaatatctactgccattctttaatgcagttacctaaatatcagacgtgtctacctgctgctcagtctactagtgtaaatatttaaataaaactcagtgtgaccttttcacttagttctgaattttcttcctctctcttcctcttcctcctcttgtccctctccttttccttgtctcattttacgcatacacactgatttaccatcacacatcaacatttgatttcatcaccataaaagaagaaaatatgttctaggaagataatagaaaatgtaaggtatgggggcattagcatacaaagggagaaaggaaggaaggaaggaaggagggagtgtgggaggggaaagaaagggagaggaaagaaagaaagaaggaaaggaaggaaggaaggaaggaagaatttagtgtgacagtcaattgtttatctcttatttccattatgctatttattctgaaaccctattatatttttatagtgattaattttgcctgaccataaaaagcaattcttgaatagacaacatagatgaaacaaactatgtaaactttatccagggatgaccttaataaatatgttagattctaacaatcttttacttttatttatagttttgttgctatggagatcttatttcagaactaaaagctacatatataattctgaatgttatcattttaattaaaagataacaagtaaattttctatgccattaacaattgcatattgttctctttacaacaatgtcttttggagtcaatgaaaattaaaaatggtcttgctatgtggtcttaataataattataacagtcataaaagattaacaggtaacagttatgttcactatatgccagaaagtgtattaaattctttgcctgtactaactcattgaatcctcatgcaaccttacaaagcaggtactattatcttccctattgtatatatgagaaaatggagaccaagcattctcaacttgtcctggaacccaagctaaaagtggagccagcatcagaacccagaaggcttctgtaaaagcccacgtgacactgactttataacaaacctaccaaaatttagcagaattcattgcacagtcataaaacactcattttccccctttttaaaaaagcacttttttccatgtttaataacttgtacgtactttgaacataaagtatttttttactattacattttattttatttatttatttatttttcttttttttcatttattattattatactttaagttttagggtacatgtgcacaatgtgctggttagttacatatgtatacatgtgacatgctggtgcgctgcacccactaactcgtcatctagcattaggtatatctcccaatgctatccctcccccctacccccaacccacaacagtccccagaacataaagtatttttaagtgtcgttacttactggtatcccaggttaactcgaatggatagagctttgatggaatgtcagcctctaggtgctgtaaatgaaagatcttctgcttcacagagttggccatagcatcattgcattgtttctttttcacttctgtgtacgcaggaagcaaccagcttggccccatatatggccacacatcagtgatgacaggaagtttgctggatgaccaccactggcactctgtggtcattgagcgccaggggcggagcattaacctcactctggacaggagcatgcagcacttccgtaccaatggagagtttgactacctggacttggactatgaggtacatgtgatgacgtagaaattgtaataaaatgtcaagcaattgtgtcactctcctactgtattgtattattgttaattatattactacttacaccttttttattttcttctctaaacaagacactgacaattttaaaaacctgattaattcgtttcattttatttctaaatttataatcatgagtacttgaactattataaaaatcttagtaccaatgtaataatttgaagagaggaaccatgctatccaggccatttaataaattcagaataaatttaatttgtaatcctttcattggtagttaatcatgttatcaattcttcttgagaatgtgcagtacattatatgcagagggttgtctaatatttattataaagtattgaataagaaatcttagtttctggtttatattaagtcatttagaaactcatgactgtagatgggtcttttgacaagctctgttttctcagaatcaatatcacaaaagcaataaagtaaaatacagactattttaaaaagattgttcatgaacaaaaagacatatattaccttctcaataattagagattaaaaataatcaatgatcacgtttatataaataaaaatatattctcataggttaaaagtaggtatatcatatttttaaattatttggagagcaattcaaccttaaaatatccattaaaactgttaatcatatacgtaggtgagctctttaagatgtttgtcagccgggcgtggtggcgcatgcctgtaatctcagcactttgggaggctgacgcgggcggatcacagggtcaggagttcaagaccagccggacaaacatggtgaaactccgtctctgctaaaaatacaaaaattagctggttgtggtggcacgtgcctgtaatcccagctactcaggaggctgaggcaggagaatcgcttgaacccaggaggtggaggtggcagtgagctgagattgtgcccctgcactccagcctgggcaacagagcaaaactgcctcaaaaaaaacaacaacgaaaaaaagatgtttgtcacagtattatacatcctaggagaaaaggataacactatacatacaaaagcagcagaacggtaagataaaagggacacaatgctattacttagccagaagtttccgaactttcttagttcatggagcccttagtgtcttcgaactttttccacagcagtcctgagccgttaggtccaaacaacctaaaaatttacgtcctaagactttggtagccatttagagaaataaacacaaaataaaagtgaaagtagatttttatttcattcttaaacaacagcaattattactaatgggatgagtgctattgcactgtacgactggcagaaatggggatcagatttgccaatggcattctaattttctgttccacttttactctacatgatactctgtcttaatcagagtaatgagagtaatgaccaaatccaaaattcacaaagacagcacatcattaaaaggaatgacacattatctaatactggaacagtaaactaccttaagctagagtttcacacaatgtccaaaaggtgtcaaatattgttgtgttttctttaaaaatttcaaacatgctatggcacccctattagttttctgcaccaccttcatgttccttggcacccagttctgaaattggagatgtattcatatatatatgtgtgtgttatgtatatttatgtataattttataagaatatggaatatgctcatcataaaataaatggaaaaaacaggattaatagctgtgttttctattatctttatgtttaaatagtttctagttttttgcaatatgaatatacgatatatattcttaaataaaaaatttagagtagaatatgctatataaacactgatggagactttattaacattaaatgaatttaagattattggaaagtattttatccctccccctaaaaaaaactcttaaaagcaaactgattgttaaaagaaaatgtatgtgaacatcccagaaatttctatcttctctaaattagtatgtgtcttggctcatgtgacttatctcccaatgtatgagagatcttaaagatgaattattcatcctctgttaataaactttgaagtaccatagaagaggtgaaaattctggaacattaagaatgaagaaatataattctaattttcaaaaaaccaaattaaaaatttggggtcataaaccctgttgagtgtgtgacgaagtctatgactattcacgcacacacaacacttgctatatcggatcagcagtttcatggacactttgaagcccatctatatacaatgtcgtgtttgagaactgcaggtatagactaaaatacctggaacttatttattagacagaaacagtaggaagaaatttaaattaactgacaaagaatcagggtagacttaccatttctggctactgccagattatggtcctcttagagactgcaattattggcatgaaatgtaataaaagtggctgtgcttacctttatattgctacacttttctcttaatggaaagggactccctttgcttatttgtttagaaaaaacctcagggactgggccaggcatggtggctcacgcctgtaatcctagcactttgggaggccaaggcgggtggttcacctgtgctcaggagtttaagaccagcctggccaatgtggtgaaacccccgtctccactaaaaatacaaaaattagccaggcatggtggcaggcatctgtaatcccagctacttgggaggctgaggcaggagaatcacttgaactcaggaggcagaggtttcagtgagccaaaatcatgccattgcactccagcttgggcaaaaagagtgaaattccatctcaaaaacaaaacaaaaaacaaacaaacacctcacggactgtattagagtcagtctctagttttgttgtacttatctccttgatatatccacacactaactatactcaaacctcacagactgcatgaaaattagcttcaaacctaaaataatacaaattatacaacattcattcctgaactatttaaaggctttggcctaaaggaagagaaagctcgtcttgttatcttcacaaaacctgaagatgcaatgtcctgcttccccaagattatactgcctcaatcaattcttccagagtacactaaggacaaaggcattgaggcccaaaggtggaggtatgctggtaaatgcttaacaaccagctctctccagggaggaatggtcaggaatgccctgatatatagcatttgttaattttcatggtgcgaatttcccaccatggttgatttcatgctaccatatatggaactgagcagggagttgcaaagaggtgcctaatagcactatatgacggtatttccatcatatagttgcaataaatataaatgacctcaagaacatatacgaaagtaaagtgtagagataaattctgaataggtatgaattttgtgtttcatgtaatttacttaatttatagcttatgtagtggaagttttaataatagctctgcttagcagtcggttcttgtgaaccagtatgagtgggattcagcacagcactgctagcgtaaattaaatatacttaccacaatttctggagatgaacatcatgaaagaagtgatggaatacaagttcactcctttgatgtaactctatgtggacatttcctttttttcctttttttttttttttttttttttgagatgaagtcttgctctatcactaggctggagtgcagtggcgcgattttggctcactgcaacctccgcctcccgggttcaagtgattctcctggctcagcctcctgagtagctgggactacaggcacctgccactatgcccggctatttttttgtatttttagtagagatggggtttcactgtgttagccaggatggtctcgatctcctgacctcatgatccacccacctcggcctcccaaagtgctgggattacaggtgtaagccaccccacccagccctaatttttgtatttttagtatagatggggtttcaccatgtcgaccaggatggtctcgatctcttggcctcgtgatctgcccgcctcagcctcccaaaatgctgggattacagacataagtcaccgctcccggcatatatggacattttttgtgacctagtcctaagagtttgtctcatcccctcctcttgtagctgcctacactgcaaagtgggccaatcaccacctgcaatgaggctgctagctacagggtggcttgagactgtgtggtgatatatacgtgcacttcacttcatttttcctcagcgtagtcaataaaaaccaaaggggagagcagcaaaatggtgtttggcttagattctctctgttcttcagaggacacccactgtggatattatgctgttgtcttttgcaatacagctctgctagggaagtagaggaatgactctcttgaccattgcagaaccacagactgcctaggaagaaaatcagtcacaggaggagaagcccgagtttgaacctgtttctgccctttaatggttgtgtgacagtggacaattcatattcccctttgatgaaatgaatctaatcgcattctttccatagggtttatgaggaggcaacaggaagtaatagaaaaaaatgtgtgtgagttaagattacataggctacatttaatggatgcacgtttattctcctttatgtaaaagaagactggaggcaaatggctgctccacgatcttcaagatcacagtcctttttaatcttgctcttcctctatccctgttgcaaatcactcaaagacggctgctaacatttcactttgcacttcagctagcaagaaggaagagagagtaaacaagactgtgtcctccccctcttaatgacagttcttagaatcgcatacagcccttccacttaaatatcatgagaccaaaactggcttcaaagaagttgataatttattatattgactggggagcaatgtgcccagctgaaaagcattattttttttccctaatgagggtaggaagaaaggatatgtagaggtatccaatagtccctgcgacattttgtgtacacttgaaagctaacaaaatcgttactgcagttatttctttagaggcaaggttattggatggcaaggtcattaataaatgtatcatatgagccacaggaataattgaatattaatcggacaactgcaacaatatttgttactatcagcttcgttaaagtgtcagaaaatattctgtggtccaaccagtttattttaccaatgagaattttattttattattattaatatttgagacggactctttctctgtatgcccaggctggagtgcaatggcaagatctcagctcaccgcaatctccgcctcctgggttcaagttattctcctgtttcagcctcccaaatagctgggattacaggcatgcaccaccacgcccagctaattttgtatttttagtagagatggggtttctccatgttgatcaggctggtctcgaactcctgatctcaggtgatccacccgccttggcctcccaaagtgctgggattacaggtgtgagccaccatgcctggcccaccaatgagaatttataactagaaagaataaatgacaacctaatatcctataattagttaccttaggaattggggtcagaattcactaaattgttcggatctgttaacttgagcctgcattgcttttccagagcaccttgatgaggtggacttgtgcctagagttgctgaaaacagggaaactgtaaggataatttgaatcccctgcagaaagtgaaaggtccgaattaaagaaatatgcacacagaggaatatgtatttaataatattaaacattgacggtattattactgtcagttggggaaaaattgttcaaaaagattgtaaacaggagacgtagtactccattttagtatcaaaaatgattgcctttggtactaggcacacttaggtagtacctaatatgttcatttcagtgcaacttgaaaacattttcccaataattctactttagattactatttcttctttgtagttttctgattctttgggatatatttttcctcaattttccttttaccttcttatatatgaactgtgtggcaaataatacatattcagctaaccattattaataataattgattttattgtaaatgaggcctttgtttttttttttaccatcacctcataaaccacaatttgtgtttccccccctaaaagtacttaagcatttaagatgccataacactaaatcatagaacataatttgttcatggaccttccagaacacagaatatttgacttatgcttcaaatatgaagtcgtgatttttaaaaatgtcttcactgttgctttcatttcaccccatcaaacatgctctggaaaagcaccacaggctcaagttaacagattcctaaccatttagtgagttctaaccccaatccctaatgtaactaatgataggatattaggctgtcattgattctttatagttatatattctcattgaaaataaagtggttggaccacagagcattttctgacattttaatgaagctgatagtaaaaaaaatagataatggtaatattgtatgataatttaaaagatatatattacaagtattgtatatcttgatattataattagcggttggcttcatttactactaattcactattcatagtaaatatcatccttgaccatgcaaatactaaatgcaattttgtatcatataaatttaatgctatagtgtatattgatcaaaaatgtataagaaatggatattttctttctataagcgatagcagccagagaaacacagtaagtagcattgtcttatttcttaagatttaaaagacctataatatctttaagcctacacagctcaactttgagttcccaaatcctaagtggtccctaatcaatattgtaatgatattttttgaactattttctacatccaaaataaatctaatgaatttttgacaataatggtcattagactacaagtctgcatagggtaaatacgatatcccttgctttgggctgcagttttatcagcttattaaattagtgctgattatctcatgcttactggaggcatttattgatagtatgtctttgaatgataaacataaaaatatatttctaatattatttgatacaagaagtttgctgaataaaaatcttttaaaatattctcaagaaaatttataaaatgcctttggggcagtaaaattgcaaaggatcattgcttttttttgttcaagttataatctaattatcagaatgaatgactccattagacacttcaacaacaacataatttaatatgccatagattttggaggcagaatgctataatatttgtatattttggttgaggtatagatacttgaccttcactgtattcatagttttgtctagttcatcataatacaatgtggacgtttacatttaatttctttttctcaaagataacctttggaggcatccctttctctggcaagcccagctccagcagtagaaagaatttcaaaggctgcatggaaagcatcaactacaatggcgtcaacattactgatcttgccagaaggaagaaattagagccctcaaatgtggtaaggattttcacccgcaaaatattggtctataaaatatcaagtaacatttttgttttttggattattgaacaacaacaaaatcatgacatttttcatcatatttgtgtttgggcaaaatgatgtaaaacaaacattagagttatcagaattagtatagatacttgctattctttgagaatagctaatgggactagcttgaagtaggtggttggttttattcccacggagcacagaatgttagactcaatatttctggatgactcgtggcacgtgcttcatcccagcagttagcagcccttaaaccggcagcatcgtgttttcaaatatctcatcacatgtgctctaagttacttgcttatggtttaatttaatatttttaaagtttttaaatcagggactttattatatttactcctgtgcttccaaagatgatttgtttgaatatgtaaataaatacactttttagcaaatctctaaccagactaaatattacacagttaaataaagcttgatttccactgcatagccaaagctgtgccacagaagttcacagtgatttttttctgccttttgtgtgagttggtgccaggtttcattagattttggaaggagagcaaaagtcaaagaaagccccagcacacatgcttccaaacgacactactccacatccctaaaagacacttagtttgcaattttagtatgagagttccctatggctctgcaagaccaggagctgctttagcccagagaggctatttgggagagcttagaattccagagacccatacaataagaagatattatgcactataagtacaataatgtcatgagtgtttgcactgtgctccaaaagagctctgatggtctcgttgcctcaaatttgagcccagggtttcataaaatgatttgacaaatggaaatccctgaatgaataaacagttcaggttgaatatggaaggtttaaaacaataacttcatgcaaatgattatttaataaataattttcttaaagtaatcataaatttatactagaaattaaaacttgaactttggttaaattttctcataaagtatattgactatggaaaaataataatagctccatttataggcaacaggtattgtgctaggcaagtcgtattttatatttaggatgatctgagaacaatactgcaagaaggatacaaacattttgtagatgaaaacattgcgatttaacatggaaaaaataagttattttatgagaaaaataacttttattttatgagtaggagataaaaagatagatgtatagcctggtatagtgggttgctgctgtaatcccaacactgtgggaggccaaggcaggaggatcacttgagtccaggagtttgagaccagcctgggcaacatagtgagaccatgtctctacaacaagttaagaaaattaaaattaaaaaaataaatcaaattgaattaaaaaattagctgggcataatggtgcatgcatgtagtcctagctgcttgagaggctgaggtaggaggatcacttgagcccacaagtttgaggctgcagtgagccatgattgaactactgcattccagcctgggcaacagactgagactctgtccccccaaaaataaaagaataaaaaaagattatggattcacaatatgtgagtttgattatgctctataattacattttattttaacaaataattgcagtgagaaaacatagaataaacttttgaatcaaaatatacatacatacagaaaatcttagatgggatagagacaaataggacattttgcaagcaaccctgcaaagacaagtgtttatataagaaatgtactttcaaagatgttgggtgctggtatttcagtgaaattgactgagcactcattctacctcctcttcccccacatactcattccctcattatgcattgactccaaagtcagcaccgttactctggaaggatctttaattttgctagggagacaatcccctcaaaagaggtatgtggtcagttataaaatctcaattattatgcataggcagttctttttatcagtaaaagcgagcatttaaaaataatcatctgtgatggtacagagcaaatttaatttgaatattaattcagagagactgcctgccttagatttaatggttattgtgctaaaatggaagaaatcagcatcaggtatatatatatatacacatatatatatgtgtatatatatgtgtgtatatatatgtatatatgtgtatatatacacacacatatatataccatatacatatatataccatatacatatacatgtaccatatacatatatatgtaccatatacatatacatataccatacacatgtataccatatacatatacatataccatacacatgtataccatatacatataccatatacatatatatggtgttgttaaaaatatatagagaaaaagagagacagacatagagatagaaccaatgaaaatatcatccaattacattccttaaaatattatgataggataaaagaagttagaagcaaatacagatttttagacctgtaaagagaatgtagttaggcactgaaatatacaatttagtgtatctgaatgataaatatttttttcttttttttcttttgcttataccaaggaggaggagtatagaaggggaggggaaagcctgaattattgcaaattttatctccatttagcccatttatagtgctagttatacaggaattaatgcattgtgatataagcacaattcatgggaatttaaatgggattttgagttggatactaaaataatctccaacaaccacaattacattaatgctgaaaacttaatatctatctatctatatatgcatatacaaggtatatagataaaaatccaaatatatttccctaaaatatcagtttcataaattgcaaacatatgaccatagtccccactgagaccagagtaatatgttaattaatgttggcattgaccacccagaataggacagagcatctctctccctgacttatgttcggccagcagtagctttgctgtcttcagaaagtctagtgatccacagtcacacccacaacacacatacacactttacaactcatggtcagcctatcacatcaggctgtctggctgtcaatcccatggtggaagctgcttgttatagttagacagccaactgctgctcagtagtaggtcttacactccaagtagatccgtagtggtgcatccagtcactgaatccatgctctgctgctgtgtgtgagtttagcttaggctcaggctgtgcttcaaaacttgtagaactatactttcatcagtggtctgacatggatgttcattttattctgtgttttcctcagagcctgtctttctattttacagggaaatttgagcttttcttgtgtggaaccctatacggtgcctgtctttttcaacgctacaagttacctggaggtgcccggacggcttaaccaggacctgttctcagtcagtttccagtttaggacatggaaccccaatggtctcctggtcttcagtcactttgcggataatttgggcaatgtggagattgacctcactgaaagcaaagtgggtgttcacatcaacatcacacagaccaagatgagccaaatcgatatttcctcaggtcagtgaaacctatttgacatttgttcctgaaacttattgcaatttccagagttaatgttgtgctttgtttggttttgctggtgttacacgctcaggattaggttttaattcagatcttcaagacgcttacttggttgtagtgtgtgctgattgaataaagaaaacttggaaagttgttgagagagcaaggcatgggtgaaggagaaaattggttgagattggaaaagcaaaatctattccttaccaatgctagtttatttttaatagataaattgctcttcttttaagtgaataatttatgtttaaaaacaaggaatgtttattttaaaaacacaattgtatctggtatcttttctctttatcaacattcgtgtaccttttactattagtaacaagattatactaattttaactttaaggaatattccactgctggaatcagaacttcaaaatgatcttgctaaaattatgcaaatggttggaaaagaaaacgaaagtgaatataaaggtggaatgacaagatttgtgtatcaactgacggaagactggcttaggcaaaaataggataattttaaatttggctttgtagtgatatgacaaatagaggcttaggtaatattcttgttatttgaatagacttcgcaaccttggaagttctttgataaatacagtacaaagaaaggtgacattgtaaattgtgatgttataagcaaagaaaaattagtctcaatattggactgataaatagtaactgttttcatctatttttcttgagatagtctttgcaatagtcatacatatatattgtgaagaactacttagaaatgggagatacaaagaaaactaacatttactgaacacttagtacagatgtagcagatactgaaaggagtcatgacagagagctcaattgggtgaccatggactctgatttctgaatatgccatatactctcatggcaccctatgcatatacctgacacggtttctaacacactatgatttttgtccctctcttttcccctctaggctccatgctccttgacagcagggaccatgctcctttttcttctgtctctggcatatagaatagtacctgtaagaggtgctctccaatatttgttgaattcaatactctgacccctttcaactaacagaatatcccctgctatagaacatatatattttcttgtaaaataggctttatgtttgtgtgtggcctgaatgtatggtctattactgaaaaggattcaaggaagccacaagaaatgttatgtcagagatgtgcctaaattattgaaatcaaaggtattgggaaatacctagttattcactttctccatttctgctttattagttttgctttttccttgaatgtctagtcaaaatgattaatcaaccatattttatcactacattcgtttataagtatacctagggaggtttacagcaaatcgaaaatatctggagagaccagaaaaacagataaaacaaaaacaaaagcaaatgtttgccacagttgaaaaactcccacattatattgttatgattaatgattattgcctaatgactaaacataaaaatattagtatgaaggcctgtctccttgcagtctctgagcaaatccgatttgctggtgggtttccatgtaacaggagccaatatatttgaaaggataagatattaaccctagtggtcaataaacatgtattaatttgatttggtgtaatttagtactccaagatactctcacctaatttaagctgtgtttattttgaaaattaaagatagaatgaacaaagaaatccaatacatgacagttaattcaccttaatagatttgcttaaacctaataaaaatggactgaagagtttttgtcaatttagccaagaatctgtgcaaattaattgaaaagatataaaatctaaagatttccgtagtattacccttctataatccagtgaaaataccttactgcttcaagcattttatataaatatatatatatacagacatacatacacacatacatacatagtggaaactaagtgctcatatttgagaaacattagttgaaaaaaaaattcaaccatttaaaaaagttatattttatattcattcattcaatctaaaagtacatatggaaaccataggacataatttcctctgtcttttaatgtattttatcaaattcaattaaatgtgtaaataagttagtaaagtggcaacactgagaaaacagttaagtcaggattctaatgtttgctttaacaaagggaaatatatctgtatcacagctattctactcttatcagcatgagcattgaagaatgtcagtccacttctccttttgtcaaatattttgattgaaagaatttagaaaatgcagaaaatctagaaaagaaaaataaccagtgataaaattttggtgtacacacacaaagtagtgcactgagaaggtaatatagagactctcagatactgttaatatatactggtaacttagtttttatttaataaattccatggtccaggatgaatgtaacccaattagatcaaaaacctttttttccatcttggtcaacactgttctttgggaattaatttaaaatattaaatacatcttacaagtaaaataatgtttaatatattgttcaccctatctttgtatctttctttccaagttgtgattactgtcttcaagagtctcattagtaatcaacagtagacttgacttatgaaattcagtcaaactcagtagccttgaatttacagagtggattatcttaccatgaaaatattgaacaagttgcaacatcaacgttttctgatggatagccaaaaacaaacaaacaaacaacaacaacaaaaaaccctacttactttttgaaataagtttttatttcaaagtgactcaattttatcccagtacatcattttttaggacagaagttactgatttatgaatacatatttaggcattacttttaactaggcataaatgataatattaaacaggtgcaaaaagggtctaatgaataatagctgttcattctgggcataattttcattttaactttaaaattcaaaactctggggaaggtggacctagaaccatgtttttcaaataattttgatcaaagtacagtaagaaaatattttatgtcatacccaaaacctactgacacaaagtttgatgaaataaaacttgccttgctattttagatgcactatgataagtgtgatattttcttttcttttgctttattcttaaaaaaaaaaaaagccataacccactataataatttcatgtcctaaatacagtttggaaaacaccgacctgacctgcattctttttcttatttgaagtgttggaatttttaaaagttttagttgcctggaagtattaactccatcactctatattggaaaactaaatttgtcttatgggaacagtattataatattataatggtagtaaaaaagcattaatgtacattactatttgaattatagcaaaaaaaaaaacctaccttttgaagtaagtttttatttcaaaatgcctcaattttatgccactaaatacaaacatatttagaacaatactcagttgtcgtctgccaatattaacaaggtaatacaatgtgattcagcatttattatagtggggagaaagtgatttatcttaatattctctctcagttattggaaaaaaattaacttctctccatgtataaacaaagcctttccaaaaagtcattcagaatatgtcctgtcctaaatcagctgttttcttatactcaagtattggaacatccttgttttgttaatgtaggtattgcttcaattttcgaatggctgttcagtgtccacactgtctcagaaatatgtaatcagaaaagattttctcatttgtattttcatctccaaaggaaatcttctgtggacttgttttatttactttgcttcttagtaaaatttcctttgtaaatcattgtgttccattgggtgtctcaagggaggagtgggagttttcttggttcagtgtgtggctgggagcatgctgggaaatagttctcagttcaatctgggcaaatgtgtttgggaacactccaggcagtgtctattctaagcaattaaaatatctctgttcttgattttatgaacacttggaaatgtagccagcatattaatatttctttaaaaaattaatttataccgttttccaaagttcagtgataacttgccccatgagacatccttttcatcatatgagaaaaaaggtctcatttgaaatacaatttttgatgttttagttgtttactgaaaattttttttcagttctatactgatattatttcaaaatgtcttaaattcttgtaactcaaaaactaaatgtttcagcattactacaaatactttaagagatttgttttattatgttttacagcaaaataattggagacttatttaacaagatatgttctctaattcaagtttaaaccatatttattagaagccttaaaagatgttacttccctttgatccattaaatttaagtttttctgattctaagaaaataaagaagcacccagagttatttatcacaacatatatacaataaccaaagtaattgaaaacaaactactgaaaatggacatgtgattttaaagagtgtatttttatgtggaatactattatgtcattataaatcacatttcttatataaaatttaataacatggtaaaaaatgctaagaataaaatttttaataaaaacttaagtagactatgaatctaatgtcattattataaatataggaattttatttcattccaaatcagaatgaaataatataatactaatgttgatcatctctaattggtgggttatcagtccattatattaactttttaatatattttctctaatatctatattttctccaataaacatcaattgttctcagaagtcaaaaacaatatgctacaaaacaattgaggataaaatgatatttctgaaaagtatgatgcttaacaatgttacaaatggaaattaaatagcatatcaatttaaaaattctaatttccttacttagaaacatgtacagccaatttcttaaaagtttcaccttaaataataagcttcaacagaatttcaattgcatttacatacaaatggagcattttataatcaggtgcagaaatttggaggttgtgtctataatgtttaattatttgaaaatattcataactcattttgaacaaattccgcaccatctatgtaattttaaaactatttttcaacctgggtaaataattggatagataagtagataaatgattggaaaatagatagatacgtagatagatagatagatagatagatagatagatagatagataggtagatagataaaaagtattgtcccttaaaactattgctagctatcaggtaacaacatattcctttttctcaataaaggaatagattgaataaataaataaatcatcactttattcccaaataatctacatacaccatacttttacaaaataagtggctaaaaagtaatttttagatttttgtaccttttgatgggcttgtagatatctaaaaatttccggtaaaggcaaatccatcatcttaagatacaaaagataaaacatggctctgtattcttagggcgaaaatggagcctaagaaattctgattcatagagcactgtactcactttaattaggagcctagaactgagctggaaaggaatagattctattgtttggtggatcccaaaagtgagatagataaagatctgagtactagatctaaatagacacatagaaataagatacccttggacatatctaaaacatattttgctgattttattccctgaaattcacaaatagacttgctgtgagagccacatggtaccaagtaaaaggcatttgagtcaatggtatgttgctcctgggtagcttcacccaactgactttttattatatatcaattcctagtgtggctgtaccactatcatgcgaactgagtggaaatctacctttaattatactgcagtgaatgctggtgcacatttttcatcaatagaagcattatagtgcagaatgaaaggaaaaaaaggaccgggggagagttttatgatgttagatattgacttattctttagaaagcaaaagggacattttaatttataatcacactccaggacaccatttccattctagtttctacaatatttttgagccttttaaaatgttctatgcctttttcagggaagatgaataaaacatgttgtgtgtatgtgtgtataataattttttaaaattccaaaaaggcaataaagttttagtaactttgttggataaaatggaggcaaaaggtgccaatgagaaccagactgtgtttcaaaagcttcagtttactgtacaaataaatcgaagagaaaaaaaaatcagatatcactagttgatactaagagaataaaaatgaattatgaaagaatagcaaagaacatagcccaggaactccaaaaataatatatgcatgtagttgaagatgtttctaagacaagaacagggaggacatagaagcaaattaactttgctgaaaagccagtatatttctcagttaacagataatattgtatctacttaacatgtacagaatgatgtcctgaagtacatatacaatgtggtcctttacctttcatttaagtgtaagggctgacacttcatgtaaggttgaaacttttgtagtggataaatgagtaattggtaaatttaagcaatatggatttacatagtagagatatatctaagtcaactttagatgtttttgcaattgcgtgtctaattttgtttcaaatagttaacaaaataaatagtgttggcatgaaacaatcagggatgatgtaccttcataatcagaaaaaacacaaagcagtcattggtttggaaccttccccacaccacttcccactccccccattaacctcatgttgagaattaccagggataattaacttgaccaggaaattcagactgtgagatagtatcattgcccagcatctacctccctcaccttttaatttttaagtaatttgggaagaatgtaggctcattaggttatctgttgcttggttgtaactagatgtggaaatcagccttcttgggggagggattctgcagattctgtgagcctctgaaagtgacttgggatcagctgaaagaatgactcctttggaaactcagtatcatgtttagccacatatatttcttagtctctttcctttcttcatcaaggtttttcacaagaaaattttgggagagtcattcaacatgcatagaaagtaattacctttggtaaacatggtatcaggaaataattatggatatggccccatctgcaatcatgactacattttctgacttattttattctgatatatttcccttgaggcttttctaacctgagctcagaccctacttctgggaactgaaattctgtgctatttctgagtcctctttcttctctccagtcagtgcttttttcctttcattcattctctacgattcaattttataattacagttgtgcctagattcttactgtagcgcttggtagactctgatgttttctgaaagatactgatgacctgcctagatgtctgttctctctacaatcacttctagtctttcttctagcacttccaggctttctgagtgtctttccgagattgaatctctattgctgaacctctgtccagaggccgagatcttgctacccctagacgtacaacctgctgcctgttccctgcctggatattggagtactgctcacctccaatttcccaggattctctccttccctcattccaatcctctgctattttatttttaaccctgacatggttgacttgattattttaggtcataacttcctcttgcctatgaatattgcttacccttttgggcatgaattttaactacctcccaatctcaactgctgctatcaatccttgtgcacacctgtgccaaatctcagccacccctgtattctttgtcatcaaattcctattgcttcttggaatgcaaatctaacatatagtggattggggaaaactacaagcagaaaactagtaaagttcacatagtcccctaagatcttagctttggttgagcacagcttgtcagctaaccccatggccaagatcctaggatcgagagacctgcatctgtaatgctgtacataattttatgggcaggggccagaaaagttgtcctgttaggaaaggagagcctctggagctcattggtagttatcaggcaacttctcttttgtgctccctcagatctgctgagctagctccttgctgtactgctataaaggctggcgagaatgagactccggggccatccagatatgcctcttatctactgctaagattatgatgacaactgtgataatagataataactattgaatgcttacactatacctgtcactgtgctaaagcctttgcattaattatcttgctatggctccaataacctcgtaagttaggtcctgcattattgagaaacctttctatctcatttatacaaatggtaaagtcattcttctggtgacacgagttcaaaactttgagaaaaatcaaattttgccttttatcttttcctgacacatgcgaagatttaacaatcaccacccttcttttaaagtgcctcattcatccattatctctttaccctaattcaaaaattcataccttgaaaaactaatcaagggcatcttattgcctaaaagaatgtttatcttcaattgctgacctatttgttagggtataggcgttatgagcatggactctggagccagattgcctactggctatcatggattgagttctttctctgtttcagtcactgttgaaacaaacataatgtacacaacggttttaagccatttaatgcttggaacaactccacaagatgaaggacattatcatctgcatttcatagattaaaaaaaaacacaggaatagacatgagtaactcaccagggcccctttcagctagtgaatagaagagctttaaaaattgcccagagcatttgagtctaaagtcactaaccttggccactacctctcatattcatgaaacactttggtgttacatgatcacacaggatcaggtactgtggaatatgacacatctgaaatatttgttgaaggcagaacctgacatcaatgatgtccttatcatgtccattggggttctcacaggagcattttaagtaatctcccttatgtttctaattctgtctcccatattatccaagtttctatttctacaatacaaggaagataattcaatagtttcccattactaaagaataagtcctgagactttgctgaagttgcctatcagcttaaggagattttgggctgagatgatggggttttctagatacacaatcatgtcatctgcgaacagtgacaatttgacttcctcttttcctaattgaataccctttatttccttctcctgcctgattgccctggccagaacttccaacactgtgttgaataggagtggtgagagagggtatccctgtcttgtgccagttttcaaagggaacgcttccagtttttgcccattcagtatgttattggctgtgggtttgtcatagacagctcttattattttgagatatgtcccatcaatacctaatttattgagagtttttagcatgaagtgttgttgaattttgtcaaaggccttttctgcatctattgagataatcatgtggtttttgtcattggttctgtttatatgctggattatgtttattgattttcttatattgaaccagccttgcatcccagggatgaagcccacttgatcatggtggataagcttcttgatgtgctgctggattcagtttgccagtattttattgaggatttttgcatcaaagttcatcagggatattggtctaaaattctctttttttgttgtgtctctgccaggctttggtatcaggatgatgctggcctcataaaatgagttagggaggattccctctttttctattgattcgaatagtttcagaaggaatggcaccagctcctcctaatgggtgcagcacaccaacatggcacatgtatacatatgtaactaacctgcatgttgtgcacatgtaccctaaaacttaaagtataattaaacaaaaaaagaataagtcctgatttcttagcatgccacacaagaacatgcacaaactatgctccactggagcatttggcctcatttctcctactttgcgtcatattgactactttccactccctgacaaggatttccttctctatattccatcctagcaaactgccatttatcatttattgcccaattttagtatactttccttccccaaaccccaggaaacaatctaccatcctctagtatagtgccttgtatcttgaataacaattattttttgttacatattaaatcacatactcctctactattatgtctccctcatatctgtactcctaacgccactcatgtgtcaggaaataggtaatcaatactttcatctttgcttttttggtttgattcacacctagactgttgcagtttccttgctcttctctctgcctcctgcctctctaaacaagtccattccacacatttcctcctgattacaatttcaaaatgactgcttccattgagtcatgttcccattcaacaatctttcatgaacccccaagttttaaagatggtctcacatgtcctctacaaaaagcctgaatactaattccatggcgatctcaaatcctttacaaattttaaattattgtttacatttgtttgacatgatttattatattgttaagatatttgatactctgttcaaaaatgcttcatcttctaaatttttttaagaacaacaatcccacttttcctttgtctgtccacctctgagtttagcacaatgtcttacttatggcatgtttctagatatccagttgattgatttttttaatgtactgataccaagatgttataaactataactttacaattctgttatcttcatcagtttatataaaccaaattcattataaaagaagagtagcaaatatctcaaaggaaataattgcttcactgtgggaggctaatgtgtgtgaaattgatcaggaattaaattttaatttgatacttttataataagagattttttttaaagatattaaagcctagagatgtactgggtaaactatttcaggagtaaaatgaaagcgtgtatacatttgccagaaaatgtattctcaggagcatgacgtgaagtaaagccttgaaattagtcatattccctttgtatttatttttttcacacagaatacaaaatataaatgtgcatgattaaaactaatttagttttattcttttcttcaggcttgggaatgcatttgacacgattaactccagggaaaaacaagagaataaattttttttgtaccttctacttgagatctcagatctctagtcagttctacacgattaaaacagagactgtccctttattgtgggagtctagtctgacttgctttgttaagtgaaatggcatctattgatgatcaaatcatgttgtctctgaagtattttatttgaaaactccaagcaataagattactgtttagaaaaccaaacagaaaaacataaactttagagtaactttatacgagacattacgtgtggacacggagaagtaaatttcacccccaccatacttccatcctgaccccagcacctttatcttgggttcacgtaagaccatacagcatacacatactacacttccagcacactttgttcagctatggttgacagaatagagctaacacattctccacttttaccacgtattctttataatgcaatattctatagggaaatgtgaaatctggatcacatgtagatctattggcaggtacgtttctaatctttttctctccaaaatctactgtatcctatttcatgcaggataatcagtgtcatcggcatacatagcaaatggtttgttcataaaaaagcttgatgagggaaataaacccttgatagtctctataggaattatttccattaggaaactgaaagaaaaagagggtgttctatatgtattgttttactgcccatagcagttttgtaatacacaataagtttattacatagaatagccaataggcatcaatattgaaaaatagagaatgtgagctgtattcctgtacatgcgtgcattctcagcaatgttgtgtggctgatcggtattgtgtgagtgcgtgggtgtgtgcaggagtacatgcatgctttttaaaaaatcctctaatctttgatgaagtaaaaaacgttaaaattcaataattctaattgagtgctataatgtctccatttgccacgtttgaatgatttagaatagaaaagattaaatcagtaagatgatatgacattagacaagtcagaattatagctcatctaaaacttgtattaagtgtttgatttctttcattcctcttctcaaacatttgcatattaactgttaagcaacaaaatacagcaattcctaccatttctaatttccttttgttctcttaataaaaccatgacaaataatgcaggcaagtaaggagaagaaatattcagtgaagaatcctcaaaatcggtggttctcagctaggagtgattttgacccccaggggatatttggcaatacctggagacattgttggttgtcacagctggagagtggggggtaggatgctactggcacacaatgaatagaggccaaaaatcctactgaatatcctgcaaagcacaggacaatacctacccacctgcacctcccaccaaacaaaggtttatttgtcaccaaatgtcaatagcatgcaggttgaccaccctgacctgaaggagctcctctgttgcactctggaagttgagtgccccagagggagaagcctagacctcccacccaccccactccacggacttccattttctcccatactgaataacaagttaacacgtttagacaagctgattcctgtagtcccttttaggtttgtttagagcttttctcctgttttatcattttgctctatgttgttatggtttcctgttttcctttcccaacatacatatttagaaaaattccagactcctttctttgatttcacttttgctttctttgtggaaattttgtatttcaaagcaatgaagagacgttgtcaattcctcttgggtatggtcagaataaagtataagataagagagttctcccggtacacactttatgtactattctaaggcatattttgttatttgttttctacagatgtcaagctctatttttctaaatatttgactctctagtacactgcatcactatgacttgttcctaccatttttatcattagtagatgcaaacataaattatgcaactttgtgtgagcttgacatgaggcagcagataattatcgcactggtcaacataacagattgccaatattaggttcaggtgttatgaaaatttaattatattacagcatgagaaaaaaattgagcggggaaaggagccttaactagcctgtgttagcctgcaaagtgtgttctaggggctcattctgcactttcttgttcttccgtctctctcctctgctcaccttctcagtctgccatgccctgctctgaagaggcacccatcatttgccccagcaagccacctagcctgtggagcagagtgacaaacagctccactttgcttagctctgggaggaggccatggtcctgacccaggggtccgtggggaccacaggctatgacctggacagtccctacaactataaaatgccaccaatggaggaagctcttgtgaaaacagacattcagatagctcttctgggtgttataaacgagtaactccttgttctggcttggatgcaaaacagattataaatgtatggctagtatcatacttgaagattatagaggaaatgttgctgttctactgtttaatttaggcaaggaaagtttgaagtaaaaaagaaaaagtgatccagttgcacagctcatttgtgaacagattttttatctaaatatagaagaagtttaaattttgaataacactgaagtgggttcaggaggtttggctttcatcggaaacaattaaaatgtatgccaagaatagaagatgagaaatcgtacctttttcttaaaaataaagagtttttgcttaaagtgctttagtgttttgcaattctgtcaacttattagctttactttctaaaaaataaattttcttatgatcaaggaaagagtacttctgctgggatcacatagaagcttaatttcttgttttcccacaattgatgattgtatgtgtattagtccattttcacactgctgtgaagaaatatcagagactgggtaattcataaagaaaagaggtttaattgactcacagttctacatgactggggaggcctcgggaaacttacaatcatggcagaagcgaaggggaagcaaacttggaacttttcacatggcagcagaagaaagagagtgagtagcgaaggggaaagacccccttataaaaccatcatatctcatgagaattcactcactatcaccagaacagcatgagggaaactgccccatgatccaataacctcccaccaggtctctccctagacacttgggaattatagggattacaattcaagatgagatttgggtggagatacaaccaaaccatatcagtatataaatctgctttgtggtgacctaatgcaaacagtttctttttaaaatcaaatgtacatcaactacttacacaaaaaacctctattatttaattcaataaatgattccttttcagcaaaaaaaacaaaaacaaagtgtgtcccttagagctctaagtgggagagagctgaaggcatgatagagcaaggagagtgagcactgaacacctttgtccttccacggctcagcatcctctgcgtggactgtggtcaggatgattttgcatcttctttcagtagtcagcttagaagttcctcctcctcatcatgtgttcctcctttctattaccagctcccaagtgggcctcttgttttgctactgataacacctgacatgctactgcctttctatagtagccgaacagaggagaacaatctttcttcctctacctttactaacttgctctttgatcgctacaaaaaaaagtacccagtatcctgtgagagtaataaatgagatgaaaaaattatataatgagagaaaaaaagtaacagtcctccatgactatcatctcatctctgtgattttattcatacgtgaatattgcaaacacacacacaccccacagagtctttcattttgggtacataatatattaagcactgagggtataaacagagtgccctcactgtatagataaatacataaaacattatagattagaaaaaagctataaagaaatcatgcaacattatatggtaaaaagtggtgggggccgggcgcggtggctcacgcctgtaatcccagcactttgggaggccgaggcgggcggatcatgaggtcaggagatcgagaccatcccggctaaaacggtgaaaccccgtctctactaaaaatacaaaaaaatagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaagtggtgggtattcaatttagactcagacagaaaagataagaaaaagtcacgcttggataggaaaaacctaaaatacagaagtcctatgacttgtaaatgtgtccagaattggttccttccagtgggtttttggtctcgctgacttcgagaatgaagctgcggaccctcacagtgattgttacagttcttaaagatggcgtgtccagagtttgttccttctgatgttcagatgtgtccgaagtttcttccttcctgtgggttcgtggtctcactgacttcaggagtgaagccacagaccttcacagtgagtgttacagctgttaaaggtggcacatctggagttgtttattcctcctggagggttcatggtctcactgacttcgggagtgaagccgcaaacctttgcagtgagtgttacagctcttaaagctggtgcatccagagttgtttgttcctccaggtgggttcatggtctcactgacttcaggaatgaagccgcagacccttgtggtgggtgttacagctcataaaggtagcacagacacaaagagtgagcagcagcaagatttattgtgaagagcgaaagaacacatcttccacagcatggaaggggacgagcaagttgccgctgctggctggggtggctgctggctggggtggctagctcttattccgttatttgaccccgcacacatcctgctgattagtccattttacagagagctgattggtccattttatagagtgctgattggcccattttatggagtgctgattggtgcatttacaagcctttagctagacacagagtgctgattggtgcatttttacagagttctgattgatgcatttacaatcctttagctagacacagagtgctgattggtgtgtttttacagagcgctgattggtgtgtttacaatcctctagctagacacagaatgctgactggtgcatttacaatcttctagctagacagaaaagttccccaagtccccactcgacccaggaagtccagctggcttcacctctcataaacatatcactattcaatgaatacaaaaaagggcaaaaagaaagaaattagtttggagaggtaggtagaggccagattatggaaggtataataaactatggtaagaaattagaatgcaagcccactggaggatttcttttaagggaattgaatgatatgatttttaaaagatagctctatctactatgtggatagtggatagatagatggatggatagataggtagatagatctctatctactgtgtggatagtggataggtacatggatggatggatagatagatacatagatagaacagaaggttatacagattatggagtgggaggtgagaacagggaaaatgagataaggtggaaagcattgcataatccaggagtaagtaatcgtagttttatctatgatgatagccatgtatatgaagagaagttggaggatgtgagaaatagttaaaagatataactatcacaacttggcaataggtctatgcagagtgtgaaagaaaggtaggaatcaagactgaattgtaggttcctcactttatttataggtaacagtccctttagctgatatggaaaagaatgcaaagagtttggagagaatccagtcctgttgtggacgtgtcacgttttagatgtctgctacctatttaggaggacaaggcaagttgtcagttagggatgtgagtctggagctcagagaagagtcaaggcttatgttatcagcatgaggatggcattggtattggaagccatagattatttactaagtaagaacagataaacagagaagaggaaagaattccaagccaagcctccaggagcttcatctttcaaaatttggtaagaggaggaaaagccagcaaaaagacagagaatgggcaatcagataagaagaactcaaagagtactgaaaggaacaggagcacgtcttaagaacagtattgtaattttgttaaaagaaaaaatgtagagtagagtatagttcagaagtacaaagaagataatagaaaaaaaagtaataaacctaagcaggcaactacataataggaaattcacaacttagatcttgactaagtgcaaggcagaattgtaagtagtctaagaattattttccaacatctactgcttactaattttatggaaggcttagacaggaaagatactaatttcactagatagagaaaacctaggctaatgctctttgaaaactgaaaaatattgttatatacgtatgaattatgaatgttgatttattgtctactccttgttcaaccccttcctccccactccttatgagaaatctgctcaaaatggtgaaagtacaaaaaacagaacaagacgacaacagagtaggtaagtaatcacactgtataataaagaaaataaactggaactacttggaatgactattgaggggagatggaaggatcagacaaaaccccaaaagaaacccaaaggactataaagaaatagaatatcagccaagggatgtttttaatgaaaaccaagaaacagaaagctcagaactaacatcggctaaggggcagtctgtggcaactaagaggtgcttgatgtattttaattcacaaaattgtcccaacacattgtgaaatgcatatgatcaaccttttgtaaagagaaggccaaagcttaaaaggtcacacaaattctcatagttttatctgtgatgatagccatggatatgtgagagtatccaagttttacagaggccgagttggtacttgaaatgaatttggctttatttttaaactcctatactttctagtaccctaggctagtgaaaaacaatgaagtggcaaatgttccaaagccagggaaaatgttaagtaaacccaacgctaagagggaactggtgtaacgggaatgataaacatgagtataattactcttttgtaatgttaggctgtgaaaaaagtgagaaataggccgacaaaatgatagtaaagtcacatatatctagcatgcaaactattgaataaaacaaatagccaaatataactaaatataaactataatttttttcagctaatccctagaaataacttaaagatgacaatgcaaatattcacatcttgtttgggcaattcaggcaaaagtctaatttaatggccttaagtttagtgtttccattcttcactttcacctgtgtaaacataattgttttgtttctttgccaataattttatggaaagctttttctaaagggtaaaaacaaaactaaaaaaaaaatcatgtacacataaaacataatttttatttaacatgtatttggcagtctgttttgtttgcaaatccaaaaaaggatagttccttttagggatttttttaatgtgttactccaacatgttttcactgctcctgagcagttacaaacacagcacagagctgggaagagcagctgggtctatctttggctttcatgcactaatgtggaaatggaactgtctttgggaagccttccttgttaattgctaagattggatgtacttttgcatccaaattcattttccctgatctagttatggaaaaaaatgtgctatcttgtactttaccaatggaaaatggtggaaagcatcatgtcttctgcccccaaatgtgtattttgaatttgataattacagcaatgctgacatagccaatacccagcctaagcagtttatagcaaagacaatgactcatgtacataggggattaaatctgcttctggaaactacataattatctagtcgtattcaaaaatgttatagtcagaaaagcacctaatgattcattggttctgttctctgccttctgcttgcttaaataactaaaatatattgagtaataaattaggagcagtaggttgtggtggttaattacatagactctagaacctgaatgcctgggttcaaatctaccacatacttaaatgcctatgaattatacttaatctgtgtgtgccacaggcttttcctttgtaaaatggtataatggggataaaaatagtatctgaattcctaggctagctataagaattaagtgtgaaatgattaggagggtaagtggctcttacaagtattagacttcttgttgttattatgttattggtactgatcttggtagtacgaaaacaaaaaggacaataatcaatacctcaagtaatgtgtttacagtatagttgaggagataactgcataaaggaacatttagcttatcatatgtgtttaaaaacattattagatttgatggtaaaataaccagtttagaatgccttcttattagacaaatatatactgtaaacattgtgtttaaattatgcttaaagtcataaaaaattagaattaaaagaaatcttacagatcagagtattcactgtattatttaaaatggggaaattgaggctcagatgttcagagaacagcccaggattacacggctatgcactgacatgacccaaagcatagtaagtctgatgttcattcctgagctttttccattggttcatgctggctttacaaactgagaacaaggaggtcagtgtggatcagagtagagctctggagtacttttacaattcagctgggtgagggaggaaaggcatttaggaagaaaatcataaagataggtatgctaccgtctcctctgttaaaaaaaaaattaggacatcatttgagggaagcagagacttttcatggagaatgagtggttacataagtttctacactcatgtaacaaatatttactaaacattttctctatagtaagcctactgtgttctgggcatataatataaattggggaacaaaaagctttctgaactatagagagcttaaactgttgtagaagtagcaaacatagcttataattgttatatataaataaagtatatagaaatgatatagaatgttagaagatgacaagtgaaaataccgtgaaaaagaaaggaggagaataagagggatttggagtgtaggtggagagggccctcaacagtgcaaaacacatcagcataaaccttataacaaaggtgataaacccatttcaaacagatgagggagttagttaagtagatatctgggggaaaaacattccaggcagagagaaaagccaaagctaaggcccaaggataggagcctgacttaagtgtttgaagtacagtaaagagtaaatgtttcctgaacaaaagtgaatgacgagagagtagtaacagaagaaacataatgcagtgaacagcgcatgtaaggctgagcacacaaaagtccaccttgaaaacgctgactttcactcttcatgaaactggaagcaactaaagttttgagcatagaagtgacataatctgtttcacattgtaaaaggtcattctgactctgtgctaaaaggtagattttcaaatccagtaatagaaacagagagttgctaaatccatttgagagctgattgtgtggtagtagaagaagagttgaagtgctgagaagtggttggatttggagtataagttgaaggcaatttcctgatggactggatatactgtctaggagctgtcaaggattgctctttcaagaaagtcaaggattgctcttccaagaaagtgcagtgtgaggaggtaaagaaattacatcaaggagaagatctgatactattaagatgcccgccctccccccacaaaaaaaaagaagaataattacccactagatgtaataacattcataatggcattgataagataaaacagtttctatgcattggtaaaggtgaaacctggataaagtggttttaattgaaaacgagaataagcaagatcagagtaattagagacagagtacaaccatctcatgtgagacgttgggcataaaagaaatgagtagcaggatgggaaatttaggatgattatttttcagttaaagagagtgtatgtttgacaatggaatgatccaataggttatacaaaattatggagtgcttttaatcttttctgaattgagtactgtttaaaggaagtatggatttttacctcaaatttaaaaacattttaaacttacttgtttatcataaacaattgtagacactgatagataatacttgctgacttttaaatcatcttccattttatatattaattttgtgcactctagtctctaaaaaatgacagtctgtcctatttctcaggaaaggcatggcagctgtcattaccacttctcacaaattgaaatgaaatgcacatagcacaccaaaatggagagttctgttttaaactgccaccccctaaaagatactgaactgaaatcagcaacttctaaaactatccttgtctccaagaaggtttcaaactactaatcattgaatgtttaaaatacttgaagtacaggtaaatatttctctgatatagtttctgatagaaaaaaaaaagaaacaaaaacatatagttagattatgtcttcgattcattatatattgttgtaattaataaggggcaagtcaggaaagtggaaatcacccagttatttcaacagagataatttaatagagagaaatggctaaaaagacatcggcagactgaaaaggctcaagaggaacactggagcaccacagctgtgaaggtctgaatgtttctccccaccactcccgctccctgccaaaagtcatgttgaaatcctaaccgcggaggtgagagtatttggagataagactttgcaaggtgattaggtatggaggacaaaaccctcatgagtgatgttagtgcccttataaaagagagctcagagagatcccttgagccttctgccatgtgaggacacagtgagaagacaggcatcaacgaggaagtggtccctcaccagacactgaacctgccagtgccttgatctggacttctcaaccttcctaactgtgagaaataagtatctgttgtttataagccacccactctatgctatcttgttatagtagcccaaacaaaccaagacagcaggtagcatagttactgaaggaacaaaggggaagagtttgaactattagaacatagacatttggaggaggccccctagagaaccggtacccagacttctgcatagctgatatgaatgttggcagggatgtaattaacagagtgcactatttacaattaaagatttaatgcccaatataaatggaagacgagccattggtaaagaatattcatagagacaatattgtacacaattaagcataatatatgacatgtattgtattttaccatgaataacatgttaatgcttctattggtgtattctacaatttgtatgggtgatagcacatagtatgtactatgtaaaactaagcctatgtagtagtagtatatatattagtggggaaaggtgcccctgagaagttgatgttgcccagcttgtgctaataccctaagaaattggaagagggaccctgaggagcttagatcagacctctgagtacaggtgcctgccatgtgtgctaatatatctcagagtgtgggaaaaatctggaaatggtaaccaaatgctactgataccatttagtaggtgcatggattaaaggaccatttttgtggcaacactggaaagaataggaaatgcaacaggaacaagtccctactttttcctcacgccttacagtcttcctccagtacttgtatcatagagtgtaatgcagagccagctggtaaaggagaaaggtagatttcggagcctcatacccagcatcacaaagcaaaatataagagaagtgatgaactgagagacaatggtttgttattcaactaaaattgtcatatatgtgtttggtccattgataggttaaaactctgttgaattgccacttttggtattacacaaattgatgacccaaaaaagattttaggatcatttgtgtgaattcagcacctaccgtatatgtgggaaatgtactgaataaacacagaaagatatgctttgttctcattctgacatttaaataaacctcacaaaggctttcctttgtttgccagagaaaaatcaatgcaaaattgtcaaatatattacaatggtctttgcccttctcttaggaattctcacctgacttctcttgcttttgctgcattgcataaaccctgcatatgcacactgtgccttaaaccattcaatgtgctgtcattgatgtcatctcatctgagtcttaaaagaattttgagaggcaatgagaaaaggtacagctcttctaagagggcaaacaaggatatgtcaaggactgtcaaggatatggtagagaagattttttatttgggacagatgacctttacagttcttccccaacattgagctttaataactggactgaccatgggtatgtcctcatcatattctgtaccaaaaatgaaagtaattatggcatcttcctagaggagattgttacttttaccttcacactagtatggttgcaagcatatgtcacctttgatatcacacaactctggtaccctatatagagaatcacaagaaaagaaaatacttgtgcttgtttacccccatatccacatttctgcttcattaaaaatccagaaaggtcagaaagcctaaactcacctggcttcactctccatttgtctccaggcatggctttttgatgccctgacagtagcccaagaaaacagaatattttcaagaaactcagcaggagtgaccttcagttgttgcctcattggcatatatttcttggtaaccagggaaagctctccatgacaccctccaggtccccaaaatatactgaatgcatgatgccagaaacattcacattagagcactatttctttctatggtgataatgggggttttgacctctgttgacatgcaaatatttctgaaagaagttccacatcttcttccctgagatccaattttgatgtgaatattgtataagaagtgatcaggaggaagaggctacttaaaagagaggcaaataagatagcctgaatggaaacaaatataactgtttttgcaaaggccagtgcctgcccataaatgtactttttcagaacaattgtcaagtttcttttcatccaccagggttgaggtgcttcctcaaagacactcttgtgtagtcaaggctcacctttatttcccttattgaactctgctcgtttcctttaacatctattttaatactgtgcaatggtattatatttttctgtgtttcctttttaactctagcactaatataaactttttgaaaattaggcttccacatccctcatttgtcattgttttgcaagatcctagcccagtgcctggcacagatatatgtgcttaatgcacttggctagatggatgaacaaatgaatgaataaatggtatgaataagtttcatatgctttttagtccacccagattccaatgtaccatatttatcagaaatgatataataaattattaaactttaattcaaaggtttatattcttattgatgtttttattatcagtaattcaattagtaggacatagtgggatattttattgatttttaagggatttaataatttcacattaaatcagcaataacaaaaacaatttatatgcttttcatgtccttaagaagtaataaaaacactcagctaaatgacaatttaataaggtgaagtttcatttgcaaatctctcgtttctttgagttcactctgacattgtcttctgtttccctgtttccccagtgacttcttatctttagtttaaaatggaaaagtgattaaacatgtcaaaacaaataactctacattttaggttttcaagtaaattaaaatttcatggacctcttaaaaacagacatatggaaatatctaataataactacatgaactgctaatggagtaagtttccaccaagcttaaaaaacacctttaatgtttttataaagccattttgaatgatagctgaaaaaaattaagttcaactcattcctaataatgctatttatgataatagttcttcagtgactttattctgcaccatggattacatgcacaaaaggaacacatatcgactgtatttgtgaaaaggaactacttttttcacactgctaagttaaatcccatcttattcagctgacctgcgattcagcacaattaacctgttcattagttgcaagtaaaatgggacatcaagtgatggtttaatgcaagcattaccacatctgaaaaataaatgtaggtgtttgtgtctcagagtgatttttcttcaatatcaaaaagcactggaaacgcctaaatctaaagcaaaacctgaatgatggagttttctgtctctatcattttcccttcctatatgtgccagaatgaattacgttcttgttgagcaactactagaggccatgcaccaagcaatacacttagaagataaggagaggaataaaacaggctccctgagcagaaagaatttattctctaaaggagaaaacagatctcaaacaaaaaattacaatacagtgtaataaaatccataaaactgatgtataaaagttgttttatgtataaaggaaagagtaacttgcttccctgaggattcagtggttatttgacagaggaagtaacatttgatctgagacataagggaaaggtcagggttcttgatttgggcaagaggatgagtcagtctaaacaggcaaagggaacagcattgacaaggtatgaaactgcacaacatcttcgggcaattttagaggtttctgaagcatgtgggccataaggaaaaagagcagaaagggcttacatgaattcaaattgggaagtcatgtgtatcttttaggggattcagattttattctatcgagatctattagaagtatataggtaagagaatcatatgatcgaatttgcatttcagaaatacgattattctggcattcttaacttttatgtttttaatttttaaaagataatatgcattattaacatatctacacctgagattagagttgaactaaaataaaattaggtgaatcatgtatttggaaagtcagatatacctatttatctttgatgttcagatattgtttgatttggatgcaatcttttaagaaataactttttaaaacatataaccaactctattcatttttaaacacagattaaatgcatcagtcttcatattaatattttaaatatgcggaacaaggtaaagtagtctcatctcgttttagtcaaccatatgttctgaaggccagaatcactgcatggtctacaaataatttttccatacttatgaattctcttatgtaatatgacttacccaggtgtacaaataaattccaattaatgatgtatctaatagactgtcatcattttgagtcatctaaccctatggtcacgcctaccaactcacaatatgtgaggagggcatatcactgcctccgaaactgataaatcttcaaataaagtgcagaaaccttaattaagaaattggtatatctattacttctctatgaatcatacttttttatatgatatgaatcaaagtttttttttggtacaaaagttgcaaaacagaagtgacataaattatccaatggttttggttacctggttgagaaaatataattggtaagaacctagaaacataaaaggtttgcttggataagtttaatattatttttaactatgcagccactgaaccactgtgactgacaaattggtttgtcaatatcacaagcaattgcaaagcgagatagctgttttcttaaatgctatcataaaactaggaagtgtttccaggataatttcagttgatgtaaaaataaatattcaatatacagaaccatacgtgatgttagtggatgcttatcaattattatatccaggccatttatttcatttatgttcatattctcaggaaccaaatttgtttatcaaattatggaaatatggaataaaatgccccagttaacctctggctcagaggataataatgttgctgggagtttataattgcagaagttttatccagattacaaaccagattgctaggtgcctctgtcactgtcaagattttattttttattattataggtttattttaattacaaccccctccttttattaattaagcatatgtttattaaacactagcagctttattgcatacaatatgcccattataggaaatttagatatttcaaaccctaatagagttcagcatttaataaacaagatataaaattgtaatatgatgtgttaagtactgtctgcatatgtatgcatttagaggcaactaaatcttaaaggggagattgtttacttatttttattgttgttgaggatgtaatatttaagctaaaatatgcagaggcataaaggaattaaagatgaaaagtaatgccatcaatagacacagaatgctcaaatgcacagagataatttcatactcagaagcctaagagaagaaagaagcaatgaatctgctgagtaactagagaggctgatcctaaagactttttcttgcttactaaataaatttggattatttcctaaaagtactgggaaactattgaaatattttggaaataacttagatttttagctgcgacattagacatggccagaaagggacattcaagagacagtgaacaggtaagtgtgaaagaacgtagtgaccagttgcaaggggtgggtaagcaagtaaagaggagataatgaggtctccctagtttaagacttgggtaacttggtaagtgatgttgatgataatattagagatacaaagtatagaaaaagaaatctctatggggatgatgaattctgcttaagacatgcaatatatgaagtaccagttgcatagcgcaactcagatttgctataaccataatttggagaatgtgggataaggataagtgagcctcctcctgtgaggctgttttatatcctgggtactgttgttcagctggcctatcttttgagcacatatgtgtatattaacatatagatatgtttatgtgtaattaaggaatatgtatctgtttataactatatacttggagccaagtatactggctggcactcagcaggaactcaataccaatatgctgaatgtatgtggggatccacccagtggttttccctaagaaggattttgctgactgtcttggtacaagttctcttgctttgattccaacttaaaagaaaagagctgactcatcattcagtattctctctctcatagggtacgctggcatcttcactgaagtatctgctaatctctttactagaacctctgttcacagtttgaagaggttaattttgcttcactcaaaattgaaatattttcctgtgaatctatccattctagcatgtcctttcttacctgtgatggtatagattttatcccaggagaaccttacaagtttatgtgatgagcattcattccaggaactctaatgctgtttccatttttatgaccaatatgctttgacctcctttctgttccagaacaaaaggagagcacagaaagggtggatattttatcataatacttcttcaaggccttgaaattgcatattgcctcctatatgctaccaaggcctatgctatgaatggaatctttactcttaaacagatcaacaacaaaaaccatacccagtgtcttgtacccttaaggcaaaaggcatcctgggcaatccctcaactcactttttgcacactcacaaatattctatctctcagtactaaagatttatcaatattcaactctgggacatgtgggaacacccatttatagatggtctactaaatggtccaccagtattcttatttagcttagtgtttatgtgactccatatatcactgcttaaaatttaatctttaggttatctgcagagcacatttagtaaaagaaaaatagcaatttgtcttttaactattattatgaataatgttgtacagtacaaaattaaaaaaagactgttttcataagctaatagttgttcttccctctgatctgttaataattagtcaatccatcattaatggcaaaggcaattcagcattcctccatgtgttgcacatgggtgtagacaggtattaacttagaaattgaaaatgtcttctgtggatctaattatgctgaaaatatttgtttataatagtccttttacacagtatttactgcccactttattttctttgttcccacccagaaatcaaaccacagaatttaggttggatagcatgttaggtttgggagctgttgtagtagttaaccagcaccctcaaagcattactcagtttcagcacatctagaagcataagcatcggtaattttggctaatgtatgtcagctgaactaagtaagcataaaaacatgtctgacatttaggaaaagaagagccacccactctcttacttaagtatatatattaataatgtttctcagcaatcatgttacacatgcacagtgacttctagcaatggagctttgcttctcgctcttgggttttcacgtcggctggggttgtgttcatgtctgctccatgtgcacttcatcctggaccagcagcttctccaggagtgctcttctcgtggcgatgataaacatgcagtgccctaggccaaatctcacaagtgtgagcctctgtcatgaaaactaggaaagggtgaaggaaagccagggaaatgaaattcaggctgtagaagcatcacatcccaggctgttatatctgcaagaacacagaaagttaaggagagtctcagtgtagttgatggtggcaagaaccagaagacagaggacaatgagtctcatgtcagaaaactcagaaaggaatggatggctaggctgtgcataaaagaagaacaacaacaatatcttaactgttatctccttaaaaggtctgaaaaattggaaaccagtctattaaacagaaataaataataacacagcaccaattactagtaacttaaaagatgtggcatatctttttagtatgctatttttaattgtttcagtgaatttaaaatatttataactactttaatgagttttattattcttttcttcaagttacttacccaatttctccttctaaatggttccttaatctcctatctcctatggtttgggaacaactacaaccttaggaaatcctctttattattctgacataaaattctttaggtcttattttgccatgcaatttttatatggctatcttattattccaattaaaatttaactttaagtcaggcaatgtgtgacatcctctatggtatctagaagagagctcacaagttaggtgtgaagaaatttctataaataagtatgtaccatatcaatgaaattcatgagttctgggatttgtaaattggacatctcaaatggaagaacagagtagatggctcacacccccttttcccattttctacattttctgtttttgaacaaaatcatcttagtttttcccagcatcagacattcacttgtataagattgaatttacaaaaaaatgagattcattcgaaaactcaggataaagcaaaattcaaggagaaaatgaaaatctgttctaccataaatccctccacaactagagagatacatattgacttttttggtagcagagacttacgtgacaggtgtttatgcctgaactgttccacagataaatggaagactttattctcaagtgatcctggcatactcatgtggaaaaagcaaaaacataattgaaagaacgttatttcattctcctattttggtaagttaagaaacaaagggaactgtttgtaactatttcttatattttgaaagccaggtgtgacagttgacattatttactaggactgagtttataaagcagacccaatagaggctgcttattcattgtgagacatcatgcctgcagctgcctccaggtaaatggtgacttgtcttacaatgcataaaccaagtagttaggctctgcgccaagcaggacttgaaaagacttatagaaagcacatggttcccattcagatgtgcttttattttttaaaaagtactaaaataattattgcatttattctttttatgttttatttttaattgacacataacaattgtacatatttatggagtacactgtgaaccataagagatagttaacataaggaggaatacatttaaataaatgcaatatttaggtctcatggatttttagaattgtaagcgaaatttaaggttgcttaggtaacactcttcattttaaatattagactgtggaagtcaagagggattaagaggttagtttttctcagtttaaactttattcccttccccttgttgcagattctaaatatgcgcttttcaaattgaggggcgaccacatcaactggctacaattgtcccctctgtgatttttgttgtgttttaatgctccaggctggatctcttctgctactttaaagatttcaaatgagacccaatgcttgagaagaaaatttgatgttttagaaatcattttcatttcttttgatgggaaaataatttctttatacacttaatttcattacctgaaacacttgtcaaagaatgactgaatcttataagacaattacttgacttagttgtttcaaggaaatctattgagttggaatatcaatctacatattatttgaaagcttgaacaagagatcctgatatagatccctatttaaaaagtactggttaagtccaacatccttttatcaaaacagtgggatttaaaatccaaagtattttttgatttttttttctttatggccattcttgcaggagtaagggggtattgcattgtggttttgatttgtacttccctgatcattagtgacattgagcattttttcacatatttgttggccatttgtatattttcttttgagaattgtctcttcatgtccttattctactttttgatgggattgttggtttttttttctggctaatttgtttgacttccttgtaaagtctggatattagtcctttgtcagatgtatagattgtgaagattttctcccagtctgtgggttgtctgtttactctgctgactgttccctttgctgtgcagataagtcccatctatttatctttgtttctgttgcatttgcttttgggttcttggccatgaaatctgtgcctaagccaatgtctggaagggtttttctgatgttatcttatagaatttttatagttgcaggttttagatttaagtccttgatccatcttggatcgatttttgtataaggttcagtttcattcttctgtatgtggcttgccagttatccagcaccatttgttgaatagggtgtcctttcccaacttgatgtttttgtttgctttgttgaagatcagttggctttaagcatttgggtttatttctgagttctctgttttgttccactggtctgcatgcctattttataccagtaccatgctgtttaaaaaaatccaaaaataatagatgttgacatggatgtggtgaaaagggaacgcttctacactgctggtgggaatgtaaactagtacaaccactatggaaaacagtgtggagattctttaaagaactaaaagtagaactaccctttgatccagcagtcctactactgggtatctacccagaggaaaagaagtcattacatgaaaaagatacttggacacaaaagtttatagcaacaaaattcacagttgcaaaaatatggaaccagcccaaatgaccatcaatcaatgagtgtgtaaagaaattatgagatagatagatagatagataggtatggaatatacactcaaccatgaaaaggaattaattaatggcactcacagctatctgaatggaactggagactattattctaagtgaagtatacaaggaatggaaaaccaaacatcatatgttctcactcataagttggagctaagctatgaggatacaaaggcataagaatgatacaatggactttggggactccggaggaaggatgggaggcgggtgagggatcaaagactacaaattgagttcagtgtataccgctcgggtgatgggtgcaccaaaatctcacaaatcaccacgaaagaacttactcatgtaccaaataccagctgttccccaaaaacctgtggaaataaaaaatgttaagtttcttgtgcgtccgtgtgaagagaccaccaaacaggctttgtgtgagcaataaagctgtttatttcacctgggtgcaggcgggctgagtctgaaaagagagttagtgaagggagataggggtggggccattttataggatttgggtaggtaaaggaaaattacagtcaaaggggggtttctctggtgggcagagtgggggtcacaaggtactcagtaggggagcttttgagccaggatgagccagaagtaggaatttcacaagacaatgtcatcaattaagacaggaacggccatctggatgtgtacatgcaggtcacaggggatatgatggcttagcttgggctcagaggcctgacattaagataataaaataaaacaaaatctgaaagtaaaattgtttgcccagtttttaaacaaacccagtagtagttttgttatatctagaattaccccatcactgtaaggctgctttgtttttttaatctcttttcctctgaacaaccctgacaaaaatcggatggaaactgacattttcctttctcaaccatgctcatccatgcagctttgacatctacatgaatggttaatatcattgattcttgttattcctgtatctattatgctctcacatgcaaggatcttcatgttctttgccaggattcccagaaagatgctccctttaatattaactggtcaattttgataatggagttgatttttctttaacgtttataatcactgtaaacttcttgacaagatggtgctattataacactgactgtttctgccgaaagaagaatgttcagtactaagacatttctgccaaacgttactacaactttgaaaagcccttcctctggcttgctaggaagctcattggagaccctaacttggagtttgttgccatgcctgcccctgccccactggaggttgccatggacccagctttgacagagcattataagcatgacttagaggttcttcagacaactgctctcccagatgacgatgatgacctgtgagaatgaagctggagcccagcatcagaagtctagttttatatgcagctgtcctgtgatatcagcggagcagggtatgggccaccttattattatctagctaggtggggcatgtggttcatctgtgggatgctgaaggagatgagtgggcttcggagtgaatgtggcagtttgaaaaataccttcattgtttggacctgcatattgagctgttttggaatgcagttgattccttcttgagtttcaaatgtaagactgctgcaatcacattagtgaattcaggggtgagatcttgttactgccatttctactccttttcatttagaatcagaataaagttgtatttcaaatatctttttaaaaatatatttacattatatgtgtatatatacatatatgtatatagtatatgtataaatttacatgcatatatatacatatatgtatatgtgtgtttacatatgtatatataaaatgtatataaacatatatatatttatacatatatatgacacatatatgtataaatatatctatgacattagacataatgtatttctatatctaatgtcatgcatatatttatacatataatagatatataaatacatatatattaatgtctacatttgacattacatatgcatgtcacttgaaaatttgtgtatataaaatatatgtataaaactcaattcaaagatatgtttccagtgatgggtcttgtcaatgtagacatttaaaatgatatttgggaattactgatgttattttaagagcttggtatgtcagagattttcaaatggaagcagttgctatagtaaatatggattttctcctaattaattcagacattaaaaagttactaattgcctacttttttcctaaattgcttctggaatataaatatttataatcttcataatattcccatctgataaaggttaggtttgatttcactttctttctaaaacatctgagcattttcaggctctaactccaaaagaacaaaactcgtgaagatttaaaatattttaatagattatattggaattccatttccattatattgaagttactttttccattgctatcatattaggaaaattaaatttatacatgttctatacttaaagttaagttttagaagtatcttttccctaattgttattgagaaattaattttaatacacttttcatctttccaacagactactgcaaacaaataataagctagaagtttagtttattccctttcctaaagctcttctataaatattgactccagcaatggaaaaagcaaaagtatagtcagcattctgtatcatatatgacatatagaatatagaataggctataccatcaataagataaatcagtgcctttataagaccaaatgagtatatcaatctcagattaaacaatgcaaagcacttcgttcaagtggcattttcaccctttcaaataactccactaaatatataatactcatgaacactaataaaataaaaatatatgtgttactcttctgtatatatctgtaaattgggctccaaacactacattttccatttatctatacgactctaatgaaagcatcttggcttaagaaaactaatagatctgaggtggtaaagtctttattattgaatcacagaactttgcctaaatgcgaagttctagcttcaagttaaaaaaatttataaatatttcaacatttaatttagatacagcaggtacaagcacaggtttgttaaatggaaatattgcatgatgctgaggattgcagtatggatcctgtcacctaggtagtgagcattgtacccaataggtagtttttcaatcaacgccctccctctttcccctctctagtactctgcagtgtctactgttcccatgtttatatgttcatgtgtgtccaatgtttagctcttacttataagtgagaacacgcggtatttggttttcttttcctgtgttaattttcttaggataatggcctccagctccatccatatttctgtaaaggacacaatttcattaaggaaggagggaaggaaggaaggaaggaaagaaggaagggagggagggagggagggaaatctagaggaatggataaattcttggaagcccacaatctgccaagactgaaccaggaagaaattcaaaccctggatagaccaatatcaacttctaaaactgaatcagtaataaagtttgggtctttcttaaaatttctattttgcctttcagctcttaaatgatattactggattgcttggtttccttgaattgaatttcaacgtttccctggatcttgatgtgctttcttgctctccagattctgaatttcatctgtctgtcattttattaatagttatttaagattgcttaagaaccattgctgaggaggtagtgggctcgtttgggggtaaggaggcactctggcttcttgaatttccagagttcctgtgctgattctttctcatcttggtgggtctctggtcctttaactgtggcagaaattgagtatagtcagttgacttcatttctggacattttcagaaggccacacaagactctgtgcaggggtttttgtttgctgttgaattcttgtccttggcttccaaggcgggtgaatggttttgtggtggtgtagtttggggtgcaatccgtagatggtgctttagagctatgggtggtagatggatactcagcgctggggactgtgtatcctcgcgtgtgcagctgtgctctgaagtgtgagggggagaggggtaaccccctcaccagttccactaataggccttcggaagccactgctgatcaccggcactgtgccgtggctttgtttgtttgtttgtttgtttgatgtttctggctgtgggcttccctggggcaggtgttgggcagggggatagaccacgcccttactgggccagctctgtggaaggaggcattccaggtgccacaccagcctgtgaacctgtgcatctcacccttctgagtgtgggctcctctcctactcaagttccgagcacaggtaccagctcagcactcctgagccataggatccaaccctgcagtgccagaacctgctcacggctccctcctctggactgggttgggttgggttctgggtgtgctggggatctaaggggccgcaggctgccagaacacactccagtggaacacagcacccaggctgggcagcagacgcttcactgtgcatgtgctgctgcggggcagccaggcaggagccctgggaggggctgacaggcaggcggggctgcgggacagatgtgcctcagtgccgtggggaagctcgccctgctttctcccagtccaggagttttctggggccagggcctctcagagggagatggagagccctgagagacgggtgcctatagctgggctctgtcagatctgttccacacacaaatgtccccagctccatgtctgctgaatccccgcctctatcaaatctcccaggagatgcccctgccagctcaaacatccattggggttttggggttccctgcagctaggatcccagaagtctgcatgagcgtgggctgtcccccaggctcttcactcaccccttcctcaggagccatttgaggcccggaatcagctttagcattcaggcacctcccacagggcttccagcctcctcttgcttcagccttagcatctgcgtgttttcttcatccacattcggtattttctctctgaagatctttttaaattacagtggtttagaggtggtagcggcccttcctggctgcctctagttggccatcttaaaactcctctcctgaaaagaaaatgttatggaaacatgaggagaacaaatgcctgcaaggaaatcaaaacagtgctgtgacaccattcagtgtcagctacacaaaagaccaaaaagtgaagctacctgtaatagactagaatctgttggttaaccaaatggtacagaggtcagtttacttactcctaactggtaaattcagtttataggtacagtgtttcagtgggacttaaatcatgtagttggttcagctttgttatgaggatcgtgaaatacctctgtaataatttcatttctgccttctccaaatatacatgtggtatatgtcatgtaaattaccttatatatttaagaaaccaaataagaagtttcgagcttggaataattcatgtgagctaactagtttctgattaaaatagcatcaggaaactgagtcaggcattttttttttcatttgccattccctgtaaattgggtattacatcgtgatcatgaaacttaccagtgaaatatgttctatgaaaaaaacgagaatacctgcaattaaataactcaaaatgccattcatttaaaacacatttattatatgcccagaattttcaagatactatgcaagacactgtcgggaatacagagatgattaacatgatgtttctgccctctctggatatgatcttcactaatactggttcattgtaatttccacttttattacctttcttaatgatgatattctcagtcggtgattttgaagataagcagatttctcgatgactatttaatgcataccaataatagctttatttttgttatgtctgggtaaagaaacaaaggtttatttcttttccttgacatttatagcatcctatgtatctgtgttccatgaaaggttacctaaatcacatttattccaaatgggcaatatttaactttaaaaatgtcaaaggaagggtacaattctctgtagggcaatattgaattggttgactgaatgataattatggaataatgcattatgcattctcttttcatttcaaatattgattaatattattgattctaaaactcatttaatctgttattcagtagaatcattgccatatactcacttaccttttaattttgatgttgataattaattgaatcaaatattttttcagagtcatttgtaacttcatggttataatttctcaattcatgttaatgtaagctttgtaagatatgccattgttcaggtaattatgtataattaggcacaaagagaaaatagttacctacctttaaaaaaaagccatcaagatttttcagttgaaaaattgagctaaaaacagaattagaaagatttcttggagctaaactcaaggatctaaaatgaaggatgagctcaggacattttgtaatttaatattggactcatatgcacgagttccttgcaggagctactcccactcctagtcttgactacaagggcaggtgagataatatctgcattgtttggtatatttaaaccctgcttctttaagtgttatcatttaccacaaaatatcgtaatataactgtcacagaaagacaaatcaagaagaaaggaaagaagaaagaatacatattgattgtcagcattaacacacaggctataatttgatgtaatattcaactctatactttatggcaaccaagatacacaagaaaacacaacatttacatagatcttctcaaaaagaaagaaccatacctgaagaaataaatgtgtcttgatggtattaaagtctgcactttctcacttgagtcctaaaacagggaaatgagcattattcccaacaactataataacatatttaaaaatggatttcttaaatctgatgacaaatgtttagaactaccatttacataagccaagtcctactttttttttttaacaaatcctttctcctgtctcctccagatgccattgccattttaaatttcctgactgacaatctcccaacttcccaaaaagtgtttatgaagtacctaagaaacaatttgaaacttataatgagatccagaactagtactgactttgaatccattgtatggagggaatgttattacctataaagcagatgagattagatttataaaaacaaatggggatcatcaggatgttgctaccagaaagagacccagctggcatagacacctgttagtaaaaggaaaaacattttgtgtatttcgtctactgacccccacttcagaaatgctcgatctgtataaaccgtacaactagacaggcattcacctggtggatgctgatattctgaagtagccagagtgatttctccaccctaaataaaactttcttccgaatttcattcagagatgacaaaaatgaggaagtgaagtgggatggggacatcacaagtgggacattgcatcccgggaagcaaggggactctgcacacgttgctgctaactgcagcggcacctgaggtggttctgaccgctgtaaactctgtcacagaattggggagtgagtatacatggagaaaatttgttttgagtacaatttcataaccagaaaatgatacagaatcatgtaaaacaccctataattcaagggcatcaatagcaagcatagggaactgattatgcctaaaacagaggcaggtcctctatattcctccctctgaatcatgtatgtcctcaaaaatgtcccatcagcacaaaaaaaccagcaaaccacagtccatcctgatagcctcctttttcatattaatagcagcattatactgtagtttttctgtctcaaaaactgaattttttaaaactttcattttcttccctatatctgattacttgtcacctccctcccaaactcccttacatatgtaattgtcttttcccatggtcaccatatccaagttctgattaccttttaataaaatgaatgaattagcttcaacaatgcaatttcttatccaggtatccattctttcaatccttcctaattttgacatacctgtagtagtttcaaagcacagatcacatcgtgacactcctgcttatcattttcaatactactccattgcaaatattaagaaagcaaaactgagagccagacaacacccaacagatattgtctctcaatccttacattcccatgaagaaaggatatatgtaataagagagaaaggaaccgtgacttagaaactctataaaatataatccacatagattatacatatgcttatggtgatattactatactgactttacggtgctttctagaatttagactctgggccattttggcaaaataaggagcctgcagactgcttatgcctttgaagagaaaaaagaatgtgaaagatgttatttttgtgatacatcaagagagaatatgataattaatattgtatttttattcatgatggaaataaaaataggcaaacactatatatgctgtaaacctttggagtactcctttgtcgcactgggaacatggtaaaatatataattttttcatagatagatcgcactataagagacaataataatggaaactgtcatagttccctgaaattcaagttgaaatactatttacatcaaccataccgccgactccatcataatgaggaaacatctcagggattattaatggggtaaatttcactatatagagaaaaaagacagataaaaacatgtatatgcccaaacttcatttgaaaggagggcatgtagggaaaggtagattaacagctgaacttcattagccatttacagaaaagttaaatattatatctaggatacatttgtcttaaatcacccaggattaaatcttccaagattaaggatttcatctaatcaatttcacctaattgaaatatgcagcccttctgctctttttttgtaactcctatattccctcctatcctttaaattatttttcatttaaaccattcagcagtttaaaccattctagactactctggcctgaagtacttcatcagaaatctttacactttagcttaaatattcatttaataatgaacaattcatcttctattaaatgctactactcaatttttgtttcaaactatatgtacatttcttgttaggcataattttatatatttattaattggtttcccttccaagacacagaacctgcccttccctcccagtgaaaccactatgaggtgaaaaatagtgttgaagaaggaagagggacacagagaaagaaataacttcacacatctatttaaagatggccctgaggtccacccacagcatcgcagggatgagttcatgagggagtatgcagccacaatacctcttaactccccatgacttccttgagcttccttgtgtgggagtagaaggttgatggaatggttagcctttcctggtatctgtgttcatcatggttctcagcagatccagctgcataaaatgtctctatctgttaggatcaataaaacaagctctctaactgctctataatcagcatcaatttgcgaacctttatcaaacttcccccctcttttcaccaagtattcaggatgacatgatgaacaactggaccaatgattggtcaaacatatcctaatatcaaatactggcagttacctggagtaaagaaggacattttgtgtgtccctactttaaacgagatccttaaagctttttgtatggctggtctgagtatttaacagaagtcccgtactcataaggatggctagacctgaaaggagcctctcacctgcagggtaatgattcggtttaatgaggaccttttggaagttacttggctctaaggccagaaagcctaactgagatcaagacataattgaataggaattgaagatccatttacctcatcagttggaaaataagcatttttcaaaatagagagataattaaatgtggtcccttcagtgctacggattaagttagtattatagttttaatatacatttcaaacagtttccctcttattctgtcataggacattgcaattaatttaatcaacctttaaacagacatttaccaagaatttatgataatttagatattgtgcagatggatgttcaatgactttttcttcttaagtcaaaatatttaaattcttcaaaatagaaaatgtgtaatatgtgctgcatattatatgcctttttcctctttcccagaatgccttttactagttttgtgaaataaacaagatagattatatcttatatacatatgtataatatacttacatacacacgtataatataatatttataatataatagaattatattctgtattttatataatatataatagaattatatattatatataatagaattatatattatatataatagaattataattataatatataattataattatatagaattatatataattataattatatattataatatataatagatatagaataattataatatataattatatattataatatataatagatattatagaataattataatatataattatatattataataattataatatataattttaataatataatatataatagaattataattctaaatataattataattctatatataaaattatagatataattctatatctataattatatataattctatatagaattatataatatataatagaattatattctgtataatacatacacacgtataatataatagaatcatattctgtcatcttttcacttcagtctatctctttctgtgtcattttactcctttacaaagaccatatcttctttaatcctgctgagggaagcaacttaaaaataactttgatatggtttggctctgtgtcttcacccaaatctcaccttgaattgtaataatctccacatgttaaaggtggaaccaggtggagttaattaaatgatgggagcggtttcccccatgctggtttcctgatagtaagttctcacgagagctgatggttttgtaaggggcttcccctctttgattggcactcatttctctctcttgctgccctgtgaagaggtgccttccgccgtgattctaagttttctgaggcctccccagccatgcagaactgtgagtccattaaacctcttttctttataaattacccgttctcaggtattgcttcatagcagcatgagaacatactaatatgtacttctagcttctgtagtcaatgatttctggatacatactcttcttctaacactttaagataatattcctttctcttcatttaaaaatatgtaggcaacttcatattcttctcttcaaaccaaaatataggggaaactgcatagacttggtgtttgttggtaggatggattgctttctgcttgcagtatgtgaagcccattcagggttgagggagatccagtttcagcacatgggtaggctaattcacgtaactcttacttcaatttctaatatccaaaagcaattatgtagcacaaccctaaatgggtaactgaggtgggatttttttgcttctgctcatatccaccatacttataaaaattgaaaataccttacgtctaggctgtatgatcctgatcacccacctgactataatacttacatgcagagaatccactaatttctagcttacccctcaactctatctgtggaaggcagaataatgccccatccgcccccccaccacgaagatatccatgtcctaactccaagaacctgtgaatgtgttgccttacatggcaaaagggactttgcagatatgcttaagattacagaccttgagatggagagattattgggtttatccaggtgggctgagtgtcatcacatgagtccttcaaaacggagactgtttattatctgtggtcagaaaatgataggtcaaaggaaggaggcagaagaaatctgaagtgtgagaaggactcagtctgttactgctggtttgaagacagaaaatggtggccaagagctaaggaacgtggaccccatttagaaggtggaaaaggcaaggaaacagtttcttacctagagcctccagaaaggaatgtagtcctgccaacactgggttttagtccagtctgacttttgctggacctctgacctacaaatgtgcaagataatgaatgtgtgttgttttaagccactaattttgtagtagtataacattctggagtttaagagtctgaatggatacttaaagatagaaagaaatgatacaacatcactctgcccctcttacccaaatactgtctatgccctaggaatggctaccctgattttctcattagtgcagtgtccgggtctctgaaacatggaggagaaaataatgcaagaataaagtgcctttgaccatatttaagctaagagaactgctctgttttatgacaaagtagaggaatttttaatttcttgatgtaggttatgttcgacctttagtttgaaaaaacaaaaaccgttgattaaggcagtagttattatttttaaattttttagtcactgtttgttagcatattccatctgttttggcaagttcattgtggaaagatgactctgttaggattaaggactccagataaagcaggggtctttcattttcatcagaagactgatcagggtgctggagttcaggggctagctgagcactcatcccaactgcagtgctgtggccttgtgattgtcatctaacctttctgagactccatatccttactttttaactaagcatactctgttaagtgccgtcttaagagtcttctagatttctatgcctgtaattccaataaattcattaattctttcaacaattatatagtgaacaattatatatcaaacttggaataacagcaaaaggttcttcaattttaagaaacaaaatattaagactagaagcttagttggatattgtggtatatgcgataaagaaaagtaaagaggatgttatgttcaagattattgaaagtggttagggaagtcctctctgaggagacaatattataatgaaacaagcctacagaattagaagctcccagtcttgcaaatattggaggaagaaaactccagacaaagaggaggctaaacacaaaggttttgaaataagattatctaccagattctaggaacaaatggttgacctgtacacccaggcttggcatgtgagtgagaataatattattataaacttagagtgaaaccagttgacccattttgttatcttttacagataaaattcaccaaaagggtaggtaattagtcttatcaaaatcggttttatttacaaatatgaaggatggaagagtgggcacaggagatgagagcctatattaagtagttggtaactcagtaaacaatggagtctaggccagacaaggagggagagaaatataggaaaactccagtggttttgggaaagaggatagattcaaaacaaaaactttaaagggttacaatgatagttatatgggtactagagtaagtgatcttgaggacaagaggcatttttgagaagaaaatgtttgaaatgaagatgcaagatgtgcccctgccccaggttgtgacaaaagtgaattgagtccataggaacaggtgtcagggatagaggatgcggttgtttgagggagggtatcaggacctgagaagccaaacttgatgagtcattttacgaagggtgacctgttaaagaatacccaggaacaggcctggagtagtcctgaaagagggaggcaggtgccatggactaagggaccaggaaggtgcacacaatctcacaagactccagctgccatcacccatgttcatttccttgaagaaatcatcttattccttaatttttccccaatatatagtttgagactttctgattctctttctataaatacaaagccctagagatttttattatctggtgatccaaccctttttggagtgactaatcaaaaaagcacatgacagtatgcatattttataattttggaaattactcttcctatttacatatactttggagtatatcacaactccaatttagtacattttgttattagataccagaaaatcatgagttcatactacagtccctctgctgccccatttccaacttaaaatagaattaccaacttaaaataggagaaacaagcttaaaatagaagaaacaagccatcacttaagtagatatagaaatatagttgataaaatttaacacctgtaccagataaaaatttagtaaactagaaatagagctttaccttagtaagagcagccattaaaaaaatgcatagtaaatgccattgtatatattaataatttcatttaaaattaaatatgtgacaggaatgcctactgaagttaccttcattcaatttttaactagagatccaagccagcatacttgtacgctgtactgattgaaatgacaatcaaattagtggaataaaaatgggaaaaaagaaaatgaactgtcattatttgctgatcataaaattatttacataggaagctactaaagaatacagagaaaacattataaaatagcaatggatcagcaaaatggttaatataaaattaatatatagtagccaattgcatttctataacaaacacctagaacacaaaattaaaaataaattatagcttaaaatatgtcagtaactattttcaaaatattttgaaaaggaaatggcagggaatatttcacaggtgggaatagtatatgcatgggacaatgagggcacaatttgaagtaagtcactataagccaagaagcttcatgataaagctgactttaggaaggttaacctggaagcaaagtaaaatagtttgagctggggggacagcaggtggcccagagagaccagaagccggagatccgggaaaacacatctccaaagggcacagaggcagagtgaatggactgaacaggagagaattagacctcacacctttcttgaggaaggtggatctcagtgcatattttaaagattagaattcacatagatatattattttactagaaaacattttctcatgtctaaaactttttaaagcaaaattacttaaaatctttggtaagttttaaaagtttagataatgtaaatgtttatatacttttgaaaagtaaactaagtattacctttaatatttgtaaactttcataacctatcactgatatttactaaagaagagagtttaacaacactgagaaatattccaacagaaaggtgaactgttttgtttttaagcaggtgaagtacaagaagtttgatggaggccattttacttaattaaaaacttcatcaaaatgctgttttcactatctgagttgtcagaatttctacaaggctttttcatattcagtcctttcaaaaatataaaatacttgaaggcagttctttatagaagaatttaaagttacatgtcaaatgtagctcttctttttttaattactgaagccatatatggtcaagagtaacttcaggctggccgcagtggctcacgcctgtagttccagcactttgggaggccgaggtgggtggatcactaggtcagtagttcgagaccagcctgaccaacatggtgaaaccccgtccatactaaaaatacaaaaattagctgggcatggtggcatgcacctgtaatcccagctactcaggaggctgaggcaggagaattgcttgaatccaggaggcagatgatctcagtggcctgagatcgtgccactgcaccccagcctgggcaagagagtgagactccatctcaaaaaaaaaaaaaaaaaaaaagaaagtaacttccacattaaacaagagaaataaaaacaaaagcaaagttctttgtctaagcaaagcctgttaactctaattaaccagctttgcacagctgtgatagtacagcccattaattattaataagaaaataatcaatattaacctcctcttttttattggtaaatgttttttggggtctttgtgttaatttgttattttttaaattactgttttaataaatttcattatagatgctggagtaattacattacctaaaaataagatatagtcatgtagcacattactttgaagagaaaaataatatttgtaactttattaaccctatactaagcacattagtttcatttttgaaccttgaaccttggtatttgatttgcagtcctttccaaatatttaaatttccatatttactctctattctttactaaactctactcattgccttagattgaaacctaagtatctttttaaaaaaaaacccttttatgtggctatagaacagaattaggaagtttgctaatcttgaaccttgctttcttaaatggtatttttgttcattctcttcctaaactttatttttttattatttctctgctttacaatttaataagccattttactggagcttcatactctactttctatatcatataatgggaatagttttaatgcttgtgaagacagcatgtattcagtacacaaagatgaaaataatttaatcatcttcatacttattagaaatacttatattattcagtcagtaactgtgactattgaacttatctcccaaggatattataaaaataaatgtgataagagctaaagaaatttttaaagtcatcaatgattcattttaatctaatttcatcactggaatttcttgaatgttgtaagagtttatgttagtgtgtcatctaatcatagttactctaactggctagcagcttagaacaagcttgaataaggttcaaactaacagtggatgactgccaatggttagaaaaaaaaaaaggaaacattaagctacttctaatctaaattaaaatacaaaaaaatcattaaaatctacttttattttatgtcaaaattgtatctcagatactctgatttttaagtcatcaatactgttttgaaaactggacagaaatagtcactggctaacagctaaataaagagattaatcataaataagcactatctttaagcagctcacagtctactaaagcctaattaagatttataattagaaagttaaattatacagcaaatctcagacttggaggagtcctttacaccatctcgtccaaccactccatgacacagatggccaatctgtacttcattctcgttagttgccttttcagcatgccagagctattcattgacatattcagccactttgttaaataagtgtgtgtgtgtgtgtgtttttccttacaagttgagtgaaaaattaaaatgtaacaaaatagtgtgaaagcactaatcccctattccctattttcttagtctgaagcttggtgcaaaggcatcaatatcacgggcttgggattggtcacagttgagttctgtgacccttctctgtcacagactgactctggggatagtctccatggtctcagaatggagattactacctgagctgcaggaggggaatgctacctctgcctgctaaaattgttgccacctcctattgtggctgaaacatggtacttgcccagtaaagtggtgcctactatagtttttatttctgtatcaagctaaacacaaagtaaataatctggcagtagtgatcagtgatgcattgtatttactatacattaagaagaatttgtaggtctttaaaaacatcacagggatgtcatctattgcaataaatgaaaatgggatatttaattacccattaaaaattattagaagaaagagtgactatacttcccaaatgagtattgataagcctgagttcctgtaaaatggcctcgggaagctttgccttcatagcttctacattcttcacctgaaatacaaatgtgggctgttcaaagatacataggaaatactttactttgaaactgaaataggagctggggagaagtgtttctctggagggactggatcgctcctaaggctgcccaacttgtgggttttccaatgcctgaggtctttaccatttaagtcgttggatttggattttctcttgctttaaatcagaattattttatctgaggcagacagaaaaattctcaaaattgagatgaagtttcatctgatgcattaagagagtatatagaactcttgtatacttatatactcttacagactcttgtataaactatggcaaaggattctttaagacagaggccaggtaaagaacaaaatgactgaaccagactgaaaacacagcccacaccagggacagggactagtagcatcaggtgcagaattccaatcatctcctggcttgtagaaattcaaattaagatagcaacaagtacactaaacagtaattgtgagtcagcacattaattggagaggaaatgagggaaggaaaagggaaaaagagagaagttggaaggagaagaaagaaggggatgggaggaaagaaaagaagggatcgcaatgtacttaaatgtccaaaacgaaccaaaaatgttaaagaaagaacatgttgggaaaattcaacacttctaaatgctgaaaacaattaacaatggaaatgtaaaatgcttggaaccaagtgatccatatctactacaaatcaaagctaaaacattggtactattgggaaaacgttggtaatgccagccatgtaaatactgtctatataaaataacaataatatctaacacataggggaggaaaaagccacttaaatgggcaaaaataccctgtaaaccaggaggacatctaaaatggtttatgtggggaatgttatcagctaaaacacttacattacaaaaggaaggctaaaaattaattatacaaatattaatcttaaaaagtaaaaaagagcaacaaaatcccaggaaaatagaaagaagtaatataaataagaacattagataaatgttaataaaaagaccaaaagcaaattatttcataaagaccaattggtataaatatattcattaataatcataacatctttagataattatttagcattatcaaataaagttgagcttgcacgtaatctacaaatcagcaactctacttcttttaggtatatatactagagaaattcttggatggaggcacagaaaatttgtatgaatatgttcatattaacattctccataataataaaacctggaaacaaccaaactgtttatatcattatactatcagcagtagaatgctaaataaattatggaataatcaaattatagaatatgacccagtgttaagactgaattaaccacaactacatacagaaatagagatgaatcttagaaatctaatgttaagcaacaactttaaaaaaccaaaattcagaatactaggaacactaggacactatttttataaaactcaaatgagtataaaacaaaacactatgcaatgatgtggtttaggtgtgtccccacccaaatctcatcttgaattgtggctcccataattcccatgtgtcgagggaggtacctggtgggaggtaattgaatcatggggacaggtttttcctgtgctgttctcgtgacagtgagtaaatctcatgatatctgatggctttataagggagagtttccctgcacaaactctttgtttttgtctgctgccatgtaagacatgactttgcttcttttctgccttccaccatgattgtgaactcgctaaccacgtggaactgtgagtccatcaaactctttcctttataaatcacccagtctctggtacgtctttattagcagtatgagaacagactaacatgtgcatatgttaaaacgacattttgaaagggaagagaaggaaaatattacatttcagaatagttattctgggtgaaagtgaagaagatgggaatggaaggagacactgggagcatcaatcttaatgcttacactaaattctcttgttgggtcatagactcaagaggatttgtttaattggtatgccatataatctaattattaataatatatgggttcttctgtatcaagtattacataataaaatatttttaaaggcatagaagatcttttctgttctgtgcctcatataaattatctcatttactttgaagcaaacttttgaggcatttattattgccctcattttaaagatgaggaagctgaggtttagagaagccaagaaacacagttcttgagagacatagctagagttcaggtctgtaccgtagccccttcctttaaccattacactgtctttctccatttggaccctttatagagggaagatcacagcactgacccctgttctcattggagtaggaggtgctgagagagctatgtaaaaagtacacactggagagtggaaaattttcacagaaatattgacacataaacttaggcaaacagaaggtagaaaagatgtttcaccaccaaaaactgtccacgtagagatgtggagagaaccaagaacctggaggatgtgagcacagtgggccttctggcatggcagaagcagagggaagtgaaggagggaacagcagtgctaaggatagaaatgcaggtttggtccagttgaagaaggcacttgatcttttcgggctgaccagtaggtcttaaactgtagtgcatattgttatcacctggcagacttgttaaactgaaggttgctgagccccattctcaaaatttcagactcaataagaatgagtggagcctaaacatttccattctaacaaatgctcaggtggaaatcactttgaaaagcaaagctttagggctggcatataaggaggattgcttttagaatgtcagtgatggtgaagctgtggagaatgggctggggagaaagaatgaacatggagagtatagttaagccactgcaggagctcaggtaggtctgaaacagtggtggtggagatggagagagagtgctgcagttgaggcatgtctgaagtctatgaacataaagtagtaaggcatgagttgggggcataaagatagagaggctcccaagctcctgccagaggtactgagtgaagagtagactcattaatcaatgcagggacaacagagaatcaactcaggtgcccatcaacggtagactggttaaagaaaatatggtcacaaataccatggaatactaggtagccataaaaaagaacagaattatgtcctatgaagcaacatggatgtagctggaggccattatgctaagtgaactaacctagaaacagaaaaccaaatactacatgttcccacttgtaagtgggaactaaacattggggacataaatatgggagcaatagaccctggggactgctacagcagagagagacggattggggcaagggctgaaaaactgcctattggatactctgctcactaccagtcacaccccataccttagcatcacactatatatctttgtaaaaacctgcatctgtacccctgaagctaaaataaaatttggaaaagaaaaataatcgatacataaaataaagagttatgctggctcacacctctaatcccagcattttgggaggccaaggcagatggatcacttgagctcaggagttcgagatcagcctgggccacatggtgaaaccctgtctctaccaaaaatataaaatattagccaggtatggtggtgcacacctgtggtcccagctacttgggaggctgaagtgggaggaccatttaagcccgggaggtgtaggttgcagtgagctgagattgtgccactgcactccagccagggtgaccaagtgagacttcatctcaaataaataaataaataaaatgagagaaaaaagaacaaacaaatactcttttcctccaagagggcactagaaagaggatacataatagtaacttttagaagagatttataaaaaatagagtgtgaattaattgtctctccccttggaaacaagagtttaacataaacaacatgggtttgcagatgtgtgtgggcaggatagggcaagaccaaggacagcatggtatcagtgaaggaaatgtgtaggagagtccagaaaacagcagccagttgagaagttcgaagcctgtcaaggaggatattttgatactatttacaaggtacttcacatacacgcatgatattttgtggcaggtaatagtaaggatgtaatattgatagaagagggagagctatgaaattgactatccccaagtagcaaacaagaattatagggtgaattatcctctcctatccctgagagaaagcaccagattgggcttctgtaaatgcaaaatacaggatgaaataaaggctcagtctgacagcggaagcttttggtttgttttctttggttgtccctcaaagtagaaagtaaagagaaggaggaagtagttcaaggtgcaaagatattctgaagtggagaaggaagaagtccacaggagtcatatgcagttaggtaatctggataagagcaaaagtaaactgaaatatgcagtagggtttgcatcatgggaacaaagaagattaatttgatgtgagtgatatgagctagggaaataatttaaaaattgaaaaaaatgtgaataataattgtagagattattccttttataaattgtgttaatacacacttcttttttaggggctagcatcacaaaattaccagaagcattgtgttgttttgccaattaaaggaatccaaataactccaaaatgattaattaccactttctgtaaatcctcaggtgaactcatttgcacagaattccctgcagttgtaaagaaaacagaacacttgacaacttgtcaggcacctacattcttttttccttttatttattaaattcttttactattacatgttattttccacagatgttatgtgaaatttctctcctaagcaaaataaataacttttttaagaattagaaaatctaaaggacaaaattttatattataaaactatacatagtattttattttgctggcataaatgcaaataatcatcttacagaaaaacattaatattacgttttgacttctttccacatgacatctacaaggcaaataacattacaaatcctcagtactttctaactgatatatggaaatagtgtggaaaatcacatgtagaattacatgtagtatgcttgtaatactgatttcctacaatgtacagatagggtaatactctgtccttggaactttgctgagaaagtatcaggaaacataacaggaaacatatcagaaacaactaaatggtgatttgtactaacattaatatattgtttatatataaataactctatacacatctctaagtataaatgcacacatctgtatgcatacatttattaacatccattgatataccacaaaaagtttgattaatcattttgagaaatacattaaaaaagaaacaaaatttttaatcttctccttactctatgacttccaatcttgggctcacattaacaccacttttttttgttgttgttgttgagacggagtctcactctgtcgcccaggctggagtgcagtggcgcgatctcggctcactgtaagctccgccccccaagttcacaccattctcctgcctcagcctcccgagtagctgggactacaggtgcccgccaccacgcccggctaattttttgtatttttagtagagatggggtttcaccgtgttagccaggatgatctccatctcttgacctcgtgatccacccgcctcggcctcccaaagagctaggattacaggtgtgagccaccgtgcccacccttaacaccactttttgaagatatctttaccttcaaggggtatttgtatcccaaatatattcagtccattgtctggcacatcatctgtcacatatagagctgcaagaagctcttccagtatcctagcatcaaaagaacattctcttcatgaccatttcactgcacctcagaaaaacaagaggccgaattcatcttcctagtcatgttgtggtgtaattaaatttaaaggaatcactacttatgtaatgtattttttccctttaagttgtctggagtaagttttggagaaacttgcatgataatatcaaaacttgttttcttattgtgttcagaaagcaaaagagaaatattaacattatttttagccttcttgtgttactggaaccatgtcacagaatgagagtttctctgggaataagatgtattgcaatattctgactaacagaatgtcagagtaagaaatttttatcagttgttctttgggtcattgtcacacatcatctgcatataatttccatagcagtgaacagtgaatgtgacattagcttcgcaatggtgttggcttgagggctggatataccgatgtgcattccagtcatggcaattcctggagaaaaaaaaattaattataatcattttgcataaatcaccatgaacaatgaggtactcatcaccttgtcagttagtttgcagcattcagttggctggcaaactggtgactttatgaagcattaaactatgtcaccgttagccagattaaactcactgtaacattatacttacataaagtgctttgtgaaggaaatatgaaaaatgttaactgaaccgatctcagaagacaggaaaatgattgtgatataatgcttgggttgaatattgtcactttcctggtgtaagcccattatggtttccaaaggactatattcaaataataagaaaaaagtcaggactctaacttggaagatgtaaagacatatatatattagatgaaatactctaaatgagaaagaaagaaaagaagaaaagggggctgtaaaatgactcaccatgtacagtctagaatcatagagacagggtgggagaggcccagagagagttgaagggtccagtatatttcacccctcagattctgtggattagaaaccaaagtctggagaaggttaagtgtctagcccaagacatagctagaaggtggtgggtccctaacctcgaatatagtatattttcacaggagcctaaatgaaatggaattcagggagtaagataaagaccagttttcattaacatttgcgttaaagttaaatatcatttttatgagaagacaaaagtaagatcaaatcctgaagtcaaagtaaataaccctgtgtaaaaacgcaaagttcatgggctttacaggctgtgctcacaagtctatgaccactgcttggaaggaacaggagtggaggctgtggcttattttcctggtggcatgtggtatgagccacaattttagtgaaagggtacagtcatgtcttaggtctctggaaactgcctaatgatttgatatcctggagattttttctggtctgctttatggaagacatttatatataggacagtgaaaaacactatttctggaggggaaagaacaatacggttaagtctaggttttctatttcttcttgagtttgttttcttttttgcttttagatttctaatcagctcaaaagatctccaagtctccaaacccttcacgaattaaaaaaaatgtaaaccctacaaatttcttaactccatctgcataacactgccacagatagaaaagtgtaaacaagataacaagagcatgggcaactctgtttttaaaaaagcaaaactgaattttattccagaagattctgtcctgtcctgtttgtaagctacgctgccaaaaatgagtgccaacactttgggagtggggagtgtatattgtttgaggtataaacatgattataatgtacaaaaataataatttacaaatgaaccacaatttctaaggttgcttcatatatgtcaattagtaaataaataaatgcataattaaaagaaaattgaagtaaaatagtcatttggtctcagcaagactctcaacaccagccaaagcatgaaggaagtaatgtccttttctctattcaagctgttacagctttctccagtggtcggaaacattttactcttcaccttctgataaaatcccagtcagctgcctttccctggtccgttcctccagcctcccatgaagaagtgatccttctcttttttaataccacttcttctcctctttatgtcttttgtcacatatcactgaaattttacccaaggactataccctctttctcctaaaagttccacctccctacttctatattctgatccattagttctcagtgtggtcctgggaacttgttaaacatgcaaattatctggccccactgcaaacctactgcatcacaaactctggggtacagtccagtattctgtgttttccccaccctctccaagtgactcagaaacaggctaacatttgggaaccacagctctaatatattctatcttaaagagaaaaaaaaaatggtactgcagccctgggtttcccttctactttccttcttccctgaactgtcaaattcctcagagtacttgttccctttcctttctcttattacatttgttttccaactcactggtcatactcagtgtcgtttggcattttgaggaattacatgttcggattgatttttgtgctgccaaataactacaatgctttctaaagttggaaatacagttgtgactagtggatgattagattcttctttgtagctctatttgactgtaatgggcgcaacttactggttttaccccagactagtccagaaaattatttagtgaacagaattgtatttttgcagtctaccaattatatcactagatatcttggaaaaaaacgccttgcaaagtagtgatagctggacaacctgggttgtgatcttggcttcttcattgtgtgacaataatataatacttaattattcttcacaataatattagtagttaattactcgttgctattagtaattattttgcttgctcacaaaattcaaggttattcatgtatttttctatctaaagcctcataaagcacagtgaagtatatttaatatcaattttcagataaataaatggaagtttagtgctattagggaacttgtccaagttaatgtagctaaaagtaggcaatgagctggatttccaaccaaggtctgtctaagcctgtcgaacaggctgctaatgaaaccttctgggaagttgttgtgtagattattctatttatgtattttattagttcattcaaaagcagtgttaagcctctgctttctggggtgcactaggctaagccctggaaacacagagaagaaagatacagcccacaaggaatcacattctggtgaaacaacagataactaaactatttaagtagatttttgtaagagtcatgatttagaggcacacagagcattgagggaacatggagactatatgaggtacataacctgggatggggagctcatggaagccctgctagggtcagtgaccttagtgttttgttagagaaacaagagccaggaaataaattgaatgaaaggaatgtaggaaaggaacctcagacataaagaataccagttgcaaagcaggagagagtaaataaataggcagaggtaagattacaaaaacttccatgcccttcaaaggaatcagaatgtctagaaggcaagaggaggagagtagggatacttttaagacaaaatgagagttagaaatctcataatgacaatactgtggaaagtggatttaagcattagaaggaatgaatgccaataattatcttagattgttttttttttcttctaaaaaaaagtggggggagatacatgtgcagaaggtgcaggtttgttacatagttatacatgtgccacggtggtttgctgtacctattgacccctcctctaagttccatcccctgaccccccaccccccaacaggccctggtgtgtgatgttcccctccgtgtgtccatgtgctctcattgttcaactcccacttatgagtgagaacatgcagtatttggtttttggttcctgtgttagtttgctgagaatgatggcttccagcttcatccatgtccctgcaaaggacatgatctcattcctttttatggccgcctagtattccatggtgtatatgtaccacattttctttatccagtctatcattgatgggcatttgggttggttccatgtcttttctgttgtaaatagtgctgcaataaatatacgtgggcatgtgtctttatagtagaatggtctctattcttttgggtatatacaaagtaatgggattgctggatcaaatggtatttctggttctagatccttgaggactactgtcttccaaatggttgaactaatttacactcccaccaacagtgtaaaagtgttcctatttctccacatcctctccagcatctattgtttcctgactttttaatattcgcccttctcactggaatgagatggtatctaattgtggttttgacttgcatttctctgatgatcagtgacgttgagctttttttcatatgtttgttggctgcataaatgtgtttgagaagtgtctgttcatatcctttgcccactttttgatggggttgtttgttttttctggtaaatttgtttaagttatttgtaaattctggatattagaactttgtcagatgggtagattgcaaaaattttctcccgttctgtaggttgcctgttcactttgatgatagtttcttttgctatgtggaagctctttagtttaatcagatcccatttgtcaattttggcttttgttgtaattgcttttggcatttttgtcatgaagtctttgcccatgcttatgtcctaaatggtattgcctaggttttcttcaagggtttttatggtttggggttttacatttaagtctttaatccatcttgagttaatttttgtataaggtgtaaggaagcagtccagtttcggttttctgcatacagctagccggttttcccattaccatttactgaataggagatcatttccccattgcttgtttttggcaggtttgtcaaagatcagatgattgtacatgtgtggtgtgatttctaaggtctctattctgctccattagtctatatgtctgttttggtaccagtaccatgctgttttggttactgtggtcttataggatagtttgaagttaggtagcgtgatgcctccagctttgttctttttgcttaggattgtcttggctctatggcgtcttctttgattccatatgaaatttaaaatagtttttttttctaattctgtgaagaatgtcactagtagtttcatgggagtatcattgaatctataaattactttgggcagtatggctaatttcacaatatttcctatccatgagcatggaatgtttttccatttgtttgtgtcctctcttattttcttgaaaagtggtttttagttctccttgaagaggtccttcatgtcccttgttaactatattcctaggtattttattctctttgtagtgattatgaatggagttcatgatttggctttctgcttgtctattgttggtgttaaggaatgcttgtggtttttgcacattgattttgtatcctgagacttggctgaagttgcttatcaatttaaggagtttttggtatgagatgatggggttttaagaggagccagctatctggattctagattttatgggctaaatggtgtctctcccaccacaacatttatattaaagggagcttggtactctaagccccagtaactcagaatttgactgtagtgagagatagattctttaaagaggtaattacgttaaaatgaggtcatatgaatatactgtaatacagtaaaactagagtccttataagaaggggaaattaggacacagacccatacagatgaaagaccatgtgaagacagggagaaggttaccatctaaaaggcaaggagagacagtagaagaaaccaaccctgctcacaccttggtcgcagacttctagcctcaaaaatcataagaaaataaatgtctatggtttaaatcacctgctgtggtgctttgttatggcagcccacaccaactaacacacaaaactgaaatttcatattttcattgatggctaccattttagatcagaatgacaactatatgctggacagattcttctgtagataacatcagacccacctagcaaatgtgtgctgaatttgctaaaagtaaaatattagctaggaatggaccatgttttcctttaatacttttgttaagacacaaacaccaaagactttccatttttgccactgtcttttctaaaggatgaattagtatgatataaagcatttgaagccttaagatgaaggaacactgcattaagttcaatgtaatcttcactttaaatctcttcttgagtgaagagtgcaaacatgcatccctgcctgaacacaaaggaataaaacctcgcctaagcactcctgacagtctttcatgcccacttgagaactggtcatctggaaccagccatccctacagctaccagaaaatacaacttcctctgtcactttcctgcagtatcacaaattacagaatggcacaagcgtgaaagagcaactactgaatgacgcgaaaaatatacagctaagagtgtgcaggcgagtgcaatggtgaggctcaaaagacttggtggagggtaaaacacagtgtgatcctcaagatttgccaccacagctgacttcctaattactactatactgctgttgaggcaggagaatagggtctggaggcagggaacctaaggctgatttacgcggacttctagaactaaatcaaaaggaaaaccccaactttccacacctaagtaacaaaaggactggaggatacgccctttgcaatcccccctccttttctgtgtggcagatagaaaattgaaagtatctctgattggttgctttctgcaaccaatcagatgattgcataggagtataactttgtaacttcacttcagcctctgattggttgctttccacaaccaatcagactagttgcacaggccactacttcatttacgtagggtatacaccaagtaaccaatggaaaaacctctagggggtatttaaaccccagtaaattctgtaaactggcccttgagtccctatgctcgggcctgcccccccgccccccgtggagtgtactttcgttttcgataaataatctgcttttgtcacttgattcttttcttgctctgtgtgtttcgtccagctctttgttcaaaacgccaagaacctgtacatcctccactggtaacactatctctgaataagataaggagtaatattagagctatcgttaataatataaataataggagatctctcttgccggaaaaaaggggaagcaataggcaagaaattagacaattcacccacatctacgctgctattaacaaaccaatgaacaggtttttctcagaagatggagaatatccagtaatactctgcgtgaattagaacatttggtgtgattaactgatttttgaagtgcacatattttgcctgactcttctaacttataaacaatgtctaaggatattaaaacattttcttcaatagctttatattggtttctaagatatctttatgaaaatatttgttttctaagatgttgaggtaattcagtattctttcagtaacttttgttttttctttaaaattgtccaaaaattttgagctctaaagtttaaaatatttgaagacttttgcagaaagtttttactaagacttaagcaaaagcgacttcagaaacttggtaatatggtattgcatgcctaaatacttgaaaaattcctatgattctttaaaaatactttttgaaagttcatgcctaaagacaaatgaaaaacttgattatttcaaaaacttattgataaatctattttactttaaaaatatctatttaaaacgtttatttataaaatggaatatataaaatgtgttaacactgcctaaagaaaagctttaagtaaaacttggctaaccaaaatgccagcatagttggtttccaatatcctttttttttttttttttttttgagacgaagtctcgtaggcccgggctagagtgcaatggtgtgatctcggctcaccacaacctctgccacccaggttccagcaattttcctgcctcagtctccagggtagctgagattacaggcacctgtcaccaggccaggctaatttttgtatttttagtagagacagggtttcaccgttttggtcaggctggtcttgaattcctgacctcaggcgatccacccacctcagcctcccagagtgctgggattacaggtgtgagccaccgcgccaggctggtttccaatattctttgttgaaattgtctgttgttgttatttggaaacaaagacaaattgcaatttgcggattttaccatcactgctgttttgttgtttaccaaacgaactttaaatttactttctggaagcttactcagatgcctcctaatcctgtacattttatacatttatagtaattttcagtgatagtttgtcatatgaataatgaacctaaaaccctgaatcatttgtatttatcaaggaaagactactataaattcattgaaatgtctttattacaacaagaaactgcaacaacaaacttttgaaagatttataggaagaaggaatgggtgattgtggataccagagctgagccagaatttaacaagaaagagcaatggcctggaatattgccctctaactagctaatcaaaggacttttttttttttttttttttttttgagacagaatgatgctctgtcacccaggctggagtgcaatggcgtggtctcagctcactgcaaccttcgcctcctgggttcaagcaattctcctgtctcagcctcccgtgtagctgggactacaggcgcacaccgtcatggctggctaattttttgtattttattagagatggagtttcactgcattgcccaggctggtcttgaaccactgagctcaggtaatgcacccgccttggcctcccaaagtgctgggattacaggcgtgagccaccgcgcccggccctaatcaagatcttagcatcatagcatgagttaagggcaaatacaggttctcctcacagtctaagggctattaattgaataattaatagtattaaaatttcacagcaagatgccctatgaaaataaattcaacttaagtgatagatattaagaaatgcaaaactttcattttcagataatatactatgaaagctaaaacagtatactacgtttcaaactcatttagtaattattcaaacatataacaatctcctgctggtttttaaatggatgttttacattatgtgccttctcttcaaatgtggccttttctaagttttgattgaatagaatgggtttttttttttcaagatcaagtctttttgtagggcttgttgttgttttttattgctagctaagtggttccttggagattgtggatgaatattgagattctttagagaaatgaagttcgtctgttacaattacactggcatgcttccttgagaaaagcagaggatatacagaaacatctaggaaagcctgtacatttttgagaagttagaaaattagttcccgattttcttttcttttgaaaaaaaaaaattttgtttcattatctcaagaaatgtggaattagctagagagggttgtcttatttttaatttgaaggagtggattcaagtgagaattaatataaacacatgctaatagggctgctttatgcttatgaggggcaagttcttcaccttcagccacactcaggcacaaccatgaagtgggttgagttggctctcagatcctcagccagtttccccctccccctccccctcctcctttctcaccacttgctgtaccctgttttcttccctctggcacctggtgttctctttacccactgctgcttctcccctgttgctccagagacaaccagtgctcaagaaaaaaaaatagtaaatgacttccatgaaagcatcttgaaactccggtttagacagagtaatgccaagacttgtgagagggctgagatttcactctgcttacaaaccaacaagcttgctaactcctgcaacagctccacggatgctggcagaagacatggcttctgggtctgggatgaaggacagcttattgctcgtagcaatagtggacagaatatcaacattttcatggattccctgagccctaattcagagggtctgcatacagcagggtggatttcaggagagaggtctcaagcttaggaaaccacaatcctttaaaaaggactgcaaccaaagctgcccaacatacaccccagagggacattatctttgttctagtggacagcaaatacaccttcattctgcacaggcagacgccaccatttctaccttccaaagtggttcactataaaaagttttttagaaaatgtccagaacaaaagatgattagtgtctctgctcacaagggcagaaaagcaacagactcatggagaagtctctcccaacatgcatatgttctgtgtatgcaggagggaggaattcatgggtgtaaagttaaaatagggcattctataaagcctacccaataaaataatgtaatcttacatttgtatggagaagagaaagtcttcgttgtttttgtctgcttgtttttgtaagatgaactataaaacataaagctcaaaaaatgcatggttgagatgtgtatgtaattgaagtattttcaactgagggtcatgttagtgttttaatattggcatattttagaagagtgaagatggatttaaaaggtagagaaacactggcttaatcaccgattatccacagggatgtttacattcagtggaggctaaagcctaattctaacatgatttcagtcatcggccaggatgtggggcagtgttttgagggtcagagagaggccttttcacagaaattactccaaaagaatggaggcctactctatatctaaaacattgtctgaataatgaacacaataattaatttgcttacattccttttaggaaatactgaacaatttctttgaattccttcagggatcttcgatatttattatacacatttcagtaaagaatgttaaaataagtatccctgtcccaaacacccagtctgtttctggtattttgaaggcgtgaatgtctcattaaccgagacaatgggaatgatgctaagaaaagctcttttttatttaactctcatgctcagtttatttttattctcatagttattatattctttagaaatattatatcctggtttctgcagttacactacttaagcaatgtcagtaacacagtcttctgcatagctccttgttagaaaaaagcttccctaatgcacagacataggagagggagaatcaaacagtaacacctcttgacatcctcaccagcactgtcactgggaactaattggaagataaactcggagaagcttattaaccctcctaatgtggataggaattggataggggcagggtgatagaaatcagtgcagggcaaaatgtgggtgtccctttcactttcacagttcagtaagatataaatactgtgtcatttttgttttcttgtttgctttttatttttagagatagagggagaaataatctagcattgtacattaaagtaatacattagaaaaggaggaaaactaatacaatatttttcctgtagcaaaaccccagaaatgcaaaaagacaagcaaaaagcaaggacttgagcttacacaatagaacgaatgtcctttacataaaatgttagcatatctgtaccaataaactaatttctaaccataaatatttgcattacgagaataaagatgaaaataaaccaatactttattaaatgggggtaagaaaattctcaagatagaatgaaagaaaaaatagtaaagataaaagtaggaattaatgaaaaagaataaaaattaattctcataaaagacagttgccaaaataataaaatagtctaacatccaaaatcgggctagcctgatttaaaaaaaaaaaagaaatctaaatgctccaaaatagtgatggaactacaacatgcaatctgaaacagtagagaaaatgaagacacaatttaaagcatgagaaaatgaaaataaatggtaaaaagtatcatgcacaatgagattatgcatgattcttttacaaatctgaaaatgtgtgaaacaagttattctgaagggaatataggttgccaaaataaaataaaaaaacatttatagatgaagaaaggtacagtatcaaactgtccattaaccattgatcaaaaattaatgtcctctaagagatattaggagaggccccaagaatgatagactggagtaggaaaatgtggcacatatacaccatggaatacagccataaaaaaacggatgagttcacatcctttgcagggacatggatgaagctggaaaccatcattctaagcaaactgtcccaaggacagaaaaccaaacaccgcatgttctcactcataggtgggagttgaacaatgagaacacatggacacagggcagggaacataacacaccagggcctgtaggggggtagggggctggggtagtgatagcattaggagaaatacctaaagtataattaaaaaaaaatatatatatatatagtcaatctttcaaggaatagatcaatattgttatggacacatttccagactgtagagaaatatgaacaactcttatgttcaaatattccataagtctgattcttacacatgataaaatctgtctaccacaggaaaaaaaaaagcttcaagccaaactcatttttgattatagatgctaagattgaaataaagaaaaagtaagttacattgagctgtatagacatataaaatagcactttaatacattaataggtaaacttagtttgcaaaattatttacattgacacaaaaagttatttgataaattcaatactcatttctgattaaaattttttgtaactgaggggggaacacttatttcatttaatttaatattttaatttattttgggatggagtctcactctgttgccctggctggagtgcaatggtgtgatcttggctcactgcaaactcggcctcccaggttcaagcaattctccccagtagctgggattacaggtacccaccaccatgcccagctaattttcgtatttttagtagagatagtgtttcatcatgttggccaggctggtctcgaactcctgacctcaggtgatccgcccgcctcggccttccaaagtgctgggattacaggcatgagccaccacgcccaggctcttaattttaattttaattgtctaatgacagaaaccatgagaatagtccagaaatacttcttagaataacactttaatacacatagattcttgatataatttaaaactatattattaaagtaaataccttccaatgtttgcttttgcattaatattaccatgggtatcaagatagtactattgaaacaaaaacagaaaaaaatataaaacagaattcaaatttgcaaatgatatggaagctgaactatgtatacctgacactgatagttgcaatgctgtatcaagagtttccctgataagctctactactaattgtaccagctagaataaaaagcaacaatagattataatagcaaaatgtaagaaattagatctgataattaacgtagtagggaggggatgtgaagatatgttgtttagaataacttagtttttctgaaggacgtaagatagcttagaaaattaaaaagaaaggttgtgtcataagagtgtgtaatgtaaagctcttaactttccacaaagtaattattatgtttaattatattataataaaaatttcaaaaagactttttgaagacaaattgattctatagttaatctagaagaataataggatgatatagattattctgaaagaaaataagagagcagcttatgccaatatatatgaaaaaatatatgcatatagaataaatgtaatagtaaggaattgaaacaaaaatagaatagcatcaatcaataaaatagagtccaaaagtatgtataaaaatgttgcatttaaattgaagatgaaattaattatttaatacataatcctggaagatgtgtttcacaatgaaggggaaggtaaatttagattatttgctcaattttccaaagtacttagcaaatagattaaatgtgtgtctataaataaactggaaaataaacttatcttaataagcatttgttgggtctcaagatgaggaacaccatgctatatgaaacagtgaaatccatagtaaactccatgaaaggagcaattaaacacaaaatcaatttttaaaaaaatatttaaaaaccacaaatcagtgtttctcaatttgggtttctaggtacctagtgttgatgatttatatttatgattttataggtaatgtaatgtatcaatattgcttcattaattttaacaaatgtaccacgctaatgtaatgaataaatattaggggaaactgggtgcagagtatatgtaaatctaaaactctcttaaaataactcattttaaaaaatggaaaatgttaatactaagcaattcagaaaatctattacaagtaatagaaattgctaaggtaagaaaatatcattaatctcttcagcatgaaacaaatgtaccaataagttgccttgtttaacatattaaagtaataaatgggtggatttatatctgggtgctctattctgttccattggtctctgtgtctgtttttgtgccagtaccatgctgttttagttactatagctttgtagtacactatgaagttcaatatgaattcaggtaatgtgatgcctccagctttgctatatatatttcaggaccttttgtggtacaaaagtttttgggttacatgaatgaattggatagtgatagtctgatattttagttctcccatcaccagagtagtgtacatcgtattcaatatgtagttttctatctctcattccccccgccaccctccctccttctaagtctccagtgtgcattataccactctatgtctttgagtgcccatcaactttgttctttttgctcagggttgctttggctattctgggtattttgtggttccatatacactttaagattattttttctatttctgtgaagaatgttattggtactttgaaacggattgcattagatctgtagattgctttgagtatggatattttaacaatttgattctttcaatctaaaaacatggaatatctttacatttttgtgtcctcttcaatttctaatataatattattcaactatgaaaaagaataaaatcctgtcatttttaacaaagtggatgggaagtggtgaacattatgttaagtaaaataaggcagacagaaaaagataaagtagcatgttctcactcttatgtgggagctaaaaaaaataaaattttaaaaaaaaaaaggaactcagggtgatagtaagatgatacttaccagcagctgggaagggaaagaggagaaggtgattaagaagagttgcttaatgagtcaaacatacagttagaaggaataaaaactagtgtttggtagcacaataggttgactatagtccacaattaatttattgcatatttcaaagtacctaaaagagtggaactggaaagttcctaaaacaaagaaataataaatgcttgacatgatggatatccctattaccctgatttaatcattacacattatatacttacatcaaaatttcacatttaccccataaatatgtacaactattatgtatcagtaattaaatatttgaaaatgttcaaggaagcatgcttataattatcctttaaatctgtatatgtaaactcttcataataaagactaatgtagaaaaaaaagaaacgtaaaaacttcttctcaactcatgcttacaagcttctttgttaaacacttccattcactgaaagaaacaacacataaagcaactttaaagaagtatgcttagatttactttttaaacctgtataaaaaaaaaaaaaaagtaggaccaggcacagtggctcacacctgtaatcccagcactttgggaggctgaggcaggcggatcacttgaggtcaggagttcaagaccagcctgggcaacattgtgaaacccaatctactaaaaatacaaaatttagccaggcatggtggtgtatgcctgtaatcccagctactcaggtggctgaggcacgagaatcacttgaacctgggcagcggaggttgcagtgagtcgagatcgtgacactgcactccagcctgggttctctatctccaatgaataaataaaataaaataaaataaattagcagaggcttttaaacacctacattacacagtggcattaatgtagggaaggttacttttatatattatagtgttaataaagtatcacacattttctgaaagcctctttggcaatatatatcagaaaccttaaaaagattcctattttttgactcactcatttttgtaatctacctcattaaaacaatcataaaaacaaaacaggacttaacttagatggttttatttatgactatttattttgcttcggattttctcagaagaccacaaacccctctagatattttaaatagaatgagatacaatacagagaatcagaagcttacaaaatcatcagaactactggtggagcaaaggtgacggaaattactgctcatttcagtaaatcagaaactggggaagttacagaaaactgttactgatctcatatttgcaccaaggaagtgagttaatacacctgcccactgcagtccctagagcaatagtgacttccttcactccaccttcaaaattctgctgaaatgcctctcgttggcagaatttaatgtgaaaaactgttgtcaggaactctggaaaacatagttctctggctcccagccttttaataaagaggaaaatataaatgtgtatggggaagtggtggtagtggcactgtactgttaacaaaaaatgcaagaatggaaaaaataagtcagcaatttaaatgccaatactcttcagtggggaatagtttactacattggagtattcatttgatgagattgtatgcagtcattaaatatcctattctgcaatacatgataaatcatgtatcattatgttttaataaaatgagaacatttttactattaattggatgaaaatgtagttcataaagcagtagagtacaaacctactttattatataatatagcatcattctattcaagttcaactttatagtaaaactaaagattttctaaatccaaaattcaattttctagacatagttctaaaattccatttttaaaagtctatggaaagaaaatgaagttctgttaaggtatatgtagaatacctggaaaacaaagttctataagtttttttagcttaatgtaacattaagagcccataatctaaaatattacattgtccagtgatattgtcatgtattctagttgtagttacttttaaaataaatgctaagttggaaaagaaagcacattttttatggctaggttttgtaataaccaggtgactattctaaagatctcattcacttataaaccataaaattaaaaaatgttttctcaatggccataatagtggagaaataggttgcttttctccagacatagtgctttgagtctgtacttcatgaaatatcatctgtaatcatctttgtacttacgaaattatcaagatgtaattatcaagatggacactatgggctattgttggatgaacacgccttgacaaacagtcaatactttaaaacaaaacaagcagtacatgaacatattcctttcctttgcagagagtttataccctatttctaattgttgtttgagaaggtattttaatagaatggagttatttactctagaggcacactctggggggtctgcataggaatgtgagtcccaggtgttttccaggtctctctctccttactaatattactcagccactctgtcttctattagttctgttttgcctcaggtttcctaaattgtcaatattttgttttgatttaatgtctagaaagaattccaggatatatttttatactaacttttgttcaaaatgcaattatctctctttatcctcacttcagcttccataagagcatttaaaggtcagggaagagtttttaagcagatcagtttggagaagcagaaaatctctatggaaaagtgcagggtctagtaggaaagaccatgtagaaatcactatatattgttttatttactgtcccctatgactatctgaaagacctagcttaatgaagattgaataaaagcattaaaaagtaatgaagccatataaattctgggcttgggtttaaaaattataattctaaccattttataatagttgttaagatacactcacctatgcacacatatattcagaaatgtttctaatatatgcaagtagtactgtgtgtatgattatgaagggcataatcaatgtaattcaaaaaacaataatgtaatttgattataagaatattaggatttgaaaaataatagtcatattcttgctaaatgaacaattcaaattagtcacattaaagaaaataataaactttaatctgtgaaacccattattaagaaacttcatttaatggattaatctcattgcaaattgcatagtgctatacaaaaaatgattactaaattgaaaagtttccccttatgtacaagttagatatataatctgtttgtttttatgtatattgtgtttaaaatcctcatattgctcaggattaccttggttatccggggtcctttatggttccctattaattttagaattgttttctaattctgtgaaaaatgatattgctagattgataagaatagcattgaatttgcagattgctttgggcaatatgagtatttggccacttaaacaatattaattcttctaattcatgagcaaggaatgtttttctatttgcttgtgtcatctgtgatttctgtcagcagtgttttgtccttctcctggtagagatctttcacttccttggttacatgtattcctaggtatcttgtgtgggtgtggatattgtaaatgaggccatttccttgatttggctctgagcttgaacacttttgctatatagaaatgctactgattttttaaattgattttataccctgaaactttatcgaattagttatctgttctaggagactttaggcagagtcctcaaggcttttatagaatcagatcatcagtgaagagagatcatttgatttcttttctgattttcaatgccttttatttcattctcttgcttgattgctctggctagtacttccagtactatattatataggaatggtgaaagtgggcatcctctgcttgtttcagttctcaagaggaatgctttcaactttttcccatgcagtatgatgttggctgtgggttgtcatagatggatcttactattttgaggtatgttcctttgatgcctagtatgttgagggtttctatcatgaagggatgttgaattttattataaactttttctgcatctgttgagatgatcacacactttttgcttttaattctgtttatgtggtgaatcacatttatcgacttgtgtatgttgaaccagccttgcatttcaggaataaagcctgcttgattgtggtgcattaactttttgatgtgctgctggagtcacaaaatactaatttgctagtattttcttaaggatttttgcatctttgttcatcagggatactgacttgaagttttctttttcattgtgtcttttccaggtttgggtattaggatgatgctagctttgtacagtgagttagggtggaacccctcctccttggttttttggaatcgtttgaggagaattgctaccaggtctttttttggatgtctggtagaattcagctgttaatccatctgattcagggcttttattggttagtaggctttttattaatgattcagtttcagaatttgatattggtttgttaagggtttcagttccttcctaattcaatcttgggagattgtatgttttcaggaatttatccatttcctttagacattctgttttgtgtgcatggagtgtttacaacagtctgtgaggatcttttgtgtttctgagggattggttgtaatgtcacctttgtcattttttaatatgcttatttaaatcttctctcagattttcatttgttaatctagttattggtctattgatcttatttatactttaatatagccaacttaatttcattgattctttgtaatggtttttggcttcaattttgttcagttctcagattttagttctttcttttcttctgctggctttaggcttagtttgctcttgtttttctcctttctctaagtgtgatgttagatcattaatttgagatatttctaattttttgaggtaagttttagcactataaagtttcctcttcacactgctcttgctggatgttgtatctctgttttcatttattttttaaaaatgtattaatttctgccttaattttcctgttcattcaaaagtcattcagaaacaagtcatttaatttccatgtaatcatgtagttttgagggattttctttgtattgatttctatttatattccactgtgatctgagagagtatgcttcgtatgatttagatttttttgtatttattgagacttgctttatggctgaacatgtggtcagtcttggagtaggtttttttttttatttattgagacttgctttatggctgaacatgtggtcagtcttggagtaggttttatgtgcagatgataatgtattgtatagttgataggtgatgtattctgtatgtgtctactaggtccaattagtcaaatgtcaaatttaagtctagaatttcttagttttattccctgatgatctgtctaatgctgtcagtggggtgtttaagtgccttattattattgtgtggctgtctagttcttttcataggtctagaagtacttgttttatgaatctgggtactccaaggttgggttcatatatgtttatgacagttacgtcttctcattgaattgaactctttatcattatgtaatgctcttctttgccatagctcaacatcaaactatactataaagctaaagtaaccaaaacagcatagcactggcacaaaaacaggcacatagaccaatagaagagaacagataacccagaaataaagccacacacctccaataatatggtctttgacaagtcaccaaaaaattaggaatggagaaacaactccctattcaacacacggtgctgggatagactaaccgtatgagaaactagacctctgcctttcaccatatacaaaagttaactaaagatagattaaaggtttaaatgtaagacctcaaactataagaatcctagaagaagacctaagaaacaacattctggactccagccttgggaaaaaaattataactaagtcctcaaacacaattgcaacaaaaacaaaaattgacaggtgggatccaattaaactaaagaaaatgtgtacagcaaaagaaactgttaacaaagtaaacacaacctacaaaatgggagacaatatttgcaaactatgcatcctaaaaacaaccccattaaaaagtggacaaaagacatgaacagatgctgatcaaaataagatacacaagcagctaacaaatgtgtgcaaaaattctcgacatcactaatcatcagagaaatgcaaatcaaaactgcaatgagatatcatctcacacaagtcagaatggctaatattaaaaagtcataaaacaacacatactggtgaggctgcagagaaaagggaatgcttacatgctgttggtaggaatataaattagcccatccaccatggaaagcagtttggagatttctcaaagaacttagaattgttatccagcacaacaatcccattactggatatatatccaaaagaaaacatatcattttaccaaaagatacatgcactcatatgttcagcatagcattgttcaaaatagcaatggcatggaatcaacctaggtacccatcaatggtgcattggataaagtatggtacatgtacaccatgtaatactgtgcagccattaaataaatgaagtcatgtactttgctacaacatggatgcagctgaaggcctctattctaactagattaacacagaacagaaaaccaaataccctatgttcacaattataagtgagagctaaacattggtactcattgacaaaaagatggcaacagtagacactggggacaatcagagtgaagaggtagggatgtggagaagtgttgaaaagctgcctattcagtattatgcccacaacccaggtgatgggatcagttgtatcccaaacctcagcatcacaaatatacccatacaacacacttgaacatgttcccctgaatctaaaattaaagttgaaattattaaaaacaaaattgtattcttgcattaaaaatgagtacaacaaatttaaatggattgtgtgtagtttaaatattaacagttcttaaatagaaaaatgaaatgtgaacactaagagttaacttacactaaaatatattctcaaattcctggtgtgtttttaagtgaagtttccctaacatcaggatgttaaattaataatctctgagacatttaaattttgttatccagtatattagtcagtattctccagagaaacataaccaacagaatgggatatatatacacacacactcacacacatgcatggtgatttattgtaggaatttgttcatgcaataatggatactgataagtcccacaatccgctctctacaaattgaaaaatgagaaaagctattgctgtaattcagtgtgaatctgaagacctaagaatcagggaaggcaatttctgagggcggaagaggagggatgtcccaactcaaacagaagcaaattcaccctctcttcgtctctttgttctatccaaaccctcaatggattaaataatgtctatccacattggtgagggccatcttctttactcagtttgctgattcaaataataatctcttccagaaacattgtcacaggcacacccaaaaataatattttaacctcactttaggcatctcttagcccagttgagttgacacatcaaactaaccataacaccaaggaaatcatgttagtattattgcaaagatatccacaatgcatttttctcacaaatgccctttttcctgtaaattgtatcacttcatctcttaaatgccctcatcgcaaaaaaaaaaataacattgtattggtcagtgttcttcagagagatagaatcaaaaagatatatgtgaatacagatattttaaagagatttattagggatactagctcacatggttatggaggcaaagtcccgtgataggttgtctgcaggctggaaaccctgagatgctggcagcatgactcagtttaagtccaaagccccaggaactagggaaacctatgacataactctcagtctgagtctgaaggcctgagaactcagggggccactggtgtaaatcctggagtgtctgtgtagaagatcctagatttctgatgtcccaggacaggagaagagtatatcccagctccaagagaaagagggcatcacctttttgtgcttatcctcgtcctcagatgattgaatggtgcccagacacactgagggcagatcttccccacttagtccaccaactcacctgccaatctcctctggaagcaccttcacagaaaaacccagaaataatcccttaccggttctcttggtaattcttaatccagtcaagtcaacacctaaaattaaccatcagaaacatataactttgaacaatttgcgtttacctttacccactcacataaaaacaccatacgtaggagttcaaaggaatttaaattgtttgcaatttttttcttttataactaggaatgttagcaaaacaccatacggtgagacagcaaagcacagtggcttaggagcacagactccaggttcacactgcataagtttgatcctagctctgttatttaataatataggacactggctaagttatttaacctctctgccttggtttgctcctttgtaaaatggagataataaatattttctaccttatatgattggtatgatgattaaatttacttatgtatgttaataagtatattgaacaatggcctgtaagtacttaatgattaattgaaattattatatctcttattaaagatggtttgcttatatctcatatagccataagagatattttgtgattgggatcaggaaaacaggttatatcaaaggcaggtagtcacctgtttctctttgcaatatttttaaagatttgatacttttagaacagttttagttcaaagcaaatttgaaaggaaggtacagagatatcctgtatatttcctgcccccacacatgcatagcctcctccattatcaacatccttgtattagtccattttcacactgctatgaagaactacttgagactgggtaatttataaaggaaagaggtttagttgactcacagttccacatggccggggaggcctcagcatacttacggtcatgatagaaggtgagggggaatcaagcaccttcctcacaaggcagcaggagacagagagagcgagcaaagaaggaaaccaccagacacttttaaacaatcagatcttgtgagaattccctcactatcatgaggacagcatgggggaaactacccccatgatccaatcacctcccaccaagtccctgcctcaacatgtgaggattataatttgagataagatttgggtggggacccagagcaaattatatcaatgaagtgtggtaaattggttacaattgatgagcctatactgaaacatgattatcacccaaagtccatagttcacattaagatttattttgtattgaacatcctatgggttttgacaaatatataatgaaatatagccaacactatagtagcatacagagtgttttcactaccccaaaaatctgccatgctgtatctattcatccctcactccccacaacctctggcaacaattgaactctgtttttctccatagtttagccttgtccatagtgtcacatggttggactcatacagtatgtagccttttcatattggcatctttcacttagtaatatgtgtttaaccttatgtcttttcatggcatttttttcagtgctgaataatattctattttctggtctgtttgtagcacagttcatttatccattcacctactgcaagaaatcttcattgcttccaagttttgacaattatgaataaagctgcttataaacattcttgttcaggtttatgtgtgaacatatgttttcaactcttttgggtaaataccaagaagtgagattgctggatcataccataagagtatgtttaattttaggagaaactgccaaactgtctttcaaagtggccggaccattttgtattttcactggtaataaatgagagttcctgttgttttgcatcctggccaatatttggtttttaaagtgttctggattttggccattttaggtatgtaatgatatctcattgttgttttaatttgtagttccctgatgacatatgatgtagaacatctttttatatgcttatttgccatctgtaaatattttttgagatgtctgttaagggttttggtccattttagttaagtaatttgttttcttattgatgagtgttaaaagtttcttttatgttttgaaaaacagtagtttatctggtatgtgttttgcaagtattagttcccagtctgtgttttttttttcatcttctttatagtcttttggcaaagcagaaatttttagttttaatgcagtctagttcaccaactgtttctttcatgaatagtgccttgggtgtcatatctaaaaattattgccaaacctaaggtcatgcagattttctcatgtgttaatttctaggagctttctagctttgtatattacctttaggtctgtgatccactttgagttaatttttgtgaaggatataaggtctatgtagaggttcactattttctgtgtggatgtccagtagtaaagcatcatttgttaagactttctttgctccatcgtatagcctttgcttctttgtcaaagatgattgtgggtctatttctagactctctgttatgttccatttatctatttgcctattccttcaccaacactaaacactaaacttatttacagtcttatttactgtagcttcacagtaaatctgaaagtcagataatatcaaagcttcaactttgttcttctccttcaacattttgttaaatgttctgggtcttttgcatccccatataaactctagaatcagtttgtcaatttctacaacataatttgctggggttttgtttgggatggtattgaatctatagattaagttggaaaaagctgacatcttaacaatattgagtcatcctttccttgaacatacattatctatccatctatttagtttgtccttgatttctttcatcagaattttgtagtttacctcatattaattttgtaattctgatggatttttcataagcatttcatttttggagatgctaatgtaaatggaagtatgttcttaatttcaaattctacttgttcattgctggtatatagaaaagcatttgactttttcttattaacctcatattctgcaactatgctataattattaattccaggaggatttttgttgttgttgattttaaaaaaattctacatagactatcatgtcatcagaaaaaacatgatttcttccttttttctttttctttcttgctgcattagataggactctcagtacaatggcgaaaataagtggtaagaggagacatccttgcctgttcttgatcttagagggaaagcttctagtttcttaccattaagtatgatgttggctgtagattttttgtagatattctttttcatgttgaggaagtttccccttattcctaggttactgattgtttttatcataaatgggtgatagattttttttcagataatttctctgcatttattaatatacttatgtgattttttaaatttagtttgttgatgtgatggattacattaattgatttttaaatattgaaccagtcttgtatacctgagataaatctaagtaggtcatgttgtataattctttttgtatatatttggattcaatttgctaatattttgttgaggatatttgtatctatatttataggaggtattggtcatagttttcttctactgtctctgtctaggtttgttgctaagatgaggctagcctcatagaatgaggtagaaagtttttcctcagcttctatcttttgaaagtaattgtagagaattggtataatttattctttaaaagtttggtggaattaccagcgaacacttacggacctgatgctttctgttttggaaagattattaataattgctttaatttattaaatacatatagacctattcaaattctctatttttgcttttattagatagattttattttctttcaaggaattggttaatttcatctaggttatcaaagttttggacatagacttgttcataatattcgttatcttttaaatgtccatgagatctatagtaatggcccacctttaatttctaatattagtaatttacatcctctcttctttttagttagcctagctagaggcttattgattcaatttatcttttcaaagaaacagcctttggtttccttgacttttccctattgatttcttattttcaattgcattggtttcttctccatgttttattatttattttcttcttcttactttgagtttaattggctcttctttttctcatttcctaatttagaagcttagataaatgactttagatatttcttttctaacagatgctttcaatactgtaaatgtccctcaaagcattgtttttactacatccaacaaatgttaataaattatatttttatttttatttacttaaaaatatgaatatttctcttgaaatttttcattttacccatgtgttatttagaagtgtgttcattgtttaatctccatgtattttaatctccaaaatatttaaaaatatttttaaatttctcttgaaatttcccactttatccatgtgttatttagaatggttttcattgcttaatctccatgtattttaggatcttccagctatttttttctgttttttttttcttgtttaatttcattccggactataaagtaatttcaaatttgtcaaggtgtgttttattgcctagaatatgatgtgtcttattgaatatttcctgtgagcttgagaagaatgtgtattctgttgttggataaagtagtctgtagatattcattatatccagttgattcatgatattgctaagttcaactatgtttttactgattttctgcctgccatggtcatctatttctgatagaggggtgttaaagtctccaactataatggtggatttatctatttctcttgcaattctatcagtttttgcctcacatactttgctgctctcttgttaggcacatacatgttaagaattcttattatcatagttcattttgagctgctataacaataccacagactaatttataataaacagaaatgtattggctcatagttctagaggttgggaagtccaagatggagaggctggcttcctgcaaaagctttcttgctgcattatccaatggcagaaaggcaaagagagggtgagagagcaagaaggggctgaacccattcttttataatgaacccattttcacagtaatgaactcactccctgtattagtcagggttctttaaagggacagaactaataggctatatgtatatatgaaggggagtttattaggataattgactcacaggatcacaaggtgaggtcccacaataggccatctgcaagctgaggagcaaggaagctagttggagtcccaaaacctcaaaagcagggaagccgacagtgcagccttcaatctatagcagaagacccaagagcccctggtaaatcactggtctaagtccaagagtccaaaagctgaagaacttggagtctgatgttccgagggcaagaagcatccagcatgggacaaagatgaaggccagaagactaagcacacctcttcattccactttcttttgcctgctttattctagccacactggtagctgattaaatggtgcctacccagattgaaggtgggtctgcctctctcagtctagattcaaatgttaatctcctttggcaaaaccctcacagacatacctatgtacaacattttgcatcctttaatccaatgaagttgacattcaatattaaccatcacatttacataataatggcattaatccactcatgagagcaaagccctcctggcttcatcactttttttgttgttgttgagacggactctctgtcgcccaggctggagtgcagtggcgccatctcggctcactgcaagctccgcctcccgggttcacgccatgcttctgcctcagcctcccaagtagctgggactacaggcacccaccaccacgcccagctaattttttttttttttttttttgtatttttagtggagacgggttttcaccgtgttagccaggatggtctctatctcctgagctcgtgatctgcctgcctctgcctcccaaagtgctgggattacaggcgtgaaccaccacacccggcaggctgcatcacttcttaaaggtcctgcctctcaacactattgcactggggattaagttttcaacacatacttttggagggacaaattcaaaccacagcagttatggccaataattttctcctttatcaatatgagattttcctctttattcccaatatattttattgctttgaaacctactctgtctgaaattagtatagctactcttgctttcttttgattagtgttaacaaggtacttctttctccatccgtttacttttaatctacacgtgtctttatatttaaactgagtttctcatagacaacacagagttgagtcttatttcttgattcattctgacaatctctatcttttaattagtgcatttagacaattgatgttcaaaactgattattgatatagttgtaataatatctaccagcataccaactataccaattgatatagttgaagaattaatagtgatataattggattaatatttagtactgctttgtatttgttgcctttctttgttcctatttttgtcttccagtcttttttctgccttttgtagtttcaattgagcattttgtatgattacgtgttctctcctcacttagcatacaaattacacttctttttttttatttttattttttgagatggagtctcactctcttgcccaggctggagtgtagtggcatgatctcggctctctcaacctccacctcccaagttccagtgattctcctgcctcagcctcccgagtagctgggattataggcattcatcaccatgtctgactaatttttgtgttttttagttgagatggggttttgccatgttggccaggatggtctcaaactcctgatctgtgatctgcctgcctcctcctcccaaagtgctgggattacaggcgtgatccaccacacctggccacacttctttttaatactttttttttaaattgttgtcctggagttgcaatatgcatttatatataatccaagcccactttcaagtaacaatataccacttcatgggtagtgtgagtaacttataataaaaaaaaactcttaatttcttcctcccatcccttgtatcattaatgtcattcattttacttatatgtaagtatacacacacatacacaatatatacattaagtatacataattaaatacatttttcatggtatttttttgaacaaatatttacttgttaaatcaattaagaataagtaaactagagcatgggaaagctcagaaaccaacacaagatcccagaaaatggggccaggcatgcagggaaactgagcagccagcaatacctgtcaatgtcatgttccttgatatgcagcagtgatgctgggctgcagctgagagtgccgtcccattgcaaggaatatcaggtccatgcttctgctgtctcaggtgcccaagcttagcatgggttctctcagctcaagccaccagccctccctaggacccgagaaggtgaagcccttgtgtgaagtcctggctcttgtcaaggcagggtgctaaagaagaaacagaaaagaagttaagaaaaaattttaattttatctttacttacttcttctttgatgctcttccattctttgcatacatttgagattttgacctatatcattttccttgtctccaaatgacttaggatgttttgcaaagcaggtctactgacaagtccccttaatttttttctttggccagacaaagtctccatgtctccttaaccattgaaagatagtttcacaaggtacaggattctaggtttgtgggctttttctctctcaacactaaataattcactctactcttttcttgcttgcatggtttctgagaagaagtcagatgtaatttttgttgttgctgttcctctgtaggtaaggtgtcacccaccccctctctggcttctttcaggattttttctttacctttaattttatataatttgaaaattgtgtgcctacatacagttttttgacacttatccttctttatgttctctgaggtttctggatacatggtttcatgtcagacattaatttgagaaagttctcagtcattcttgtttgaaatatttatttggttcatctgtctcttctctttcttgtattcctattacactttcgtagtttccccacagttgttgtatattctgttatagttttttttttcagtttttattctttatgcttttcaattttggaggtttctattgagataccatccagctcagagaatttttcctggaccatattcagtatactgttaaccacatcaaagttacttttatttctgttacagtgttttttagctctagcatttctctttagctcttaagatttccatctctctgcttactttacctatctgttcatgcatgctgtcacctttatccatttagagcccttagcatattatcataattgttttaaattccgtgtctgataatccaatatccctgccatgtctatctgtgaggcttgctttggcccttcaaactgttttttgtctttttgtatgctttgtaattttttttctttatagccagacacaatgtactgggcaaaagggagcactttaaacaggcctttagtaatgtggtggtaaggtatatggggagggaatatgttctacagtactctgattaggtctcagtctcttagtacccctatgcctttggactgtgaacatcacaagtgtttctcagggttttttttttttttttttttttctgcctcgttaggtgggacaggatggttacattgggctggagttggttatttcctttcttccaggaaagttgggttatgatagaaccccaacaggttgaattctggttaaccagtttctcctgaaggcagaccttgttaagaacacagcgttctggcatattgcaaaatgattcattttcatcttttcctgctagaaggacaaaaagatttttctccaatatttgctgtgaaaacctggttgagtcccttggagcaaaactcacaaagtgtgggacccgtcctttgactgggtcctcctggagttttaactctcagactccttcatacttagcctctagcaatttgtcaattacagttcaagtttctatacccaacctgtgaagaaggttcatggcattctagttactatttcaaagggaggactctaaacatttccacccactgcactttgggtgcacaaatctatagtgagacagaatactttcacacaacacattccatgaagcagatttattacagataggcagcaagggacaacagaagcctaggactcatgacaaagctgtcccccaaggttcaggaaagcttcatgagatggatggaatctcatctgcatgcaacttatgtcacactgcagctaagggaccccaaaaagcagcctgtcctcggctttataccctgaggcattgtgatgcactggggaaaagcattgtaggatattctgctctaggaggaacaggaacgcagtgtgggatattctagccagttattccttatctcaagatgttgcattcccagcacatttacagctattaagaactacaagggccaggagcggtggctcacgcctctaatcccagcactttgggaggccgaggcaggcggatcatgaggtcaggagatcgagaccatcctgacaaacatggtggaaccccatctctactaaaaatataaaaattagctgggtgtggtggcacacacctgtagtcctagctacttgggaggccaaggcagaagaatcgcttgaacccagaaggcaaagcttgcagtgagccaagatccagccactgcactccagcctggcaatagagcaagactcaatctcaaaaaaaaaaaaaaaaagaaagaaagaaaaaagaaaagaaaaaagaaaaataactacaagcaagaaatcaaagagagttgggttggcccaaggccacctggagaactgtcagccagcgcttgttcccatagaggtttttgcttcagcatgttgtgattctctgtatccctcatctgtctctttaatctggggggcagcagtttgccctgtgaccttacttctgttttggatctaagaagagttgttggtttttcaatttgctctgctttttatgtgttgttagaatagaatggcaacttccaagctccttacatgaagaaccagaaactacaagtctccataccatttttcaagtatggctttacatttttaaatgattgaaaaatcaaaacaatgatatattctgacatatgaaagctacacaatatcaaaatgttagggtccataaataaagttttattggaacacacacagcagagttaaatatggcccaaagcctaaaatatttactataaccctttagagaaaaatgtagctgacctgtgggctatgtgtgctaccgtaacagtgtgacactttctacccttcttgactagaatactaaaataatccaataattattttatgttttccaggaaatcaagtaaagcagaatattattaagaaacctttagttagaatttttaaattagaaataatttctttcatagtcccagaaagtatataatgggtgaagtatgaatgggtgaagtatgaatgggtgaagtatgaatgggtgaagtatgaatgagtttgaatttgcataactgttaacattatccatgtttcccccctctctatatatacacatatacacacacataaacacacatatacaccagtgatatcctctacaatgaaacatattaattattcctgtactttatttaacaccaaagtttcttgattttgtttttttattagtagatagggctattttctgaaccctcttaccaagtcctctaatgactttagagacaactgtatcttatacactttttaaaagcaaatctcccttccttgtccagtatgttgtgagcacagcgtagaacatttgataaagacttagtgacttgaattaaattacttgcagttaagtaaaacatcccaaatcatgaaccctcaattatcttgtctgtgtttaccatgtcctaaggcctttcaaatagaagtgacaatttaaaagttctaaaataattacagcaccatattgctcactataaagtacaactgtcaattacaaattcaattatcagtggccacttgtgaatctagagaacttcacaaatgttctgtcttgtagctgaactggaaatgtttttagggttgccgtttgttttatagttttaaatatttataacctgattaattattttcctaaaatattttcgttctagctaaaaaatgtgctaggaacaaacacaatacctgctgaaagtgacttttgtccctttcggtgtagggataaatgttatcccacctaaataatatgactcttgtttttaattaggtttaaagtaccctttgcagtttgacctttccctggaatgatccattttctatgctacattttatcatgctgccagtaatgtcatcaaaaacttttaaagaacatattaaattggctttaaatttatattgagctttaaaatgaaacagcattaggacattgtgcttctttgttttacacctgcatactcttaacattccggtgttggagactggaattcttttcactccaagtactttaagttaggaaggaaagaaggaaggaaggaaggaaggaaggaaggaaggaaggaaggaaggaaggaaggaaggaaagaaagaaagaaggaaagaaggaaagaaggaaggaaggagggaaagaaggaaggagggaaagaaggaaggagggaaagaaggaaggaaggaaggaaggaaggaaagaaggaaggaaggaaagaaggaaggaaagaaggaaggaaaggaagaaagagagaaaggaagaaagagagaaagaaagagagaaagaaagaaagaaagaatgaaagaaagaaagaaaactaagaagttatttatgctttgtacaacagaatgggcacacaaggattctaacaaggatttcaattctaatatcagcacttagcccctcaatgtctttgagcatgttaagttgcaaagcccaaacggccttatctgataaggtgtcattatcccttctttgcaatgttcttgttagagttagaaataatagatgtagtgcaattgtcaccataggccctcaataaaagatggttgttgttgcagctgttgcaatatgatcgaggtctttactgacccagtgaaaaccttctactgcttgctctaagaaaccatttccttcttcctaattagtcctcagtaaagtgaataagttattagagaacatggtctaaaaacaatcatttatattaggacttcatcgtgtagttgaaacgtcatgccatggcttggaaatatcatggaaatgtggcatgaactcttcccggggtggtaggagatcaatgaggagcattgggagccaagaaaagaagccaaaaaaaaaaatcattagaggaaactttccttctctcacccatgtgcattttgaattcaacatatcgttggcaggttttctttaggtcaaggacagctttaaagaaaactgttttagatcctccaactctccttcataaacctatcccactacatagctttacaaattgcctcttttggagattttcccagaactatcctcttcactctgcacacagcaagaaattagccttccgctcttttactattccgttcctttacaattcatgctacttcagtatacttaacccagaatttattcaagttttatgtgttaatttaacaaatatttatttagtgactacctttattgtaccagttaaacatataacaggaaacaaaactcaaaaacagttctgtcctcactgagcttatattttggtggaaagatacagacaattaattgaaccaaataaattatagtgtatattagaaaaggataagggctgtgaaaacaaataaagtaaggaaggggagtgaaatatactgggaagtagagtttcaattttttagaaacagcttccctgagaagatggcaatttagtaacataaccaaggttgcaagtcaggaggttattcatggtgaaagcaatgtaggaaggaagaactgcaagtgcaaaggccaggaggcaggaagatgccctgcatggtccaagaagataaaggaagcccttctggttagatcagagaagatgaagttgaatagggctggtgtggagggacctggagaatatctagactcttgtaagctactgaaaaaaaaaaatgttggcctttagtctgagtaggatgggaaacatttgaatatttgaatgaagaagtgaaatgatctgacttgtgtttttttaaaagctcattctaactgccacgttgaaaatggatgataggaaagcaagttgaaaaaggctgaccagttagaaaatattacaaatatccaggtcgttttattggtagggctagaaggaagtggttggactctgaatacgacgtgttaacagatggacgaaagggaacagtgacagtgagggtcatggaggacatagaggtttttggtttttgccctggagtattagaaagttcaaagttgtcataaattgagatggcaaaggttacatacagcctgcttttgggttcagtatcaggactgcaaatttaggcatgttgactttgggctctctactcatgattccagggaagatgtggaataggcacttgaatatagaaatctggaattcaggggagacatgatctgggggtgtacaacttgaagaattcccaatatagagatgatatttgaagttgtgagactgaaggagaatgctaagggagtgagtgtagaaagaaaaggtggaaagtctgaggctgatcttcatttgcactctaatattaatcggttggtgagagaggaagaagcagagagtagaagcagatgatggaggaatggctaaggattggtgtaaaggcctgcaaataaaatcgtgtcaaggaacagtagatgaacaagtaggtcaaatgctgctgaatagtcattaagatgaggactgaaaataatgatgagcctaagaaatgagttggtgtgcctgtatggagtagtttcaagaaagaatgaaagtaaaaagctattgaaaccagagaatacagattcttacttttgaaagtgagttttgctacaaaggggatcagaaaaattgggtaataggtacagaggaaaacatggttatgattatttttaatgaaagaaacgtgtttgtatgataatggaaatgaatcagtggaggctaaaacagtcagtaatgtaggagaaagggggaattgctggagaaatttccctgagcaggaaggggaaaggggctataagatctggtgcacaagagaaggatccagctttaggagcaaggacaattaatcttgttaaaagagggaagactgagcagatgactcactggttagatgtaaacagcctctcagcctttcttggagcattctcatttagatataagatactatttaagtaacgaaatatctaatcatatcatttcagtaaatttaaatgaagaatttccattaggatatggaactcacttttttatttttttattatactttaagttctgggatacatgtgcagaacatgcaggtttgttacgtaggtatacacgtgccatggtggtttgctgcacccatcaacccgtcatctacattaggtatttctcctaatgttatccctcccctagtcccccaccccccaacaggccctggagtgtgatggtcccctccctgtgtccatgtgttctcattgttcaactcccacttatgagtgaaaacatgcagtgtttgggtttctgttcttgtgttattttgctgagaatgatggtttccagcttcattcatgtccctgtaagagacatgaactcatccttttgtatggctgcatagtattccatggtgtatatgtgccacattttctttatatatatatatatagagagagagactagatagaaactcttaaatcctaatatgcaaatctaacctgggaaaaccattacactggttaaaagtagcccatttgggatgcacaaaattcatttttttccttatgcctgacaggacatccagcaactccagtttgtaaatgagcttattcatttgaactgggatccatagctttactcaagaatgaacagcttggttcatctctccttgaaaattgctgttagaattaaactccttagtcaatcttttaactcaactgtttcaaaactcctttggttttgaatcaataaaagcattgaggatgtggcagttgagcagatgggtggtccacttggtaaagctttgttatctccatgtaagccacaataaaactctgacctgacaaaaagaaagtgtttacacaaatcaaaacagaaacctctatactataagttacacagtgtttccagttggtatctacaagtattaatgcagacacagtgacaggtttcaaataaacttgatagaaaaggccattcatattttatcatgttgggttgatggacttacaattgagaacaatgttttactcaagcttagtgaaaactcctaggtagtaatcaatattctcagtcaccattgcattgaaaatatgttcttgtctatgtcgacaaaggcatcaaattaaacttgcaaaggtagattattttttatcttttctcctgatgtaacaaatacatattataactgaaattgcaatataataaattaaaaaataaatgctattcagatttgaaagaaaataacgggacatctaatccatggctctattaatgctttatattttgtggcttaaaaccatctttctaaatattaaatataaattctgctaaaatagtgagggggacatagttgaaacttactatacatcaaactacgagtttccaatctttaagcaaaaatatagttactaaaatgttgtttacaaattatttttaaaattttaatactgacatgcaattaaatgatccaaaggcttcatacatttaccacatgttaaatgaagaacacgcttttgaagaaatctgaggtttcataaactgttatttactgagtttgttttgcatccaagatctcaggaggatttaatctttcatctgtttttcaaagcctcagttacattttattttttattttttgaatttatttatttatttatttattttttgagacagagtctctctctgtcaccaggctggagtagagtggtgcgatctcagctcactgcaacctccgcctcctgggttcaagcaattctcctgcctcagcctcctgagtagctggaactacaggcatgcaccaccatgctgggctaatttgtgtatttttagtagagacggggttttgccatgttggccaggatggatttgatctcttgacctcgtccatgtcagcctctgaaagagctgggattgcaggcatgaaccatggtggatggcctgaaatatttaattgacataacgattatacatatttaaggggtaaaagaagatttgatatacatatataattatcacaatcaaagtaattaatgcatctatcctgcattaattaatccaggctgtacattagacctctagaacttgttcatcttataactgaaagtttgtacccttgaaccaacatctcctcatttactccacaccctatcccctgacaaccactattctcctctttgtttttgtgactgaacttttagattccacatatatgtgagattatacactatttgtccttctgtgtctggctcattttacttagcctaatgtattagtctattctcacactgctataaagatactacctgagactgggtaatttataaagggaagagctttaattggctcacagatctgtgtggctggggagacctcaggaaacttacaatcatggtagaaggcagaagacaaaaaggaatcaaagcacgtattacatggcagcagacaaaagagaagagtgaagcaagcgggaactgccaaacacttttaaaacatcagctctcctgagaacgcactcactacaatgagaaaagcatgggggataccgtcttcacgatccaactacaattcaagatgaaatttgggtggggacacagagccaaaccatatcacctaatgtcctccagtttcatccatgttgtcacatatggcagtgtttccttcttttttaaggctgaataatattctattcaatacagcacattttctttgtccattcatctgtgactgacacttaggttgtttctattacatatcttggctcttgtgaataatgtggcaatagacatgggagagtagatatctctttgacatactattttatttccttttgatatatacccagaagtgggattgccagatcacgtgatagttctattttaaggtttttgaggaagctccatgatattttccatagtggctgtacaaatttacattcccactaacagtgtacaagagttcacttttctttacacccttgccaacatttattatcacgtgtctttttgataaccatcccagcaagtatgaggtgatacctcattatggttttaatttgtatttttctgatgattagtgatgctgagcatctcttcatatacctgttggccatttatatgtctttgctggaaaatgtctcttcaggtccttggcccatttttgaatcaggttatttttaaacattgagttgtgtgagatctttatatgatttggacattaactcctcatcagatataaggtttgcaaatattttcttccatatcatagattgcctttttattttgttaattgatttttgtttttgtttgtgatttttgctgtgtggatactttttagttttatatagtcctgcttgtttatttgcgcttttgttgcaagacacaaaatcaacatacaaatcagttgcatttttatacactgaaaacaaaccaactgaaacagaaaataagaaaatgatcccatttataatagatagcattaaaagaacaagagacttaggaatacatttatccaagaaggtgaagatctgtacactgaaaactatcagacatttatgaaagaaattgaagaaggcacagataaatgaaaagatagcccatatacatggattggaagaatcaatattatttaaatgtacatataaaccacagcgatctacaaattcaaactagtcatcaaaattccaatggcgtttttcacggaaatgccgtttcacagaaatgccacagaaaagacaatcctaaagttttaatgaaaccacaagactgcaaacagccaaaacgctcctgggaaataacaaagctggaggcatcacagtccttgctttcaaattatgttacaagactatggtagtaaaacagtatggtctggcataagcacagacacagaaatacaacaaaagagagagcctagaaataaatttacacacacattatcaactaatctttgacatggcaccaaaaatacacaatggggaaaggatagtttcatcaataaatgatgtttgggaaaactggatattcatatgtaaaagaataaaattagactcctgtattatccaatgtaaaaaattaactgaaatggattcaagacttaaatgaaatatctgaaaccataatattcctagaaaaaaacgtagggggaaactttctgacattgatcttggtaatgacttttttaaaagcgtttatcttttctttttctgaagaacaattattgaaaccaccatttcagggtgatctgtaactggtaagcaaaataaaccatgtaaaagaggagaagccttgagtgtagatgaatgtggtttctctagttcaatcataacattaaaatttcataattaaagaaaattagttctattatttctgtatttatgaacaaattggacaaactattatcttccaatctgtaactgtacatgggcttttcagattgattctacctaaagaaaatcaaaacgaaggtttatatattccttcagtaaaatcactcatagtttcccttatttagttagcatggtgtctttataaacagatgacttaaaagtgaacagaaaatggagaacaaaataactcaggatcccaccttagagataaagctctcatgactgttttagcagggttaacaaacgttccctatttcttccataagttaggctgcctgggtccatgacacggcttgatggacagggtgatccctagtcacctgtgcgcagctgctgcttctgccagctgaactgttgactcacagagtctgcaatatttcttttcttacattaaatttaagccatctttacttgctattttaattccacaatttaacaaattataacataaccctaataaaatgtgatatgtagagaaaacaaactttgtcatgaacacctactttaatgatttgtaaagactccaaagtgttatttaagtattatattaaagtattgtggtgtgagaaccataaaattttgaccaaaaaagcaaaaaaaaaaaaatgcaacaaaaattaatagagacagttgactactggtcacactctaaagaaattgttaatattatacacacacatacacatacacatgtaatttattttttaaatactatgctgcagtgatccaattataccttatttgaaaaaaggaaaaaagtcttatataaaaacattgatgaattaatgaaaatgtatatgtctaaaacaaagatatataatttaaaataattttcatcttttatcaaatattttgatttactatcagtcttgatcatattatttccatgacagtaattatttgctatattcactctaaattcactgtctttattacatctctttgtaattattaatgaaaatattccacttttaaatacctatgtttcccaggggttgctttgtgtaaaaaatattagcatgctacaaactatgagctatccacagtaaaaaaaaaaaaaaaaaactcaaaagaaaatctaattgctattttattcatttgattttataacctcaaactcacagaatactgaagaataaacttttctcctgattcatttgcaagtaagtgggcaagtttccatccatcatctccaaatacttttgtgtctgttttctacaagcaagaacattattctacatatccagattacatccatcaaaatcaggaaattaacattatttcactagttctttctaatcctcagattccatttgagtttcaccagttgtcccaagagtattctttttttttttttttttttttgagaagaagtcttgctctgtcactcaggctggagtgcagtggcgcgatctcggctcactgcaagctccgcctcccaggttcacaccattctcctgcctcagcctccagagtagctgggactacaggcgcctgacaccatgcccagctaattgtttttgtatgtttagtagagacagggtttcaccgtgttagccaggatggtctcgatctcctgacctcttgatgtgcccgcctcagcctcccaaagtgctgggattacaggcatgagccaccgcgcccggcccagagtattctttatagcaaaacgatgcagttcagagtcacatgttgcagcgagtttcattgatccttaatttccctcagcctgggagattgctgtctttccttgacactcaagactgaaattttatcgatgaggccgtttgttttgcagacttggtcttcatttgggtttctctcatggttagtttcaagttttgcatctttggcaggaatatcacaggagtgatcctgtttcatactcatcatgccaagggctgcacagtttcaagccatcccattattgtgattatttgatgcagacgctttgatggttaatgttatgtgaactgagctaggacacagggtgcccagacatttagccagacattatattctgggtgcttttgtgagggtgtttcctgatgaattggcagactgagtaaagcagaaggggctccccattgtggaagagcctcatccaatcagttgaaggcctgattagaacaaaaagactgactcttccccgagtgagagagaattcttgcttgctggccttgacttagacattgtttttttttcctgtctttggactcaaactagtattaaactataggctttcctgggtctccagctttccagctcacctggaagatccttagacttgcgaggttctgtgattacctgagacaattccttacaatgaacctttttatagagatggagtttttggtgtgtgtgtgtgtgtgtgtgtgtgtgtgtgtgtgtatttacatatacacatacacgtgtatcctatttgttctatttctctgaagaaccctgactaatacaggtgttgtgtaccagacttccccactatgagaatgccttttcccttggcaattagtatttttgtggaggtactttgaaatataaatgccttctcctaatcagatctcacatttatttctttatgtacttatatcggtatggattaaaagtgtcctattttatttaaggtgtaataatccattctcgcttctattttttcacactgaagcccacattgttccagatttaacccatgggagccccttccagcaggtgtctgtgtcctttcattatggtgctatcatttcgtgagtgtcttcctgctttctggcagtaaatgttgttccaaaatcatcttgtattttcccaacttggaatataataagcccattcttcaaggtcctcccagtagatgcccgagggactacatgcacatctgtgtgtagatgaataacatacttattcacaacaatacttaatttgctacttttaaatatgaaagaccgtgaattcacacaagtacttccaatgccaacccaatgtcatagggttcattccagtcttcctctttgacataatttgactctcttttccaactggaaaaatcctggctcccattgtctttgatatacttatttatatacttaacccccagttataagcaatttcttgtcactactgctgccatctctccatgtctggataccctccaaacctaactcaggcactgacctccccactgcaggaaactccccctactgcagggacgctgtcttcactaacacttcatatcaagccattctcacttgagaaagcctcttcacctgctcagactctgatacgctgtgtgggctgcccccattccttggttgccctaaaccccactggctctctgattttccatgcctggctaattctctatataactgtgcctattctgctgtgtgtcacctactgagttttcatttcaacaattacattttattttaagcttgtttttttttttttaacagtctatcctcctttaaacatttcatgtacttaatagtctgtatctgatcattccaatttcactggagtctgtaaattttgtttattgtttgtactcactctcacttgtcgtattccttcaatttttttttctttttggttggttttttttttcttttttaaatcttaacctgtaaaaatcccaattgtctaaattgagagtgctttctctagaaagaaatttctattttattctgctcggagctgggggcactgccaacaatctagtcaactcctgtatgacttattttgatttgatagcagaaacctgggactcaccttagagttctcctatccccttatctcccacatccaattactcaattcatccaactccacttcctaaaatcctcccatccagtaacctaaagcaaccctctattgctcaccttccacaatgctaaagactgatgtaaaaataaaccttaccctgtgattgccatgcccaaaattcttaaaaggctttaggtaaaatttataccctttggattgtcaaaaacatgatgacttaatcttttcttgtctgcgtatctagccacctatcatgccacttcctttagccttcacctcctcttttttttttttttttttttttttttttttttttttgacagtgtcttgctctgttgcccaggctggagcacagtggtgcaatctcagctcaccgcaacctcagactcccaggttcaagcaattctcgtgcctcagcctcccaagtagctgggactacaggcacatgccaccacaccaggctatttattatttattttattttaagtagagatgaggttttgccatgttaggcagtctggtctggaactcctgacctcaggtaattcacctgccttggcctcccaaagtgttgggattacaggtgtgagccactgtgcctagcctagccttcacctcttgaattgtactctggcaataacagactctgttgttttccaaatgtgccaccatatttctgcacatgcccagggtaacctgtcttctctaactagttcaagtgctggctccactttgaagagtgtatcttatctacaactccatgcagctcatttcactttgcgttatgaatgcttatttgaatgcctgtgtttataatgaagtgcaatttctttaaggtcaggggtcatgtctattcacttgtgcatttccagtttctattaaagattaacatggaataaattctcaagaataatggctgaatccacttccagcatgcaataagcaattactgctggcatttgtacaagtacacagtggtggaaattcagtcatatgtacatttctatcaactattactaaagcagaagtattatgaaacagttaaaaaatatacatgggttatgattatccctgttcattgaaacagtcctggaaaaacattttttatcaggttgtaaacactcactttaaaaattaataaaaagttaatataaagtctagaaatttaaattccatgggatagtgctaatgacaaaatagtagtagaccctaaattgtgaatttcaattttgaatttcaaattttgttttgtgttttatttttttgagacggagtctcgctctgtcgcccaggctggagtgcagtggcgcgatctcggctcactacaagctccgcctcccgggttcacgccattctcctgcctcggcctcccgagtagctgggactacaggcgcccgccaccacgcccggctaattttttgtagtttttagtagggatggggtttcaccgtgttggccaggatggtctccatctcctgacctcgtgatccgcccacctcggcctcccaaagtgctgagattacaggcgtgagccaccgtgcccggcctcaaattttgaatttcaaaatttagggtctactactatgattgtcacgagatatagtccaaatttcattcctacaaatatgtgtgcagacacacacacacacacacacacacagattttatctggatatcctctagttgctttaattctttctaaatagtcatctaaatcctgatgaagcaggagataggtttagtgatggtttcaatggaatgctatcgaaaattttcattttgtttttttttcacatcagaatcaataaatgttagccaactctcctgcttaatcgtcccattgagaatatattttatttcttagtgtctgtgcctaatatagcctgtttatatgaccacactagaagcttgagatctagtcctacttattatttcttcatttagatgtatttccagtaaacgtaattaaattcaagctctcagatatttctttcattaaccatttattctccctttctgttatcagatacagattcagcaattaatttcctgattaataacaattgctatgaaagcatcattcagtccactaagttgctgtgtttctagaagatttgattcaaaggtttgttcttatttctggcttcaatatccattgttaagtcttgccctagggtagaccacaagagatttagagcaactaaactatactaaattggttataattcaatgtagtttaatatacaaggaaatggataatctatttaccatccaactcaaaagaagaaagaaaaagagagtgagagtgcaggtcattttataggaaaggaatgtttttaagaacctatcaaagattctctcagtcagtagatagatggtatgcaaaactctgcttgataaaaacattgcaaaagtgtttttgtactttttttgagtttacatctcaaaacctgctcactttcgggtgtggtggcttacgcctataatctcagcactttgggaggctgaggtgggtggatcacaaggtcaggagttcgagaccagcctgaccaacatggtgaaatcccgtctctactaaaaaaaaaatacaaaattagctgggtgtgttgccggtcacctgcaataccagctactcaggaggctgaggcaggagaatcacttgaacccaggagacgggggttgcagtgagctgagattgcgccactgcactccagcctgggcaatagagcgagactccgtttccaaaaaaaaaaaaaaaaaggacactttattggtacgcattcatgactgtgcatacatacttaaagttaataaccactctaatgggcatagaaactttctgaaaataatgactatattatgaaggacaaatacagtacagtttaaggaatcttgcttaataaatatttaagggtttcattgccatttctagaagttaaacagaacaaaacacattgtaaattctaaactattcctgcaacatgattttccatgaatctacaacataccgtattcattttatagatatcatcatcctcttttcagtaattgaaagtattttccacaatactgagtcaagtggcgatatgaatatgacaggtgtgagctccaagtcgtaatgcatctttttcatatataatattttttatttcaaagtttttggggtacaagtggcttttggtaacatggatgaattatacagcagtgaattatgagattttggtgtatccatcctgcaagtagtgtacattatttcatctttgccacttcctagccaagtgattttggaaaagctgataaactttttatgcctcatttttttaatccatagaacgaggacaaccatagtatttagcctggcaacatagcaagatgccgtctctacaaaaaaaacatgaaaaacaaatcagctgagtgtcatggcatgcgcctctcgttcctgctactcaggggcctgaggcaggaggatagcttgaaccctggagagttcaaggctgcagtgagctatgattgtgccaccgcactccagcttgggtgatagatggagaccctgtctctaataaaaagaaaatgcatagtatttattttataatgtcgtggcaatgagcaaatacaggtaaaccagtcacagtaaaatctcaataaacaaggtgattagctcactacacatctacataaaacataataaaacaaaacaactttatttcctattttccttcccaagctccaggcgtttcacttccaattttggagtgaacaattaagttaattacttactgtgatttcacattacctacgtttgactcagctgtctatctccatagcctctgtggtgttcgagttccctcagtgtgtcacctttctcattgtcttaggagttttcactgcaggagactctgcagttacggagcccacagcactgagtaggtctcagccaatgtttggtttggccagcagcagagtactgacatcatgtttattatcccaacctcactttgtttaattacatatttgtaaaagaaaacaaatactgaagatatatataaaaattctgtgtcgaagggcattatttctacattatgactcctttcatttaaacatacagacatttggtaccaaaaagaaaatatatttgagccttttggattcatttatttgggggtgaggtgggacacttttatttcagtgtcatctgttttctcgattttgtaaaactaaatggttccatgtttatttgtatggttgaataaacatcataatgcaggtgcaatgcccagtttcaggcagtagagcatctgtacttaaaagaccatcagatttgtattaagctgttgaaatttgactgcatagttaggatcagacgttgcttcaaggtacaagaatgaagcaagtcaatctttaacaacgtttctctctgtcatggaggcagctactgtctttaagagcaaggacaaacacaattttcactttgttagaattctgggtcattctccctgagctctttatatcaaagcaatggcatctctggtcctagatacaagctctaattgtttctccttttagaaaatcatttttctctgccgggcgcggtgcctcttgcctgtaatgccagcactttgggaggctgaggcaggtggatcagttgaggtcaggagttccagaccagcctggccaagatggtgaaacctcatctctactaaaaatacaaaaattacctgggcgtggttgcatgcgcctgtaatcccagctactcaggaggctaaggcaggagaatctcttgaacccaggaggtggagcttgaagtgagccgagatcgtgccattgcactccagcctgggtgacagagcaagactccgtctcaaaaaaaggaaaaaaaaaaaaaaaaaaaagaaattgttttgctcttttcttccctattcttaggcttctgaactttttttgttgttgttgctctctatccttgcaactcctcatttcaatgttgaaacaactgagaggtgaagtcttcgtaaatataatctagaattgctagataaaataagaggcccagttaaatttgagtttcagataacaaatgatgttttagtgtaagtatggcccatgcaattcaaatttgacttggtgtactgtgtttttatttgctaaatctggcaagcctaatctcatatctagttattgaaacacgtttataaagcagaatgatgtataaaaaaatctgagttcaaatatgttcacttttatttcttcgcaccatgcaaaactgccgactgtcctcttggatttgaatttccttcttttcctgattttttcatcgctttgtaaatgtttttctttgactttctctcctccttacaatgcaatcgactttatcattgtttcttcagtgtcctgattcttttattctacctcaacatctttatttccccattcattcttctttgtgaaaaaagaattccaaaatgcttattacctcagtattttctctgacacaagtttgttaagaaatactcaaatttttaatacaggtctttgttctactgaaaaacatttcctttgccaagtttagactacattaaggacaaatatcattgctgtagtccatgcacccagaactctgtaataaatagtagtacccgcttcttctttacatgtgtccagttctgtaacttctatttgggaatttttgtttaattataatccatgtgtatattccttgaaatctgtggtagtatgacagaaaacgagtcttcatttggctggtagattctctagcctttcccttttcagattattttgcatcttattgccagctttttaaaaactggtaccccgatcgttttgctgcctgtacctcaaagttttccttatcgctcttttgatcaaatataaactttaaattcttccatttattatttcttctttgactcgcaatataccccattctaatttggaactatttaaaaataaggctgctaactagaagtctctgcacatttctctacccatcccaaaagtttggtccactctaccttcctcctaagtaaaaagttaacaattctcctttccttaccattaactttttaaaatcacttatgagacactgactttgatcaacccattgatcttttttcaggctaccattcttatgtactttaacatgttttgatgaatttgtggtcattataagtattgaatgttgtattccacactatgctttgcatttttttttttttttttttttttttttttgagagggagtcttgttctgtcgccaggctggagtgcagtggtgcgatcctagctcactgcaacctccgtctcctggtttcaagtgattcccgtgcctcagcctcccaagagctgggactacaggggcccaccaccacgcccggctaatttttttgtattttggtagagatggggtttcaccatgttggccaggctggtctcgatctcctgacctcatgatccacctgccctggactcccaaagtgttgggattacaggtgtgagccaccgcacccggcctgctttgcttttttaaatgttgcaaattagaattcttttggttatcttatctaattttctatttttatgttatgtgtcagatagtctggacttacaggaagacctgtcctcttccagcacgcacccttcctcctcccccatcattcccaattcacatgactttctaactttctaattgggtgctttttaatattcatgagcacaggttttaggtcacacagctttttataattatgggaaaagtaaaggtaaatagtgggtgggtactcaaggagctcacctacaaatcaacttgattcaatctatttaatctattgcttatgttctgatttttcatcagtgtcctggtcattgcttaacaatgcaaaatttgtggataaaaatattcatgttaggtgaagctcactgactagcctacaaatcagtgtcaccaattttgatacattttatccacatctccattatctggttaacatatcattttgcaaaatattaaaagatcttcaggtcacaaagggctgtcatgaacaaagtttcttctttttttaaataaactgaacagtgttactatctagttggcaccaaggacacactaaaattgtaatttataattatggggtttttcctcacagaaataaaaataaataggtcttattgaagacatagacagttttgcttctgtgaagatttctcctttacacataatcagtctgacttttctcactcgtttctgcctgaggtggaggtggggactccattcttgacttaataaatctaaattcttcaactgtcattctctcccaagacacttcaccctttggggactatgctgcattttcccattcttgctctttgtacatttcatcctgggtctggcaagacctatttcaaatatacaaagttatctgatacacacaggaacccaacctactctccacagagtgtggaagggttaaagaaaagccacttctgaacatctccgctttatcagctcccgttgggagatcaggggccagcagccttcattagccaataaaaagaaaatgacgtttctttgcaaggagtagactttactaagcaccctatatgttaaaaaaatatatattaaatgttagtttttgtctccaaaatagatatataattctcagatttccttgtaattttctcttaatggctgattaaatcttgacaatataaagcagtccagtcatccacccattcactggacaaatatttcttccatgtaaatgccaggcaccagtttaggtcctgatgatacaccaatgaacaagaaagatgaagtgatgatccaccaggaacttacattttagtgggagagatacacataacaaataggtagatgatatgataagcagggtaagtagatggagagcagatttttaagacttctgtgagctaagacctgattgaagagaggttgtaattttgtggtgtcagcatgatcaggccaagtaatcacttcctattgcccatatattttttaatcatttgtttaaaaatataatgcaaagagatagttctcagactgttttctcatatagaagatacttatttcttagattcttagtactactcattttaataagctatatgagtccacaacattaaaaaatttactctagaaagtaaagctgggtaaagtgacctcagtgtagaaaacttttattatatggccacaaaaggcactgaaaacgaaatttctagagggccttaggggattaaaagggaaatgtttagaagacattaaacctctggaggtttaattttgcaacttccccaaatacttagacgacttcaaaaataattttgcttttgtctaaactcagaaattatattgttcttttttgcccttgctggccctcagaagagtattaattctcattttgggaaggaattattttaatcatgccattaaatgagaggaaaatatcccttttctaaaaaaataaaaaattaaaaataaaaacctcggtgtaaagtggaattctctagagaatgcattgtgcacaaaatgaccttcctcagtgtattactgggatggagggagtcgtctctctgtggggtagcaaataagccctgtggccccctcaatccacctcagcctccacagagcatcagttgctgtttcatcccgggttggtccagacagccactgccagtccactagagggagcacttgagaggaaacccatttgctttcattgatctagatctcaaataaaatttcatcttagaggctgggcgcggtggctcatgcctgtaatcttagcacgtcgggaggccaaggtgggtggagcacgaggtcaggagttcaagaccagcctggccaacctggttgaaacccccatctctactaaaaatacaaaagttagcgtggcatgttggcagtaagctgagatcatgccactgcactccagcctaggcaaaagagtaagactctgtctcaaaaaaaaaaaaaaaaaaaaaaaatttcattgtagaataaaatccaattcctttcagcttttatcttcaaattttggtcattgtttgcattagtcattgttcttcaggaaaacagaaccaataggatatatgtatctgtgtgtgtgtatacacatatatatgcacacatgtatatatttatatatacaaatatatgcatgcatatatatttacatatacacatatttacaattctgtaaaatcttatatataaataagactcacacatacacatataacgtgcatatatatatacacatatatatggcatatatatatatacatatatatggcatatatatatatacacacatatatatggcatatatatgagatttattttaaagaagtgactcatgtaattatggcagatagcatatccaaaatttgcaggtgggccagcacgttggaggcccagggaagaaagactactgcaaatcaaatctgaaggcttgtctgctcactaaatatcctcttgcctggggaggtcaacctttggttctgttcaggccttcagctgattggatgaactctcctccctctaccctcacctcaataagaaggatgtcttagtttctccaggcttctataacaaaatagcatgcaacagaaatgtatttctcacagttctagaggctgggcagtccaagctgctggcagattcagtgtctggtgaggtcccatttcttggttagtagagagttgtctttttgctgtgtcctcatacgatggaagaggcaagccaattctctgggcctctaagggcattaattacactcatgagggttctgttctcataatctaatcgcctcccaagagtcctgcctcctaatatcacattagtgactaggcttccacatatgaattttagaggtacgcaaacattcagatcatagcagaaggtgatttgctttactaaaaatcagcaacttaaatgtaaatctcatcctaaaataacctcacagaaatatccagagtgatgtctgaccaccatggcctaaccaagttacaagataaaatcaaacatcatgctgtttctgtatagtgacactaaaaatagttgctaaaaacttgtatgacaaaatagaaaaatgaaagaaaggcaaattattttggaaagttacagtaaagaacataatctaaacccaacaaaaaagtttctgagactcaatcactgaacagagttggaagaagcttttattcacttcattccactgtatttaacaagtctctacttcagtccctgtggggtttctaatattataaaaagtaatatcataggttataaagatttagaaagagtgcttctatttttgaaatcaataatccagctaggacatattttctagatattattataacatttttacattaaagataatttcttgttatttgaattttatttcccctctcctcggggttcttagtaatacaaatgagtaaaattgctttcagtaggatgctagacacattgtactgtttgcaggtctgctaaacaacagaatcaagtcacctccttggcaggtgaccagcattaactataatgcccatcaaaacagtcaataagaatcacagatctgtggcaccatagaataatggcctaattaatctctgttcaatttccatttttatacctgctcccagattcccattatttcttatctatgagttcttttctcatttgaaaacatcttctatggattttccttcattcaatcagttgtttttacattcattcatgtttgcattcaaagatatttactaagaacttagtataggttatacatttatgaatattattcaaacactgaagataaagattgactgattaccacagtggacagagatacattgctgttaaaaaaatctgagtcctttaaaagttttttgtttatcatttgcaagagtatatggaatactgaagtttcttctaataatatcaaaggaatagttaaaatgccatagggactaaatgttacatatgtaaagtaacatagccatctggtctgtttcattcttatttccttaggagaagagtgttaagcatgctctaaaacatttattgagggcacgttttatgcttacgtttaggttcagttttaggtatatagaaattttaaaaggaaaaggaaaaaaatttttaaaaaaaggtataaggggatgataaagaggaggccagaaagaaaagaaaatacagtttctctcctttcaattccttaccattactttaccattcttgtgtggaagtgggagggcgtatccacagaggggtagaaataggcaaataccacataaaagggataattgcaggttggataaccgcacacattggaaccaaaactgcttccgaaaaggttataggatttagatagtgccaaagactaagtctgaaacacatttaaaatagttgtttatttacaaaatttggcacaggtccccgtctattgctacttttctgtcaacagaggtttaaagtttttagcagtgaaagttttatatagttaaaagagactgagacaatctctggaaagcattttattaccatgggattcccttttttgtgtgtggaagtgggagacctcctaattggtgttcaggtacacttcgcagtcttggttgagtgcaaggaggcaagtgagcagcatggagacattcaaagacaggaggattgtcctgggttagggtcagtggtattttctccatccagctattttctgtaacaaaagggtttgatgagttacttttcttgtgaccaaactctcttaatagtcccttatggggccggtggctgtcatggcagtttgtcattagtaaagaagttgagactactctagtttggcaaacaatatgaataaagtgacaaggtgatgatgagcatgcccatagtcttgctatttaaacaatgattattaggccactccagtgaaagataatgagaaatagaacttctgcttacagaagatgaattttgaatgcctaaggtttaaatttagatttgatgggatagaactttgcatattatttacatggttttgaaaacaggcatgaagagagaacaaggttgtaaggagcttaggacagaagagaccaagctgtcttataattgagtcaggacgaagcacaggaatgttactttgaatcaatgctggccttaatggtccactgatctatgggagaagaaaaaaaacttgatatttaagcattggtggaaaacacacacacacatacaaaatttctgaataccagagactgagggaaatttgtacccaacctaattagttgaaaatacaaagcaagtttcatcaatatagcttgtatagggttaagaaaaatacttaagcattacatgattgctgtaggagcccattttttggaaaatttccagggactctttgagtcaacttgttaaaaacagaagaaaggctaggaaagaaatagcttgttttatgcctgtgattataggatttcatcattatgtgggccactgagtgttattttctcaagttcatgcatatgcagagatttaaactaaatttgtgttctactcaccacgttaagaggcacaagttatcaaagttactaccaatacattctattcccccgaaagacattcaaaccataattctctcaagttaaaaaaattaatattttgtaaagtaaccattgtccctcttctcaatataatccaagtgctaacacctttgaacacaccaacaatggtctcttgattaaaaagaaaccacattaggaaagtcctttgaataacataaattgtctcctataataaaggaagacattggaggtaaaaaaaaaaaaaaaaaaaaaggtttcagcaccaatcttcaatctctctctcacaccacagaagattcagagctggagttgggaaatgcagtggacttgggtaaactgaggttttcagtcttcatactagtcagaggtcataattgattgagtccagttgtgatataactttgggcagtaattttagtcaattgcttcctaccaaagttccgtgctctttgctggaggctccgtttctgaaaagctctccctctgcccttctttctttttctctgcacacacaaccctcacgcagctttcatgctgcctaaatcagcctgtggattaggtattttctcattatccagattaaaagacagctcagtctcacagagatgtaactgactatttgattgaaactgacttttttccccattggaggcacatcagaatcacctggaaactttaaaaattctaataccagaccatagccttccaattctgattgcgtggatctgaatggggtagttccctggtcttactcttcacaagctccccatgtgatgttaacatcagccagcagaggctgcgaacacccataaaaacaaatccagatatgttaatagatgttagggaaagtgggagaagagggggtggtggatttgcaaatgttaaacttgttacccaaataacctctccaagtaaaacttttggaaggatagttttgatcaagagaacctgcccctttttggatctctttcacctgcaaggagaaaaaaagtgagaaaaggaatcagctttttataataaaaaaaatgcagatggagattccgaagtggctcttcagcgtgaggatcgaatttttacagggaaattccctctgaaatccttctagaaattcctgctatatcatctcccacttacataatcattgccccttatccactaagcaccccccacccccccatctgacagtcttgtcaacctcatgtgtctggattctcagtcttagtacagtccctctttcgggggagggagagctttggagtttggaggagaaggaggaaaagtgtgtgtctggcctgaaggtgatgatctaaaagaagtttccactgaagaaacacatctgggtgtttcacaatgtggctccttgtatcatctacatcacttggaaacttgttagtaatgcagattctcagacctcaccctggacttacaaaatcagcaatgaggggctccggctgagcagtctgtccgagcaagtcctccaggtgattctggtgaattccagtgcaggctaaagtttgagaactactggctatctcatgttttctcttgagcttctcttaccaaccttgggttgctttgttcctgtttgttttatagagcttttctttatagagcacccttggcataagtagctccatcttagaaaaagactccatcttacattttaaaagccatcatgccaacagggaccaggtgttcggctaaccaatagagactgcacccaaccagataaggacataatcattcacaccctttcactattagtcctcgctagaggactctgtggccataaaaaagagcaggatttcaccaattggaaactgctgtcttagcagacaccatctttctgtcccttgtgataagtacccagcatcccctgccgaagactctgcccacattaaaatctcttccttgcaagaccctgatggaccacctggatcaggacgaggcattgtttggtccacattgctctctctgaactggtttgttaacccttttttcctatctcctttatcttgatgttaaatgttactttgttgtggaatgtttagtcaaaacagataggtaggtaggtaggtaggtaggtaggttatgtgtggtttgcaatattgtctgacctgtggagtgacttgagcttgtgtgcctatggctctgccaagtgaatgggtagcactaaagagaattacctcctctggagcttcaggtagctcatggctttgatgattgaaatagcattggtgaaagtctgacattatggaaagacacaaatatttgtggacttggtcatgtctgactgtgcactgctcatgataccttcctattacttcgcctagagcctgaatgggaaagggagaggcaagcaactgaccaactagcaaacaaataaaatgaacctactgtgaacagaaaaactatttctgcccatagtagtggcttattgcagatacttatcttcagtttaaagttatctttgagtctctatgtttgtagctggaaagatgcagatgttttaaatcaagaaagttggacaagtttgttcctaatattccttccaagtttaattcaatggatatatgagtttggggattaataaaaaaaaacagcaaggagtaagaatctttgggaatataggaaaaagtgctgtattcaactgggaaatatctacatatttaaagacaacttctcagagaagatgattataagcccacattatgttttatttcaaacgtgctgttggatgaaaagttgctgaataagctgaattcaagattctcccctaggtagaaacatttgggtgaggggtggtggggagaggtcatacaatgaagaattgtctggttaaagattaggctacttgtaagatggattaaagatgtaggcaagtttcaaaactgatagtcagctgagtggatcttcccagaaaggatctttaagtatcatgagagtttatcagaaaattgctcaagtgttttattaggaattctaattattttcaggaagggctgtgaattacatcttgcaaaaaagctctgtctcccaacaggtttggtgacatttattttttctcagtttctagtctcatctcttctcacattttatcttttgttcacttttagtaagtaattttaacttcctggatttcaattgcttcctctataaagcagggataataatttcataccataatgaaataataaggctagaaaaataatttttcttttagactgttccaagttttgtaactgactaatctaaattatgcattggggggaaggtgatatgagatgtgcttttcagtccttggattcgatactaattataataccaaactcatggtagattgatttattctgtcacatatctatcaaacatttgcagtttctgctgttatgtatgctttatgcattttacaaaaaatcatcccaattacacaattactctatgatgtaggtacaagaattatccccattttatagatgataaacctgagacactgaaagtttaaatagctagcttacactcaacagtgtggtatgtggtttgtggcagaggctggatctgaactcaggaagcctgcctcttgtgttcaacaaacaattcactagttgatatcctgtcattccacttgattctccaaaaataaggttgggccttgtcaaggatcaaatgaagactggtaatcctaaagaagttgaacttcagagagcctcagtgggagagaataacatgcctagtccaggtcgttaaaacttagattattttcttacatagtattggctactgcccgttctgatgcttgtacatttctgttacggtcctcggtctctggattgaaccttatccactagattggagcataggcactgtgattcaccatgttattctggaatctaatatagaaaatgacccagaagcaccatttttaacaaacctgggttccctagccacgtagaagcatcagccagatccagctggagccaatcctgctgattagcttaacaggttctctgttttttttttttttttttttagaaaaagataaaatgttacaagatagaacatcgtcttattgcttcttttgttttattgcccctgccattttcttagagcattaaaaagaaatcactttctcagatggtatgaggatgaaaggatccacattgggaacaggaaaccaaagatctctgaagattttgaaagcagagaaagaataaccaggtgtacataatgataactaggaaatacaaaaccgctgtgagcaaaactgtttcttccagtttgggaggctccaaagtgaatcccgtgatcttagacacagagatcaggttaaaagagcctttcttccaggcagcctgctgctgcatgatgctcatcattccacatcctgaacaatcctcaggcttcaggctggacgagtggtctctaggtaccactgtgtacttaagagtgccattttctgagtgcatcttctgtgccaagcactgtgctgacatagtatcttattggcaactcttaatcttctatggcatcagtcttattcctattttagtgacaagggccctcttttgtaagtaacttcctccagccccacagtaagtgcgaaaaatgggattcattcctctgactctttgaatccaacccagtgcttgggtgtcttcaagtatctctgaattcctgacctctgggattcagtgatttttatggcattcatgtgatttctgtggtgagttccctccacccccaactccacagggcctgtctgtgaaaatgaaagataccagtcagggtgcaagacacagtctgttctcatggagtcagtgaaaacttcattgtatttgaaagaccctctgatcaccagaaggtcattcttgctcgccttttccttgactataaggttctataagttttttcgtaatgccacttacaataatacagtatttacaattacatcagaatgacaaaaacacagtttacaggagttagcacctccaaagcatgacaataataggaaaaatgtatcaccaagtactagtataaaaataaaattctctataaccaataatgttgaatcagagagccattttgaactaaagaagtttttgattcccttgtgttaactttaaacaaacttttttggttgattttttttttctattcattccttctgtataagaaataatggagaaatgtgttaaacttttagttaaatgtgtgtcaaagtttaatataaccatatggtttttcctagttttggttatatatgggaaataacatttgattcactcgaataactttacagttgaccgggcttgcttatgttggtgaatgtatttaagctcattcaaaacatacagcttgacatcttagaatctgaggaatgactttaggcaacagttaagccaatttttaaaattctcattgggggcactgaattgaaacgctgtaatcttctctagaactatcttctatttcgtgtttcagcaaagacttaattgttctttgaagaatttcttactctaaaaatcgtagcaatttatattccaaagaaatacaattatcttgctcagaaaagagaagaaatgtagaattgcctttatttctaagttataattgcaatcatgtattggcagcacatgtgaacaacttagatataaaattatgatggggaaaaaacctgcagcaagaagcaaagtgtgcatagataatgatcctctgccaagtaaaatgagttctatttatgtatttgtttaggcatattaagtgtctagagcagcagtaatgtgaactttacctttttggttgtttacctttttcaacacctatcaatgctgtattggtaaatattacatacacacacacacacaaacacacacagtcttgctctatccccaaggctgaagtgcagtagtggaatctcaactcactgcaacctccacctccagggttcaagcaaacttcccacctcagcctcccaattagatgggactacaggtgcatgccactacggctgactaatttctgtatttttggtagagacagggtttcaccatgttgaccaggctggtctcgaactcctgacctcgagtgatctgcccgccttggcctcccaaagtgctgggattacaggtgtgagccaccatgcccggccaaatattatatgttgtacgcattgggtactatgtattttaaagtcaattatgtttaactttgctcttattctataattttgcacctctggaggtaaagttaccatgccatataaaaaaaatggagataaaagtaatacattttacgataaaaccactcttccttttgtttttatataaataataggtagaggtctctgtacatattttatttctatgtttgtttgtttatttgtttatttattgagccttcgtcacccaggctggagtacagtagtgcaatctccagctcactgcaacctctgctttctgggttcaagggattctcattcctcagccaccagaatagctaagattacaggtgcacaccaccctgcccagctaactttttttgtatttttagtagagacaggatttcactacattggccaggctggtctcgaactcctcacctcaaggaatccccctgccttggcctcctgaagtgctgggattacaggtgtaagccaccacagctagcccatattttagtaaggaaaatgatgggtggcatgggactttgaaaactaagacgatatacttagtgttttaaaataagattttgttactgatataaaccacattgaagtgaggaagactgggtcatagtccagcaaagattgcaccttattttcttaacacgctaaagtgacaggccctatggttggtggggaagaaaggccttgtgacctagagggagaaaatgagatctttcgattcccagagtgagagagaaagatggacactgtctttagattataaaattcaaaaagcctaccgaaggggtgttgagagctacacttgaagggggctctgtattcatttagggacatttaacattacagctttctgtcatgttagcataggtcactaggtgtaaaaatggcatgataagcaatatgcgggtgttaaatgtaggagcagtatgcaagagtatacaggatagaaaaagccccttgagtccagaaagcaggcttgagtcaagagtgatagcctggactaagtggtattaaagagaataaagaggtagaacaatagaaaatagctcccaaagaaaaactaggcatacttcataaaattacagaagcagggaacaggatgacaaatgtgatctacatttgaaacctgaggactaacatgtgaagttgcctctgaagagatggtaagggaacctgtctgtgtgaggggagtggtggggaacaggacagttaatggacgcattgaacttggtgtcatctgcgtaattcaaagaaaacatgtagtggtgggtggaggaagatttggatataataagttgagtcacaggactgacgttgagtgaaggctccaggaaaaaaaaaatactaggactgacattttactgataatttacaattcttaagggggaaaaagagaaaaaaaatcaagcatagaaacaaaggaataataataggtattaggagaaaaaagaaacacgtggactaagtgagagaattttatgaaagaagggatgctgataggtttttgacaaaacgcttgggcatcaagagaatgaaaaggctttggtttgggggaaaaagtctcattggtggcttttgagaattcagttttagtagagagatggagttgttttaagaggaagtaaatggctaattgtagaagtgagctagggcaatgcccatcaggcagtctcttgaggtccagtgaaacattgaggtttagaaggcaattattgatcacattcagaatcagcttacacagaagtctgttgaacaggaagcaagtctgccaagcagggcaacatcgagtaattcctttcaaagggaatccttgcagcggcccactcagcaatctaatcagataacctaggagcactcctttggggctccaggtaacagctcaggtgcaaggagacgaaatgcacagtgggtgtgtgcaggaccttctgccataatagcctccttctaacaaggggtattcctctcataaacattccttaggcacaaaacacaccaagttacaatacttaccacatgtatggaactccaaaactacggtaccgccatcaggcattcataatttactggtatttctccaattcaagtacaatttattttttaaaatgacgctaggaaattgggagtccacagatcagcatgagcatgaataagggaccctctgtgtgaaggaagttaaggatcttttcacatggagggtgataatgaaaactttaagtgagatgactcactatagaatccaggcttcatgaaaaatatggaacttgggaaaatgtaataggttgagtgactagatcgatagtggaggttcagaggcagatggagagaggcaacagaacagattgcatcgtttcagtattgaacaaagtcttaagtacataatgagtgcaaatatttgtttgattaaaatgagtgcaaatgggagcaccaagttcaacatcttagtgtttagatgggtgacatacaaggatgatgatggtttgctaaagaagtaaataagtacaaataaaaacaatatagagacagagacgttcaaagtaatagatggcaagaaaccacaggaaatgcaaccctgttggtgaaatcactcaatcatcatggaacagtcttgagtaaaaatgaaattggttattaagtgaatttgtttttttattttatttttaaattattttttaattgatgcatagtggtacatattcatagagtacatggtgatatttcaacacatataatgtttggtgatcagatcagagtaattagcatatccagcatctgaaacatttattatttctttgcattaggagcattcaatatcttccttctagcaacttgaaactatataacaataaatatatattaactggactatctccattaatgctctatgtagccatatcagaagtccttagattttttccttcacatttttttttgcttatttacagcacaagcacgtatgattgcagcaccccctaactgttctcccgtacttgaagaaatgtccagtcccctgaatgaactcacctataactgtatgataccctctaaatccagctataaactataataatcagcttataggtgaaaaagagtcgaagatcaggggtgcaaatgaacatcgagatgatccaatgtaaactctgttttgttgatgcggaaactgaggcctggagagttaagtgacctcctaaacttgcagttcttggtaacagttgtgaacatgaattccacgtctagtgctctagactaacccatgctgtcttcaataattccagtgaaaaagcatagcagtttagtcctcccaacaccaatgcatgttcccacattcccttttctcaatctggattgttttttcctggatgagtcatatgtttctttatcaaattctaaagcttcagagtgaaagcagaggcacagccatcctatatgaataaagcagatggaagtatgggatggtttcatatggaagtctacaggtacaagtcacataactatattttaagtcagcatcttgtaatagcttccttccagtgtgcgttatgggttgtagcatgttgtggtcagaagacatgtatttaagtctgttctctctagtttatcaggtacctggctgtaggcatattcacttaacttctctgggtatcagttgaaagatcattatatctaactgtcagaatagttttgaggatgacataaggttaaaatgtataaaatcatgagacattttcctcagtacatttgttttctctttttacttttcctccaattctgctatcaaagctctggaatgtattaccaatacatctgtcatctgttaatattaatgggtcttctgtttccttaaaatacctcgataatgtataaataggaaaaatattactttatatgacaatgacatcaagaaaaagggagaaaaataagatctgagttttctaaaagaaaaatattaaataaacaatatttttaagatatatgaattcttcagagaagacaatgtttacacagggtgaaattcaaacgtaattttctgctgaacaactgtatatggaggacatttatggcaaatacaaagcagtgtttatatcatttgcatgtgtgtgtttctttgttcttaaaaaggtttcagtgaaagacaagagcatcgtcttaaaagtgaatctcaaaggttgaggctgttttgttcaaaggagtagacttcctgaggtttatgacaaatcaatgcgagggtcaaatttaaaacacctagagaagtagagaatgctgtattctttatattatccaaactattcaattaggtttttggaaaaagattgataacataaattctaggttatataggttatctccctaaatctgaataaaattctgagagtgtttagtgcttatagctgtaactgagtacattttccactatccctccctccccacaaaaggatagattggtcattgggtcagtcttgttggagacgactggcaagtcaaatggttttggaaagtaaagtggatttccgaacagaaaatgtttttccgcggaaactatggaagagatcaaggacgaaggcaaactaaaccttgaagatgaggaacggtagtgagccatatctaacaaaagctttactattcatggcttcctagtttgcaacttaacgtgaagtttgttcacatagatctgagaaaataatacctaattattgtgaaagaggacttaagagggattctttagcatggttcaggtggggctttaataagtaaaggcaaaaatatttttgtttcaggtctctaagatacatttcatgtaaaagtccataatataaaatgcaagcctatacctctgagtcaaagattcaaaagcacttttaatattatggggaaaaatttttttaaaaagccttgtagattatcttcaagggtttgaaattaattccaagcattcattagaggacaggaaaagtctgaaaatattatagtatgcatgagatgacaaatggaaattaaatgtgtactatccacactataatatttcagagaatatgaaaattaatagtgataccacagaacctgtataatttttttcctccgtgattttgtagggaatatggaattctgtgagaagaccttgtagttctcatattgtacaatgttctttgaaagcaggtgcgtatgccttgagttgtggtctcctaattatttagttgagaggtgtaaccaatggactcacctgtgtgaaaggatattggctctttatggacgcggaaattcaatgatagtgattctcaaaatgtggttcctggaccagctgcatcagtattactttacaacttgccaaaaggtaaatacttggcactcactccagaacaactgaattagaagctccaacaatcagcgttataatatgttttccagagaattccattgcagctaagttttaaaaactgtagtctctggcaaaatccgaggcacaaccagacacatctctgtccacattttacagtctctggcaattcatactgaaccacttgtaataaacatgttattcggggttcatcctaatattatgcttctagcttttgaatgatttattaaaaatatagctagtaatgcccttctaatttatcagcaatgtatccttttggtcacccattaaatcacatgagaaatgtttaaattcctgttactctggcagtggattgaaatccaggcaccgccaggttaaaggttccttgggtgattccaatgtgcagctacattttgggactacttccttactaagcaaatttctcagcttgattatgcataaaaattaccagttcaccttctgaaaacacaccctctacccccagagattctgatcagaaggtctaagatagttctaggttgttgcatttctaaatagctccacatacaattctatgttgttcagccagtgctggtaccaatatttggaagctctagagagaaaacctctcggtacttgttcttgtcaagtggtaagggatactttaaaaaaaaaaaaacctaccatgaagaacaactcacctattgcaagtttttgatctgtaggtcagagaagtgaccttttaacacaaatattatttgaatggcgttgtcaggttactttcactggggaaaaaaataaaaaatccatgaatattcagtgatacaaatggttagcagaagacaatgctaaaaatgaagggtattatgacagccaactgttttaaaacttcaagtttggagatctttgttacttagaattttgtaatctgaacaattattctgaaagattttgatggatcattagataggcaagcatctgttcaagtaaaactggttatttgctgacaaagcagaagataattaagaatcataattaactataagctagacataagtcaggattataacacttattataaccatgtataatgataaaatttctcattatattcatctaaagatttttgggtgcttaccgtgagccaggcactgtgttaggaggcaagcaaaagttacaaagaatggatgataatcttttgttataaaatgtagactgttgttcttaggaccacaattcaaagaggaagtgtaagacaaaagttcaagaagggcagtggaagtgaatgtggaacatactgaaggattttacaacacactttgaaacgtttaaaaaacctgcaatgattttacttgaatgcggaaagacagaatgctaaagctcaagcattgaaagagaactaaatacatagggtgtgttacgggctgaactgtgttcccccacaaatcatatgttgaagtcttaacccctggtaccctagaatgtgactgtatttggagacagaggctttaaataagtatctaaaacagggttgttacggtgttctctagttcggtctcactggcatccttaagaggagattaggacacagacacacacagagggaggggtatgaaaggacgcagggaggccgggcctggcgcggtggctcacgcctgtaatctcagcactttgggaggccgaggtgggcggatcacgggttcaggagatcgagaccatcctggctaacacggtgaaaccccgtctccactaaaaatacaaaaaaaattagctgggcgtggtggcgagcgcctgtagtcccagctactcaggaggctgaggcaggagaatggcatgaacccgggaggcggagcttgcagtgagccgagatcgcgccactgcactccagcctgggcgacagacagagcgagactccgtctcaaaaaaagacacagggagaaggtacccaagtacaaggaaagacgactcagaagaacccaaatgtactgacaacttggtcttggacttccagcctccagagttatggggaaataaatatctattgcttaagcacccagtctgtgtattttgctatgacagccccagaaaactaatacagatagtaacttgctgtagacactgtctacagagtaacaaacataggcaattaactgaacatgggaacaagacttagttggccaaaggtggtggtgcttgcctccaatcccagcactttgggaaactgaggcaggtggattgctttggcccaggagtttaagaccagcctgggcaatatggcaaaacctcatctctacaaaaagtgcaaaaggttagccaggcatggtagtgtggtgatacatgcctgtggtcccagctactctaccctgaaggctgaagtgggaggatagcttcagcccgggaagcagaggttgcagtgagctgtgatcatgccgctgtcctccagcctgggtgacagagggagaccctgcctgggagaaaaataaaaattaaaaaaaaaaagtcacttctgactatagggattatctgggagtctgcaaggtcttctaaaaggtgatattttaaatttaaaaagttacctatttttaactcctggtagaagtaaacattgttcttccttgaaaacataaacaaaacaacacgaacatctcagtattgatttgtcatctccttttggaccagatcaaagatctgcctgagataatttgacttatacataatattaaatggtattagagtgaggttacagtatatgatttcagtgtcttttatctcttacatactgtgttctctacccggaaggagtgaagcagactgaggggtcacgtggtcctatagtatagaaatcatatgtagaaattgattcagctctgatgcatacatatggatggataccttgatatttaaatgggacctctgtctcatttctccatctccctaaataattaaaaatcagttcactcttccgggaatcattttgaatgaattgaagagtaatttgcaaagcaagacgtataggggaaagagcatgcatgtgtgtttgagtctatggggacatcgcatttggcatgaggtgctcaggattcagaggactgtcttgcattttcctagcagtcagtggaggccttagcattccaacctaggaagctctatagatgtaagcaatgtgtttgctttatttgactgctatttatatgacagtgacaaacagatatggggtaaacttactgttttgaaaaggtcagacaaaggcaaggaaaatagaagcaaatgaagtgaacgcatgaaaaatgattactcaaagaaagatacaattatgcagagcctgaaatcaactcttggtttaatgttgtgatatgagtctctcaagagaggacagcaatccaaaaccatttccccagagaagcatggaattttacagttagatatttatttattgtgggaagtatttttaaacatctttcaaaatgcaaatacttagtgtcaatgtgtttttagaccctcctctgtgaaagagatacgtagaatggtagaacaaggtaagagtctaaggggaagtgggataaaatttcaggaagtgaggggttgtgaatagtctgaaatggagtatctgagctgcaggaggagcagcagccacttactggtccctgcgggcctgtgcccactagggcatatcaaaccctctgatggagctgctccaggctagcctcgtcaagccatctcccagcctcaggccgaggagatgcctgacggggccagcctggagcagctgcatcagaaccctacagctgttaagaacctttataccagcagccacaataacaccaaggtcacacaagatttcaagcaatggaggatgcagcaagacaggtgatagcatcagtgaaaactttaaatgagctacaaatgttaacagtgttcccctgcttaatttactgttttcctaaacagctatgaactatttgaggtgaagctcaaaaggacatactgaggtccaggaaattgaggtcaagctgcattttccagacagaggtttcaaatcctacatgaggaggaaggttatttacatattaagccttctgcgaagttcaataggtagactcttgagaaggcaagtcttgatttgtagaaagggctccatctcttaggcacctgagacccaggtcacccttagcgttgctcaggttgtacttcagaaggactcccaggtaagggaggagtgagagttaaattctagctcctgacaagcagggctgtgggtacccagaagatggatcactacttctttatatgcacaaagattttttttaattttattgtattttaagttctcggatacatgtgcaggacgtgcaggtttgttacacagataaacgtgtgccatggggcagcagccatcactgtagctccaggccaccattttttcctctgctggtgctggggagactggatggcttggtcccaagaggtagttcctacatttcagcacaccagctgtggaagatcgtggcccaactgcctctttaggacagactctgacccatccctcctcactgagtgggccctccctgcaggaactccagcaactccagccaggggcttagggaccaaactctgatcttcctgggcctgagcccctagtgggaggggcagctgtgatctccgtggatcagtagatttagtctcttctcctgctagctctgaggaatccggacagctcagacgagtgggtttcccccgagcacagcacactccctccaccaaaggacagtcaaagtgctttgttaaatgggtcctggatcccgtgccgccctgactgggtgagacttcccaacagaggtcaccagacaccttatccaggagcattcctactggcatccggtcggtgccccttgaggacagagatcccagaggaaggagcaggaagccatctttgcctccttaggtgacatctccaagtgtgggagggacccaggtgaatagtctgaagtgaacccccagcaaaccacagcacccctacagaggagggacctgactattgaaagaaaaacaaaacaacagcatcaacaaaaaagtccccacaaaaacctcatccaaaggtcagcaacctcaaagatctgaaccagacaaactcatgaagatgagaaagaatcaaccaaaaaaatgctgaacactcaaaaggccagagtgcctcttctccaaacaatcacaatacctctccagcaaggacacagaactgggtggatgatgagatggatgaattaacagatgtaggcttcagaaggtgagtaataactgttgagctaaagaagcatgttctaacccaataccaaaaagctaaggaccacgataaaaggctacaggagctgctaactagaataaccagttgagagagaaacataaaagaccggatggagctgaaaaacatagcacaaagatattttaaatgtaccaagtcatacagccattgagaccacatctttttaagtttttaatttgcaaaaagttgtagaggcagcccctatctccctttgtggtgtatcagcctcagggatcttggcaggtggaccagcattgggatctttcacagcataatttatctccatgcttctggtgctctgagtatctggatggtctgagactattactatgaagaacaaagtcatgataaggtatttctgcagcctaagaaaactgcagcattctgttcactgagaaatttgtgcttccataaaaaatgattttaaaaccctatctattattgcagtgaataaaatgagattttgagcctattgttggatttaatcattatttttatggcagaactggggttgtgggagtagttataaccagttgtgttcttttaatctcttttattaagtcatttatcataagtaaaattcagtttctgaccttggtgctttatttaagtttccaacttatctgtttcttagcatgttttgtgttcccattttaagtctgtaagggttatagaatacttatttcattttctctataagaaactgtttagcaatctaggatagtgttatgattaaatggcaaaaagaagagataatgtcaaaattaaagctacttaacagtaaggggcatggaaggctacatatcaaacccatctacactcaagcttcattttcaataggggattttctatggcctcttggctttcttgcttagcttaatccaagatttctgattatcaggacaagagaagagacaaagggtgaacacaaaaagtcatttagaataaatgtatgtcatatgatagtccaaattaaatgcttttggtattgctgtatccatattcctttaggttacatccattgattctttttacatctatctgcattgcatagccctgtaatacttaaaaaatttcaaacagagtaatgaaaagcatggaaattcaaaagacaacagtgaaagtaatggaaaacagtattaataatgtccagtggttgaatggcaatgagtgatactcaacgattgaggagtgaataagattaattaatttaactttgatggtgatgtcctctcctagaatcttgtttcctttcatgtttttggtacgcatccttcctctctctgatgttctgtttcaaaatttaccctcactattaagcttttcctattatgccaaccaaggttaacacatttttttttttctgaattcctataatagtgctgctatccacgcaactatggacttggtgagggcaggaataagatcagtttgcatcccatcagacccctagcactgttagcatagaattgggattcacttgtttgttgaataaataaatgtctggataaataattgccataaaatttgtacttaattttcatagtactctcataaaactgatatgtgttgagtgtgttttcgattataaaaatcttgaagagaggatcagtgactttcagctcttcattttcctaccctgacaatcctcagttctaactattgagattaacctcatgaagtagagtacaaggtacccaagggaagtctggagtagtccctgtgacatttctggtcttcacagaatggtgtttgtggttgtggtgagaagcagtggaaggttcctcccacacacatggtctttcacttttccctgaaatctggcacccttgacctgcttgtaacctactttgtgctgacccattcaccttaataagaaaggtaaatatataagcattacagtccaaatattttttgaatttttataaatggtgtttaatgctatgagattagaatgaatctaccatttgtagacatttattaaatgtctactatctaaaaatttaaatgtatgtacatcctcttttttgacactcattcgacactcattcacttcaatgtttttaaatatacatacagataatgaccaaatttatatcttgctgcactgacttctaaactctatgcagccatgaaaaaggatgagttcatgtcctttgcaggaacatggatgaagctggaaaccatcattttcagcaaactaacacaggaaggaaacaccacgtgttctcacgcataagtgggagttgaataatgagaacacatggacacagggaggggaacatcatacaccggggcctgttgcagggtgtggggtaggggagggatcgcgtaaggagaaatacctaatgtagatgacagattgatggctgcagcaaaccaccatggcacatgtatacctatgtaacaaagctgcatgttctgcacatgtatcctagaactgacagcattataatgataataaaaaaaataatggagatagcattagggatgtcagaaggagagcaagtttgatttcagatacactgagtttttaatgtcataagagatttaaactatacagtccaaatttttggagaaggattgagattttgttttcctattacacagaagaatcgaaaatgaaagattttattttctcagcatggatgcatccaggttttgtgtagctgaaagctttatacaaattggaggtaggggacctcttgatacaaaactacaaataaagtactaaatggagtctttatttaatgaaaaaacccataacaaatatttggagccttggatgctcgagtctctaattttttaagatgtcaagtgctttactagaaatacttacaatgttatgatgaaatgcttcctgagtgtaacctggcttcccttccttagacgagaactcctagaactcacgggtcctgaatctaaagcttaattcaccttgcagtaaattctcctctgtttggtccttgaggattgataaagacttattttgtgtgtgtatatgaccataagatatttcaaaatgcacttttatttcttctttttatgtatctagggtaacttttaggttaagaaaatgttttatttaggcttttctaattgcaaaaaacaaagattctctcaagctatttcagcagagggaaggctcagttcaggagctgagaaagtgttcacccactcaacataaccatgttggatatataatgcaatccagaccctgtaacatacagacacagcaccttctatcaaggagaaggagtgacttagaatcatcatcacataaatacatgtgcaaccgactgcaatagtgctatgagagacacaatatgccgagcacatatgacaaggaaacaaaccaggtcccctgggttttgtttacatgtttgctatattcctcttgtttttgatgatattgctggaggagacagaagggccaggacaatcaagattttcccgagcaaggattatttgagctgagatttatgtatggataggtatttgctaggcaaaagtagtagagatgagggatatgaggtttcaggccatggagttaagagacaagactagcttgttacaatggctcatacctgtaatcctagctacttggaggctgaggcaggaggattccaggaggccatgagttccagaccagcctggatattatggtaagaccactgtctctaaaaaatatttttaaattaaaaaatgagttgggtttcgtggcgtgctcctatagtcccagctattcaggaggctgagatggaagaatagcttgagcctaggattctgaggctgcagtgagctatgattgtgccactgcactccagcctgggcaacagagtgataccttatcacttaaaaaaaaattaaaaagaagaatgaaaacacaatacgcaacataacatggtgactcaaacctaaggttgatttagaattcgcaatagtttcaatgaaagcaaaaagtcatgagtcatgtctcttctttctatatctattctgtctagttcatgagtactggccacaggtgcctatgaacccttgaaacacagcattccagattgagatgagcttccattgtgaaatactcagtatgtatttgtatgtacatagtttgtaaaaggctttgtatgacaaaaaaggatgcaggatatctcattacaaactttcatattgcttgcatgttacaataataatactttggatattgggtaaaatagatacgaaaattaagtcgctggttactttatccttttattaaatgtggctactagaaaatttaaaattacacatgtggcttacctctgtggctcccattatatttctattggacattgctatttgagcaatgactcttagccctggctgtatgtacatcgccacccaccaggccacacaatagacctagggtagtagaatctcttagggcatctgcattttagacaaatgacctcatttgttactaatgattgtcacacaggtgttccacaggctgttcctgtaaatgccatggctcagatgtgtgtattatacattgtttctgcttctttcagcccttaagcctctggtaagctgtctctttgaatctagtcagagtccaggaatcttttcctgctagcatagcctcatgtgcgaaataagttgtgttgattcatttgccattaggacgactgtggtggcagcctccactctggatttactctgtagggattcgtaagtcatttttagtccatgactcttctcttccccctaggaagcccccaccagagacaaaactagagccgctttttatacctgatttttcggaagtcagcttcagaatggatttgtagaaaatcttgtatctctaccagctcattacactttgggtaacgttattgaacgtagaatttaagtttttaaaacagaaatgtaagtagtttcacgaaagaacaacttgtatagatcatgataacacctcgttaaattgaatagatccttgtcttagctgctaagtaagttgatattcctttaaaataccattcatttgagaagcagcaggaataagtgtagttttttcctctctccattgaactccagcttcatgagattatttattttattaaataaattcaagcaacctctaaaatgttctcaatttttgcagcatgatgtctaatgtctttatatggagtgtaaaaactctcacagtctggtccaagtccagtcttgttccccagttctccctctgctccagacaccctgaatgccagccaaactgcactacacattatccctaatgcatgctctgtgtattagtctgttttcacactgctggtaaaaacgtacctgagactgggtaatttataaagaaaaagaggcttaatggacttatagttctatgtggctggggaggcctcacaatcctgatggaaggcgaaaagcatgtctgacatggtggcagggaaagagggaatgagagctaagtgaaaagagaaaccccttataaaaccatcagatctcatgagacttattcacttccacaagaacagtataggggaaccacccccatgattcagcgatctcctaccgggtgcctcctataacacttggaattttgggagctacagttcaaaatgacatttgggtggggacatagccaaatgatatcactctgcttcttcaaatctctagtaatttgaaattattatcattattactacttttgagatggagtttcactcttgttgcccaggctggagtgctatggcgcagtcttggctcactgcaacctccacctcctgggttcaagcaattctcatgcctcagcctcccaagtagctaggattactggtgcccaccaccaaacccagttaatttttatatttttagtagagatggggtctcaccatgttggccaggctgctctcgaactcctgacttcaggtaatctgcctgccttggcctcccaaagtgctagaattacaggcatagccactgcacctggccttgtaatatgaaattagattgctcatcctagaatcttgtaacccttctccataacaaacttctactcatcctctcttctgacaccttccttcccgactcccttacataatgttagtttgccaaactctacttcagtactaaactctaaaggaatttatttgcatgtatacgtatttttcacaagtaagcactagagcacaaggttgaagttcattacatacctgtctttgatgggtagaaagagcagattatttgaagacgttactgtatctctaccttcagcctatgcttttctcttgccatgtattccagtttctattttttcgagacagagtccggctctgtcgcccaggctggagtgcagtggcgccatctcggctcactgcaagctccgcctcccgggttcacgccattctcctgcctcagcctctcgagtagctgggactacaggcgccgccaccacgcccggctaattttttttttttttttgtatttgtagtggagatggggtttcaccgtgttagccaggatgctctcgatctcctgacatcatgatccacccgccttggcctcctaaagtgctgggattacaggcgtgagccactgcgcctggccatgtattccagtttctttaagcttcctatatacagtgtgatttaaatctacttatcatctggatgatttgtcttttaatatacttccatttgcttatgttgagtgaagttatctgaggttagaataacgtacataaaatgatatgtgaattgtaggccttggagagaagtcttaaggacactcctgtttttagctattcttcttttccatttgctgctgtggactgtggtttattttagactaaggaagggcatggtgcggggtttccactgctgcttaaactggagttgaaatcctatgttctgcttcctggcccactcccagcctgcagaagcccccagcactgaggacaatctaaacgggcgggattgaattcaccttatcaccacttcgcgccgaaatttacagtctacgttgaggggttctgggttttgtttgtgttgtttaaattgttgtggtattgatattactgttttaaaattaataattatggtagcatgctttggttttgaagcttcaggttgtatatactgaagagcaacatctttaatttttattatttttattttagattcagagggtacatgtgcaggcttgttacctggatatatttatgtaatggtgaaatttgggctactagggcacccatcacccgaatagtgatcattgtatccaacagtaatttttcaaccttcacccgctctgacccaccccactttggagtccccggtatctataatttccatctatatgttcatgtgtgtctattgttgaactctcacttataagtaagaacatgaagtatttgattttctatttctgagttatttgtcttaggataatggcctccagctcaatccatgttgcaaaatacattatttaatccttttttatggctacatagtatttcatcattttatatatgtaatatatattttatatatgtaatatatattttatacatatatatttatatctattttatatatatttttatatctatacatatatattttatgtataaaaatgtaatatttaaacatatataaatatatatgtaatatatgtatattatatatttatatgtgtaattatatattacgtattttatatatttcatatatatgtaatatctattttatgtaatatattacataacatatattacatgtatgttatgtagtatatattacatattacatatatacacacatatatataatatatacacacacagacacacacacaaacacagagacacaaacatcttcttttcctagtcatctgttgatacacacttaggttgactccatgactttgctattgcaaatagtgctgtgatcaacatatgagtgttgggtagatacacagtagtgggatggctggatcgaatggtagttttacatctttgagaggtctccgtattgttttccatagaagttgtactaatttaatttcccaccaatgttatataagcattcccttttctccgcatccttaccaatatctgatgtttttgactttttagtaatagccattctgacttgtataagatgatcatcattgattttgatcatctcattgaggcttcaatttgcatttctctgatgaatactgatgttgagcacatttttatatgtttattggccacttgtatgacttttgataaatgtctgttcatgtcctttgcccactttttaatttttttgttgttgttgttgtttaatgaagttgttctttgagttctttgtagattctggacgttagtcctttgtcagatgcataatttgcaaatattttcttccattctgtaggttgtctgtttattctgttgtttatttcttttggtgtgcagaaactttttagtttaattgcatgttatttgtctatttttgggtttgttgcattttctttgaggttttcatcataaattctttccctagaccaatgttcagaagaatttttcctaggatatttcatgtttttttaatagtttcaggtcttacattcaagtttttaatctatcttgtgataatttttgtatatagtgagaggtatgagtccagtttttttaggcatatggctctccaattttctcaacaccatttattgaataggatgtccttttcccattgtttatttatgttgattttgtcacagatctcttggttgtgtgtggctttatttctgaatcctgttctattgatctgtgtgtctatttttataccaataccatgctgttttggttattatagccttacagtataatttgaaatcagataatgtgatgctccttgcttcgttccttgtgcttaggattactttggctcttcgagctcttttttggttccatatgaaatttagaatttttttttcttattgtgtgaaaaatgacattagcaatttgataggaattgcattaaatctgtagattgctttggggcagtatagtcattttaacaatattgattcttccaatccatgagcatgggatgtttttttcttttgtttgtcttctatggtttctttcagcagtgctttgtagttcttgtaaagatctttcacctccttggctaaacatattcctagatagtgtgcttgtgtatgtttgtgtgtgtgtgtgtgtgtgtggctattgtaagtgaaattgagttcttgatttggttctcagctcgaatgctattggtgtatagaaatgatactgatttttatacattgattttgtatcctgaaaccttactgaagtcatttaccaaggctagggatcttttgaagggacctttaagatcatgtcatcagtgaacagagataatttaacaattccttttcctgtttggatgccttttacttatttctcttgcctaagtgccctggcaaggacttctagtactatcttggaaagtcgtattgagggtgggcatccttgtcttgctctagtttcttaggggaaatgctttcaacttttcctcattcagtgtgatgttggctgtgagtttgtcatttatcactcttactattttgaggtatgttccttcaatccgtagtttgttgagagttgttatcataaaggcatgttggattttgagtgctttttctgcacctattgagttgatcatatgggtttttttttaattgtttatgtggtgaatcacatttactggtttgcataggttgaaccatcctttgattactggaataaaacccccttgattgtgatggatcatctttgtatatgctcttggatttggcttgctagtcttttgttgaggatttttgcatgtgtgtttttgcatgcaatatcccagcatcagggatgttgacttgtatttttctttttttgttgtgcccttgcctggttttggtatcagagtgatactagtttcatagaattagttaggaaagaatgcctcctccttaattttttttttttggaatagtttcaataggatcgataccagctcatcttcattcatctggtaaaattcagctgtgagtccatctggtcctgggctttttgttgttcttggaagattttttgttactgatttaatttcaagcaaaatcttttaagaaagaattgtaaaatatacatatctaagcccaattaagaccaataaaatgtttgtaagttgaattaaatagtttctctttattcctggtacagtttaaattgccacttgtcttgaagtaaccattgtctcagctatgttacagataccatagcttgtaaaaataaacaaatgaatttgatgccaaacttgaagctcatattggaatgtaatggttttaatgcagacacaatttctttctgtatcctgattagattgaagcattgttttctactgtaacagcataatatttcatcaaaacatacctgtgtttgagagctcataaggtcttcttgtatattgggaacagatatggcaatattaatgactatgttaggttttttatactagcacactttcatatatgtatttgtatttataagaaatttttctttcaaatgctgcgttcaattgacaaaaaaaaaactgcaaatgaagcacagatgctgtgaattggaatacaatgtgcaatgcaatttagccctgtaggctttctggaaagaacccacttcccctatgatgagtagagttgtcagtagtgacaataatgctgttagacgtgaaaaccaagtgtgctcacctatgattgactgacaaagccacggtgcctccatgaataaaatccaagtgctgcgttacaattcatctcatgatttttgtggttcagtaatttatctttataaaacaccaatgacagctagtattccgttgttcctgtgagtgaaatatgatatgcttgcaatatggtttgaggattcactaactatggctatgtacacataatttgtaatcaagttcatgcatgagtagctgaaatataaataggaacatttaagactgtctcaaaactagattgaattctccatttacgtagtcatagcaggatggttcaggtacatgtcataatgagcctttgatgaatgtttgagacattcagaaaaggagtagaagccaaatgagaaccaaaaagaaaagaaaaacagaagaaccatagcattacaaagctaaagactagataaacttaatttttcagaagcaaatcacataatgaaacaccaaaatgagaattaaaaagtcagaatttactactatttgaactcctgagtttagccattttttctctgattttccaatgttgaatggagataattcaggttgctaagtataatattgaatatatatttaccttagaaatttgcacatatacattataagcatatttgtggggatgctgtacactagaaagtaccatgatttactcgtattatagtctatagctgctatattcatcctcccaagaaatctgttattatgccatttcttccgtctataaagttcttactagattaagttcaaacttctttttttttttacttttcataaactttattgatagtggccacaataatttttccttttctttctttttaagtaaacaacatttaaaagataatagtaaatgaattcaaacttcttaatttgaaattcgaagtccttcatcatctggtttcaactggtacctctggtcttatcactcattccataccatgaaatgcatgcaaattgctcttgctgaattatacataatccacttgctcattcagcaaacatatattgagtatgaacaactctgtgggtttaaagatagaaatatgctgctaatggatattcatttatatattctaggagctcaggaaggggtggaaaccatgcaaaaaaaaaaaaaaaaatagcctcctacacttccatcccttaattcttgacaatctcttcatttcaggtagcttttccatcaatttccataaatagaaacttttccatgaagtcttccctatatcctcaaaagaaagtaatccatccattccatagttcatagtgatttcttttaatattaagcaatgttcactgacttttatagttacttctctacatatgtcttccataaatcagtaagtacctcagaagttgaggaccatgtttcaaatattttctctatcatccacagtcttcagaatttgtaactacagaacaatctgttgaatgagtaaaatcatggaagtatagttggggacaaaattattcttatttctttcttaatttacctccttaaagatgtaaaagaaaaaagtctaatttctctcatctatgactgcagtgggtgtaaaatcaaaccatttaattattaaaatgaaaaatagcacatttttaaaagattcacagtacattttgtgaagttttatactgaataaagttttttataaggaaaaataaagcataattattggaaataaataaaagcgtgataattgtctccattatatagctataaaattttatgtctatcattaatcccttataattatttaaaattatttcagtcttttcgtataatgttaagtaataaaacttgcataattatttttaaaagtctaaaaattataaataacatttataattctgcatctgtgataggattttataactgtacttgtaacaaaatggagcttacatttttaaatgtaaaattgaatgaatacaaattactttctatcctgaatacagagcattatacatagcttgctagacatagccaaaaatacatacttgaaatcattataatgaagatgattaaataactataatcattctgaaccctatctttatgatattatgccaaatgtgttagtaatacttacctacattttgacatgttataatctacataaatttactagtgatagatatacttggatttcagataatgcactaaaattttctgcatataataaatatttttataaatgtattatttcttccagttaaaaataatcatctctaaagaaaaagtaaaatataatgctataatttcttgatcaggctaatggtgagacgattattcattcttaaagctttgactcagagataataaatcttgctgagaaagacgtttgaattcattatttctcataataaatgctcagtaaatatttgatgaacttaggcgatgggtccccatagttttattgtcagtactcttcatgtttatgccaataggacctaataatcatataaactacattttcatctagcatctgatttccataaaatgataactttgtcttcttcagtatcatctcattgtcttgacatagtaagagctaaattataatattgattattattaagtgcctagttaaagaaggaaggaaatcatcctagtcagtttccttatgttgcttcataaacctatccctagatgatccaccagcttactatacaccaggcattgttagaattctcgtcagctctcaatggctcccttttgtcacaaagtcaacattgacttgaaccaatgtaaacgctaaatactttaagaatgaaataactatatgattcctgtcttgaggtaacttcatcgatcacagtagaaaatggtaagtttacaagatgctaagtagggatttattaggatgtttacacggtggtagacagagatctgtcagataggtggacggcctaaataaaagcatgagatttgttcttaaattctgtctgcagagcacagtgaacaattcaagtctacatgtaaagtgatcttacagtgacttacaatggactctttctgccttttgtatagtacaaatgatgtttgttttccaaatgtatacagctaattgtaaactctttcttgtgtaaccataacttttgtttgagccaagacattaccagagtgggaaagccgctgtttaaacaaagaagaaaatcaacagtgaaaagaggtgtctagtgaccaatttctgtttgcttgagttccctttgagaacgggctgggaataaataaattaaacaactgaggcttttacaggaaaacaataacaaaagcccttttctgtctttgcacagttcagagacaaaaacagaggtcacacatcctccagcaagtctgcttcatattcaggcgtctcttacagggacgaaaaaatctctcgtagaagtcatgctcaataaaatgcaaactcgtttacgaaaatgccaacattttcattttcttttgatgactttctcagagaataatgatgttcagcttagggttttttattttatttttatttgtagtgccctttgggaaagaacattttctcttttaaaagccacacaaagtttaactcaagcagtctcattgttctttctcccacaaagctagcaagaaagactaatgtattacttaatgaagctattcattgcttaataaaaataagaattagtaacaataactgttatattcacattaaccttacttttatgctttaacatagaaattgttctgatgtactatatttctaccataatttgctttaaaaaataaagcgagtgggaagtataaatcccatgatatgaaaagtaagatatccttttcattgttattgtagaaatctgagttaataacctgtgctaaacccagctaacaaaatctcaagttttggaaagtgcagagttgtaatactgatgataagtggcagctctgaaaagtgaaaaaaaatctttgacttgaatttcacaaacttgggtcttactaccaggttttcaacttactagtttatatgggcaagtctcttaaattttttgaatctcgatttaatcatctgttcattttcaaaatgggaagtaactctggctgttacacagaatggtcacttattaaatttttgatgttcacatataacttaaaagaaagttcatatgtaactttaaagaaggctatatgtgaacattacaaataatgataaggaccaatataataaacctctggtgcaagatttttataacgaatcatcagcattcaatataggaaggctgcaacattgctcatagatatctcccttgaaataggtaaattcaccagatttacaaaatggattagccaaaagcttatattaaatattatttttaaaagacaatatgtatattaagaattgatgctctgtgaggtcagtaactttatttttgatgtagtcatattgtctagggtattgtctgacatagtattgaataattgaatgaaagaattccctgaatatactttcctttagtatattcacaggctgatttagttcataactacaatcctcatgaatatgttcttcatgaatatatttattaaaagactaaacctatgacccttagcttttgataaattaaataatccctacaatactactaatatattcacatttattggatatatttaagagaaatatattcatgaatatattcataagatgaatacattcatattcatagaatatattcaagaagaatatttcttaacacaattacctaataaattggtaaaattgatgaatttggtgagttagtcatcacctgattctttagataattgtttttggccaatccactcttagagaattggttttcactgaattgatctagagacccttcccttgactatgacctgtgtgatcatcagcaggtagctactagctactggagtttaccaccctctacacctgtgagctgagatcaccttctgtgaaactgctgttgggggatagacaggacctccatcttccaaaaggagggaggttagaagccaatgtcttcttcagaccaagagtgacttaattcgctcatccggcttactgtttcaaattcttctccctaaattctgtgccttcttagtcctccttgttcttcagaggctacggctttaccttggggagatttgatagtgggcatgaaaccttagtacaacttgttaaaggctgagctagacacaaaggggacactctaatttagctattagtctaagtgtgtaatccatataaatcaggtgtgaccagccacatgaaactcctttctcaaataatgtatatttagtttttcaaacttgacttatatccccagctaccaaagaacttagcttctccaggaaagtcactgtcattgtgagccatggtttggatgacatcatcatctctcaaatatgtgagagcagagtgaagattgagaatcttcaagctaatttaagccatgacagtggtgagatttcaagagttaaacattaggctatttgaaccatctggttatactttttagtctaaggcatacagagatggtgaatttaagaagaatgaagatgaggaaagcctgagaaaatttaaatacagggaagatgatggactctctacagtttaaagggaaagcaaaacaaaatggtgcttaattttatattatgtatctgtgtgtcataaaagagccttaatcatggttgataattaatcaaaggaaagccctttatttttattattaatttattactattactattatttatatgtagagaaagatgggggtctcactctgttgtccaagctggtcttgaactcctagtctcaagcaactttcctgctttggcctcccaaaatgctgggattacagatatgaaccacttcacccagccaccattaagtttacaaatgaaattagacataatttgaaagtgatatcaacttgaaaacccttaaaagtgtcctgaagtcaccttcaaaaattttatgaagacattgtctactatgccatagtccaccaataatttcttcttatacactgcagttcacatgacattaatggcattgatagctatcagttttgctaaattataatatattaatatcctacaactatatgcatatttcatgagttttttgacacatctatacccccatctaatgagttttaaagataacagtgactccaatattttccacattttaaggtatttttatgttgtacattaaatatattcttgccctgatttattattttattttgttgacatatacatatggaaaaagtccatattatgattgtatagttcaaaggcttttttttaaaaaaaactgaacatacctatgtaactagtgtctatatcaagaaatagaatgttaccaaccctccagattgcttttagtttcaataattcattttaactagagggatgctcatctagcaaccaactttaagcaatacgcagcaagtagctaccaaaaacaatataattgtgctatataataaaaaaagattatctgtggatctagctaatgttgtctttagataggacatgttctataaataagaaaatgataattactcatttgtatcatagaagtttaacattatatgtcatctaacctaccagaaattctctcacataattgcctttgtggggtattgctggatgacatcttcatcctaatattagtattccagagaatttctgaaatagagaacaaatgcttttcccaaaaatcttacttctatcttcaatttcccagtactttctgggactctacaacttggcgttaaatcacagaagtggctatgaattccctttcagattttacctggtaaaagatcttagttctttctatggtcctggtttcatcttccatattggtatgtcatttatttattcccaagattctatgacgttaccaggacttcccatcttccctttactaagatacaatattcaagtgacgagtcctacattttccacatgtaattttcttttttcatctcggtgaaatctctttcatctctgtaggtgttccatggccattgtgtttaatgtttagagtcatccagaacggcaagtacaaatgtgaagccaaaagttttcaacttcaattatataagtatttattttaatgtgccctaaataacgtgtttttttccccccaaatcaatacatcatcattggtctttctattcctctctatggcacatgaatgtattctagtcttttttttaagtagttagcatgaaaaggaatcttgtaattcagctggaatgaagcgttcattttagtgataaaaatttggaggacagagagagaaagcaacttcttcacataatattacagtacatgctgcccaaattctaacccaactctattttagtatatcacacggctctcctgtcttacgtagcatgtaatgaatatcacatatgtgtgcatacacatatacaagcacacatacctgacttatgcacatgatgccaacccatgaaaccatattaataacaaatcaatatttttaaaatttatgctaggataaaaatattacattttaaaatatttttatttttaaccattaatcaaatgcctatcacatttagtttataatccacaaaaagacttggtaacatacatttatatcctaatatgtgttacttcactcacataaatactgttttaacgtactcacctatggcatttttccacacaagttttgccactaggagtaagaaaaactaccaaaagggcagttgacactcaaaaaagattattgttgaattgaagatttctgaagagacatagttaatgaataccttgagaggtacctttcaaggttcagtcctcattaatggtttaattggaggaaatgacattgagctgaaacatacagaagctgctaggagtcatgtagaagaataagtagtagagaggttggcaggaaaaacctacctgtaaaaggtaagcactgagtttttgcctatatctgcagcctgggtgcatcctttgaataaaagttaaagattatctggtggcatgtataaaaacagagttttataaaaaaaggattaatgcagaattatctgaaataagaaactctattcttattatgcaatttataaagcaatttaagaataattgtttctattcaaatcataaaggattgtacctggatgtaatattttaagatgtcttttccttgtcaggattctgatcatgatgatttcctgaacttgggaatttctgagcccctgagtgactggataacctctctaacttaaaaacaattatctcactcgtgttacccagtaaacacaggtataaaaaggctctattttaatgaaagccactaaaattcaagttctttatgattattatggaaccaaaattttgaaatatttcaaagaatagaattaatcatacatactattttaaaggaagccattaaattacatttctgacaatttttcattttaagcttttgttataaacatttagaaaaaatgagaaaattgattcaagaattaaccttgtctaaattgtcattattttcatttttgatattcctattattcctttttaaaaatactttttgcattgcatctataatactaatatgacagaatttaaaaagtcattgaccaatagcattacataatttcttccttaatacataagaggacaggaactatgtgcctttgggacatggagaagaggcaaggtgctctgtaatcattctagtgttcatttctctaacaggataacaccagccttgaagacgggaccaatagagttttaatggcatattacaattaggatatggaaaacaagagaatgcctatatttgggatgacttcttgtcagattcccagttggataccaaactaatctcagctacactctgtcttccccatttatttttatttattcttccaaagctatgtaactctgatttgtaaaatatagagaagcgttttctagaaattataaatatgtacataaagctatttacatatcattagaccatacagttgggcaaactccataaagtctggaatcatcagatttatttttatattgtctacaatgtgtcaaatagatatatcctcagaaaaagtcagaggaattgatttgaatgtccttgccgtttacatagtgtcaattttctataaaccaaggatgattttgtgcctttatagaaaactaagatattacatttatctgaaacatatatgggacaaaaataaaggtctaaaaataacttagtcaatttagatttaagaaattgtaataataataatgaaaacttatattcctaaaatgatacaataacaatcttatcactacaaatctctgcttagaacagaacaaaacagtgactgtaaacaaatactaatatttaatttaaaaaattaacttggatatttattttaaaaagctaaggaacaggaaatataacctataaatgtttaaatagaaaaaacggaacgtaagaaaaataatctgaaaagcataaatgaaatgataatatatgcattacccaataaagtcaaatggtgcaattaaagaatgatgaattatataaaccagggttctgaacctgagagaagacctaaaccactgaaagtgcatacaaatttggggtatatatgaatgagtttttcttggatcaggattcatagttttcattagcttctcaatatacaccactattcaaagttcttctcctttatagctaaactactcgagggtcatatcttccctttccattcacctaccatattctcccctttccactccaatcaacattctccttcacattctcaaatctaatgttcacttctcctccttgttttacttgatgtctcagatgcacttataagagttgactagtccctgcttcttcaaatagtttccttcttcacatcacattctcctattcttttactggccactctctcagtaatctttctttgttaaagaaaaaaaaatattcagtgacacttgttacggcatggtgagaaatattttattcagtgccatctcaatgggtatggggaccacagcaatgggattttgcagtggcggagactacgctcaacttcaaatatagcacgggcaagtgggaatttatatagccaaagaatagagtggggtcagtggatgcaacattactaagaagaaacatcaggtgcaaacaggattctggttaaactgtcctaacaggattctcactgaaaacaagctggggtgatccaccatcccccgggagatggcgaaggatgaggaacctgatcagatatcatcggggtaattagatatggaaaatcagagcagggggagtaggaatgggggtgtgtcttgctaaactgacttagcagggttctttgctaagctgaattgtataaggaattgcacagatgggccttggagaaacttcaggagcttaactaaagtttagtcaagcaaagaatctctgctacctggcctctcatccatttcctcaactttgaaaatttagagtactccaaggttcagcctaaactctcttttctgtgtcaagtctctccccaggtaacttcatcttgccccgtgacttacactcatgacatacgatttgtatctccagactacatttttttcttgagctccagacccaaatatataactgcctacctgatatctctacttggtgatctaacagattcgcccaacctcgactccctcccccagtctctcattacagttaaatggcatcaatttccactcagttgcttaagttacagatctatttctcaaactttcgacagccagtcaatgacccaccagttgtgcttccaaaacgtgaaaaatctggccacatttctccagtgctaacctccgtccaaacttccatcgtctcttgccctaatgacggtaagagcatcctaatagatgtccttaccttcactcttgccttctacttatcaggcctttacctatatattttctcttatttcctcagtccttcccccttaccttttgcactctggtccctttggtctggcactccaatacaccaagcatattttctctcagggcctttgcatcaaatcatcatgtggctgacctcttgttgtccttcaggcttcagatttactgtcacctcctcagagcattacccttttgtcaatcattcttatctctctattacaatctctgttttagttattttatagcagttatcactgtctgaaattgtacctgtaaacccattgtctgtctttgcacacaagaatataagctccctgagggcaggggccttgtgtgtcttctttactcttatacccctggcacctcaaactatgccagttgcattgtaagagatgaattaatgagtgaataaatgagtgaaagaatgagcttgactctttgaaggagaactgtaaaagggcttaagctggtgggagcaaatttacacgttcctctctttagagaacagctgaaaagttaagatgaaaagcaaagactgtcaaatcaccccagtcataagaaatcagagaaagcagacgatgatcatcacgtgcttcttcctgttttttaacctttcttcagttatcaaagtaacgagagtagtttgcagttactcatggccaaagccagatgaaatacaacagatattaagtgtgacatctcttcatgatatgaatattttctctgttatacttttttgggttttccaagttttttccaataaatgtcactttatggatgaagaattgtattctttaaaagtctgtatttaaaacctgaaacccatctcaaatgccactctataatgtctttgtcttgtgacctcacacactacatacaaaatgtgatgtgttccttttctaaaacctccaaagtgccttccctttatacatacatgtactttgtctttatacatacatgacaaaataataatgataaaagctgctactgtctctcaatagtatcaggtacctcatatacattatgactcatgaatcatgatttcctctataaggaaaccaagttacaaagaaatgtaaaaacttattcaaattaaaatagctaaatatttctagaccagaaaccagttatgacttactgtatctctagtgctaaaatagtacttaggaaatagtaggtattcaatacatatttacaaataaacagaggattgatattgtcatttgaaaccctggtataaatgacatcctggtatgatacccagacttaacggctttaccacaccccatcttagatcttacctacattttttcattaatcaatagtcagatgaattagaaccctccttgaagccaacaatagcttcctattcatgacaacttgtattgtgttttatattcaacagagaatcaaatactaaaaaaaaaacaggagagacaattggggagagtgagaaataaagaggaaagaaagataaaggaaaggagggaaggaaggaagaaagaaaggaaagaaggaaggaaggcaggcatctgccaaaagtgataagattaatgaaaatggctccttgtataaacatattcctactaaagttacctggtctgtaagattatgtcaagaaaagaaattaatcattggcagaataataaagtttcaaataagagtttttgaagtatagtgatgtttgtcttttggctaggaatcagtaatggttgaaaaagctaccaaaatttttttcatgaacatttagtcttggggtagttatttaatttttaatatgctaaaatattgatctctgtaagttcaacattttaagagtctaattgttttctcctgtttaagagcaaataatttcatatatattgggtttcccattgtttgatgacgtagaaaacacagcataaagtagacattgaatgaaatttagttgaattttaaaatgaatagcaccactattactccatttgaaaacatttacatattattgaggtaaaaattacatacagtagattctcatcgttctcattagtcaatatatagttatgttctgtatagtcactgtgaaaattgaattggcaactattgaaccatttttcctacgggaaatacagggttaggttcctgccagcctctgatcacaatatttgcaccaactaatcaatacataaccttgttttgtgtgtgtttctgtttaaagttactgtatttaatatttatcattgattaaaactgaactcatgttcaacagcattataacttatgcctgaatcaaatttaacaaacacatattttttatgtaaggcacataacagctttaacttaggaacactaaagagcacttcagtactatgtcaggggaccgcttttaacagcaaagtcaacaaaagcaccaaagtataaaaaatatgacactggcagggtgcagtggctcactcctgtaatccagcactttgggaggccgaggcgggtggattgcctgagctcaggagttcaagaccagcctgggcaacccgctgaaaccctgtctctactaaaattacaaaaaaattagccgagcgtggtggcttgtgcctgtaatcccagctactcgggaggttgaggcaggagaattgcttgaacccgggaggtggaggttgcagtgggctgagattgcaccactgcactccagcctcagtgacagagtgagactccatctccaaaaaaaaaaaaaaaaaaaaaaggcactggatatacagtgaaaagaggcactggatatacagtgaaaagaatacctgtttgcaggttgagaccttaaacaagaaggcaaagcgttagctcagttggaaacttgtgccttaggaccactctgtacatgcatgagtctttaaatgaccatgggtattgattttgggtttataactaaattttagcaagtaggcaaattcacaaatgttgaatctgcaaataataaggaccaactgttcatgacatgcgcagatcttaaaagtacaattcaatggatttggatgagtatatacacttagacagcaaacatggaatcagcatatagaactttttctctccctcagaaagttcctcgtgccaccctacagtccattcccacttgtgcccaccttcccatagacagctgctgttctgatttctatcagcttgatttttttattctttttttaaattttattttacttgaagttctgggatacatgtgccgaacgtacaggtttgttatatagctatacatgtgccatggtggtttgccgcacctatcaacccatcatctaggttttaagccccacatgcatgaggtatttgtcctaatgctctccctcccctttcccctcactccacaacaggccccggtgtgtgatgttcccctccctgtatctattttataaactagttctatgaacatattcataaaatatgttatttttatgtccaggtttttcttacaaaacacaatattttaaaaattcattgatgctgttgcttgtatcactagttcattcctttttcttttttattatttagcaatatttccttgtttgaatatatactgtatgtacatgtgtttatttccaatttgcaactgtcatgaataaggctgtcaagcattcctgtatgagtatttttgcaacatacattctgatattggtagatatatacttaggagggggattgttgggtcataggattaatatatgtttaactttattaaaaattgtccagagttttccaaaaagattgtacaattttatactccaaccagcaatgcatgagggttcaaattgctctagatgctagttagcccttttaatttttggccaccgaaatgggtataaaattatatatcatggttttggtttccctgatgactaataatataaagcactttttaatgtgcttatgaataattaatagatctttatttgggatgtgacttctgcccattttttccagtgattattgatttacaggagctcttagtatattttagtatattctgttttaagatacatgcactgaaaataatttttcctagtctctttcttgccgtggattttattaaccatgtctgttgatgagaaaaagtttttaaatttgatggatctcaaattatcaagtgattttgatgtcctctaggaaacctctgttagcccccaggtcctgaaaatattctgttttcttaggtctcaaatcctttcagaactatttttttgtttgattgtataaagtagaagtcaaaaatacatcttctctgtatttatccagttgttctggcatcattttttgtaaaagacacttttcattcaccattaaattgtcttggtgcctttgttaaaaaacaattgactacctacatgtgagtctatttatgatctttctctgatgatatacatgtataatcttgaaatcaaatgataagttctctaacttggtttttcttttttgcttattttgaatatttaaggattttttttgcattttcttaaacatttttgaatcatctcatgcatttctacaaaaactatattgttgggtttcggttagaatcgcatggtatgtatctccatttgtttagtgccttaatttctctcactgatgatttggaggaatcagggtggaactttaaaagctcccccaaatgactctcatgtgcagacaagataaggaccactacctagatccttttttcttagaagaatttgggtgcctgtaagaaaagaattcatcccatccatccctaagattctacgtattaaataaatgaagtggtcatttctgtttgtttgtttatttgagacagggttttgctcttattgaccaggctggagtgcaataccacaatcttggttcactgcaacctctgcctccctagttcaggtgattctcctgcctcagcctctggagtagctgggattacaggcatgcaccaccatgctggctaattttgtatttttagtagagacggggtttcaccatgttggtcaggctggtctcaaactccagaccttgggtgatatgcccgcttctgccttccaaagtgctgggattgcaggcataagccaccacacccagctatgaagtgatcatttctaataacacatccaaaaaatgtcatgacatacgatctccccaatgtatttgttttacttaaagtttctattcaagtgatttttccaaaataaccacacattccaaagtgactctttgtaactttacaataaggcatttggcagtttctttatcataaaaaacaaaagtaccttgtacctgcccaagcacctttttacatgttttatctgacaacaattgatcatatttataatgtggtttagattggcatgtgaaaatgagaaaggtcaaaatggatccattttcttatgatatggaatttttatagataagaaatagtgcatggcatatttatatgaaaatttatatacctttttaaagttttattgcataaaaggataattgattattaataagatatattagtaacacatcatagaaccctgtaactgcctaaagatgaattcatattctaggaaattttgctctcaagattgaatattgatcacaagactgaaaactccagtcactgtaattttacttgaagcattttctaacagatgttacatcttggtttgccattatattttaaatacgttctttttcttttttcaacattcattaaaccagtcttttcttcttgtctctaataagagcaacatctgtttcttcttgttcaatcaaagcaacttcctcaagagtcttactttaaaaatgataacattagaaagcacggatagaaaacttttcattaatattttacatttgcatacaaaacaagtgtttctaacaattataagttagggaggtgttagagaaaatattataaaacaatttagttataaaaatataaaatgagaaggtgctgtaatatggtttcaaagatgttcgttttaggttaaattttctttatatgaatatcagtttccttttagaaggtacagttgaaacacttttatcattacgaattataacaatggtacataccacactgtatgtggtacagaattataacagtggtacataccacaccgggttccaattcaatctcagcctcttatggggcaagctccacgtgtgcctgaatatattatgaccccaaatataaggcaattctccattttccctggattattttatatttttactaacttgcacataaactgtcaaggcctaagtgaagatgtcaataatatttatgtgtttttcagattacatacataaatcatttagaaagttcattttttcattctcactttttagaaataattttgttctaatgtctgcacaggcaactttaatgtcagtgtctttgccctaactttgtgaatcatctacacatttctgtagaacaaatcatcttcacctttgtcttagttgtttaagatataggataagtttcccatatcactgtatatgttttcccaagcctcaaattcccattaacaaaggactggctaagatgcattttttagttgtcctgtaggtgaaatttatgatctccacattgtaaagacttactgcattgctttcttgtttagaaagcttatcactacattaatatttgtaattatgagatagtaaactccaaagacaatttttttttttgttttgagatgaagttttgctcttgttgcccattctggagtgcagtgacacgatctcagcttgctgcaacctccacatcccgggttcaagcaattctcctgcctcagcctcccaagtagctgggattacaagtgcccaccaccacacccggctaattttttgtatttttagtagagactgggtttcatcatgttggccaggctggtctcaaactcctgacctcaggtaatccacccgcctcggcctcccatagtgctgggattgcaggtgtgagccacagcaccctgatgaaagacaaattattaaatgtgtctcagcttacttttctatgaaataaaatgaattaaagtgtccatgtttttgtcttaataatatagatacactgtctcctatctggcagccaccattctaatgctgtacaaatactaatagtaactagtatacaaatacttaatccacctactcaaagcctcattttatttccagacctgatgctgtatgagatatggctatccccagaaactgagcacttctccagatgtggtagcaaatggaagtgtgtgtgcgcatgcgtgtgtacccatgtgtgtgtgtgcatgcgtgtgtgtgtgtgtgcacgtgttgtgtgtgtgtgtttgcatagtataagaaaactctgatcatggatgcacagggtctatataaataatgtattttgttgtggttcttgtttatttgttcaagctctagaaccaactatgtctgagttcaaattctaacctttacctgttaccatctataggatgcttacagattggtagactcagtccttccctatatactggagataattgtttaaaaaaattttgtgaggtattacgaatcaaatgcaagcaaagtatcaccatggctagcacatagagcttagaactttatactatatatgctgacatataaaaagatcatgaaattctattcttctctggagacagccttcaggatactatttcttacaagatgtagacaaaatatgaaagaagcagcacatttttctataagaaattgggtcttccttgccacatttaagaataaacttcattacatttggggacccatttttatcatagattactgaggtattacctcttgataattaacattaaaatttcaaaataataattggaaatgaaatgaataggaatcaaagcttaagctttgatacagtagtggctgctatcagcaaggatcctttaatctgggttctaatttctctagtaattaagttcctggaagaaaataaaataaccttttaattttaatctgattagaataatagaccttttgccatgaaaaattaaaaggaagatgttccatttctaaattaattttgtgatggagaaattgtcgtggaattctctgaaaggctttcttgttcttccacttagagtaaccgaagatattttataagggtctatctctggacatgtgattatttaggattggatttggggactgaacaaatatcacgttgatatctttgagatccatgtcctaaaactgtatttcatagcagggtttgtcaaattataaagacaaaaatcaaaaaaccatgcagtcctatagttaatcaacaataaatcctactttgtactttaaagggaaatgctatggtgaagatagggtcttcagtgcatcaattccttgggaatacccaaagggacccacttgagatggaactatttcagtaaacactgctgcttgactgacagttaacttcaagaataagcctttacatgcatagagtaattttatagtacaagagattgtatctgtgttgttcttcagaatatttgaaagataagaaataacatttattgttttcccaatttttgtatggacaggaaaaataaaactctgggattaaatgacttaagatattcttgtcagaaacagaacttggacttaaatcatgcctttttctttttccagtgaggaactatcttacaaagtaacctatgagtaccaaaaagtagaccctgatatatgaatatgggtgcatattgtttatttgacattggtccaataaatgcaatctgggagaggggaggtgagacaagttggggtggaaagccacaaaaaggttctttaataaggagattgttactatgggcacctgagttctagcccactggagtctctctgagaggctgtagtaactacagtcccttgcacacctagtttctggactgttcctctttctacatcattggaagccattgaaatgtatgggagttttctgcaggtgacagccagagtgggatgaagagatatacttcatttaataacttgataacagagaaaggtcaattacaaatggacttaggatgatggggatttccaggaacatctattgacattaaattaaacttaacaaaaaaaattatatccacttaatccttacccttagaatgagtcatattgcacattaccgtgtagagctgagaagccatagtcagcaactccaatgctatttttattgcttttttatgtttcatcatttacttggccatctatgaaacctagagtgccagattcctggtcatgatcactccctcagattcattcagttattcattcacacccactatgtaccagacatggttttaactttagggtttttttagtagagaagaaaacagacaaaagagagcttataatcaagtgatagaagacagaaaattagtaagtatgctagtaaatgaacatataataaatttagtaatgagaaactataaggaaaaataaagctcagaaaagaaggaatgttgggagagagaggaaaatgatatgttatttagaatagctaggaaagaccacctctctcttaagatgacatttgcacagagatctgatgtgagggagcaaaaccatgcagataattcacacgaggcattccagatggttcacatgacacatcttagttcaccaaaaggactttagtcagtacttttcgtgagttcaaaaagaacagaaagctgttatagggaatagtgtgatctcagttatacatttataaagataataccactttgtggggagattagactgttagtgcaaagagtgaaatcagaggaacaattggggggtaatgaaatactctgtattcatctgttgatggacactttggttgcttccaaatcttagctatcgtaaacagtgctgcaacaaacataggagtgcagatatctcttccgtgtacgtattttcttccttttgggtatatacgtagtagttggattgctggatcatatggtagaccagagatgatagtgggctcacatagctgtttgccttattacattatttatattatgcatactatttatacatatattcacttgtatgctaaattttataatttggaaagtcttttgcattaattcctttagagcagggattttatactgttttcttgattgaaacaaaatgtgctcagtggccaggcgcagtggctcaggcctgtaatcccagcactttgggaggccaaggtgggtggatcacttgaggtcaggagttcaggaccagcctgacatggtgaaaccatgtctctactaaaaatacaaaattagccagctgtggtgatgcacgcctataatccccgctacttgggaggctgaggtgggagaatcacttgaacccaggaggcggaggttgcagtgagccgagatcccgtcattgcactccagcctaggaaacaagagtgaaactccatcacaaaaaaaaaagaggggctcagtaagtattactaaattaaaatttgaaaatcctaaaaaaaacccacaaaaccctgaggggtgattatgtgtaataatacttactatgagtaactactacaaacatgtgactatcttctaagctccaacagcccttaagttctttaaaatagtttttctatttcttagtataaaccaactagtaatgtatgattttcctataaaggagcacatgtagtaaatagcctaggctttatgaactacatagtttccagtgcagctgactcttgatgtagggcatgtggtatgtaaataaatgtacttggctacattccaataacatttatatggacactaacatttgaattgtatataattttcacatgtcactaaacattattcttcttttgatttctttccaaccatttagaaaagtaaaaaccattcttagctcacaggttatagaaaagcaggtggcagcaagccagatttcagccacaaactgtggtttttcagattcctggtataaattatcaggagcttggagccttgatctgtgtgtcattgatttgctctcattctatttttggacacctttattcgttagagttctctttcttttgtgaaactgaagcacgtcctcatgtaacttctacctgtggattctacattgtgccgtctgaagaagaatagcacaaaataccccccacccaccaccttgtcatagcacaggccttcacagggtcgaagaaagcccctctggccctcttggttttctctgctacccagtgttaaactttgtccagatgcttatgtttcctggctgctctcctatttttgctttttaattttctgactattcttcataaaatgaacacaaactaaacaaaagctttaagctactgtccagctaatggacaattcaatctaatttttgtttccaaagatcgttgtatcaagcaacaatgaagtgccattgttggggatatgcattcttgatttattttgctgttttttttttttaataccatgtactccattataaagataacttatttgtaaatgttcagataatcctatcattattttccatgactattagtggtcagttcgtacttataactacacatgcacagttattatttagtacttaatttctataaactatacttaccaaatgtgtttattgagagaaaacaagctatacagaaaaataaagattttaaaaacaaagacagactttagataaaagccataaattcattttcttgtctgagaataagatctagcaaagctaaccagaaaataaattactaagttaaagtagttcataattcactaagttaaaatagcacataatcataaaatgtgctcagtggctggatgcagtggctcacgcctgtaatcccagcactttgggaggccgaggtcatctaaatgactttttttcaatccatttctttccctaagtacacagcggtattaatactgcttctctacttgattgggttatattatgccttattcagttaggtggagtatagaaccacttatgatgatgttaaagagacatgagacgtcagtttgaattgtaagcagcactgtattttccaagagaaaaatacttttatttgtaaaatcgtgatttgttgattttggaaattgtgttcagctgggtaattttaagataaaaatgacttttatcttgtacttaccaggttctgggttgaatgatggacagtggcacgaggttcgcttcctagccaaggaaaattttgctattctcaccatcgatggagatgaagcatcagcagttcgaactaatagtccccttcaagttaaaactggcgagaagtacttttttggaggtaagaatgccattcctttttggttactaatccattgcaaaaaatgaggtttcaaaatgaagtttgattatgaagtatttatatttgactcaactgactcagtagatctcatgacaaaacaaactgtaattccactgagcaaaacaaaaaaagaaaaggaaaaattttatttctttctgatgaagatattaagatgatgtcaccatattcttctggcctaatttaaatcattgaagtataaaaaaggagattctaaattcatcctcataatcctcaaaagtcaggtccttggaatatttgctgttcacctagtgctttgtaactaattattcaaaccttagtgtcttcaaacaaacatttattatctcgcagtttctctggatcaggaattcagtagtaatttgctgagcgagtctttcatgaggttgacgtcaaactgttacttgtggctgcatcattggaagcctcgtctgcttccggtaggtctcacttacctggctgacagttggtgctggctgggatgcctcagttctctgtggcctctgattctgtaatacctttcttcttcaagtagcctctcccgggggtcactgggcagagaaatagagagggaaaaggaaagaaagagaggaggggaggggaaagccagtaagtcaggaagttctccagataaaaactatgagtattttttaaaatataatccaatttagcagtgatatcccatcactactattattttcaacctgtgggaagtgagtcactaaatcccgtccacagttaaaggaaggggatttcacaagggcatgattataaagagccattgattcctgggtgccattttaaaggtgcctaccacagtctaccttacagaagaagacatgttgtcacaaacatcttggttcttaagtaacgaaaagattagtaagaagaagattatcttaatgataaactctatgtgtgaaaaagtgttgtagcaaagacctgtcacattttctaattgaaaaaatgtgtcctgtcagaaaatgatctttttcataactaatacattatgaggacatattttattaaagtgctgggtactttgtttagatcaatacatcttttattagattattgtgtttcctgtcctaaatcacgcaatgtgagatgtaaaaaataaatcacatgcttagaaaaggcttttatttaagctttaaaatctgtatgttacatgtttgcctctgaaaatgtttctatttgtatttacatatctactttgtttaattaaatatatagttatatagctctctctctctctctctctgtgtgtgtgtgtgtgtgtgtgtgtgtgtgtgtgtgtgtgtgtgtgtgtgtgttctagtttttagagtaaggtgacatgagagcagccaccttgtttatctcataccctgctatattcctcaaggtcctagaaaaaatcctggaatgttgtagatgaacaataaatatttatgaaagacttagtaaattctacaaattaagcaagacgtcactttattatgaattgtctagagaggaaacagaggaggccctaggcaatttactgacttgccactgagtttgcagctagcaccttaagttttctgagtcctataccagggcatttctccccatctaattagtgacaagttagagacaaaaatcatgaactagggctctgcttctttaatcttccataatatttgttggaagttaagactacatgatttttaaaagactctcaataaatatttgatgagtagacgaaagtcaaacaagctgtcttatgagtgaatgaactggacatactgatgtgagaaaaaacaactcaatagccaaactggttaccgtccaaaaaaatattcaatatgattggcttatggccaacagttttcattgctatgatcacaaatagatcacagttgtcagtgggaaagctactgataatctctgctgatcccttgactggaatatttttggccatacatgagctccctgaatgcctaaggccagtttttatcgatttcaatctagaggggcgagcacatagctgtaaccacacattcatggcatagagtttataggatatgaggtctttatggtgtgctatttacatcagtttacagattctggtttttgagcccaggagtcaggagaatattgatttcctcttgggtctatggtctgcctttaggatatactgtcagctaatgatcacgatgcttgttttgttatatcgtcattagctgaatcctaagtgtgtaagaatcatgagaagaactcattgccattctggctctcaggccccacctctggaactttgaaattcaagagaatgagaaattgaatacttaaaaacttcaagtgattctgataaacacagtctgagaaacagaattatagattgaccttagccaatttgcacacatgccttttagattctttttgtaaaacatcgtcagtcactgaaaagtttgggatgcatgagaattagctactctcctatagctttgcccccagagggcaaaagaagggaagtcacaggacaagttatgatgcccataaacatatttattaaatgaacaattattaccaagaaagcacagcactgttcataaacattcttctgcaagctcagtgaggtcccagctctctaacttgctgcaccttgaatcaaatgttctcccgaagcagcgacgctgaatggtgggattcagctacacccagagctggtgccaggtgacagaaagcctcctcagcgaatgactggcacaggatcactaagtgatgctaactccagaagcatttctaagaactcaggttacaggcctcgccagaatcttttaccatcttcacacaaggctgggtgtgtctctaaaaggtgttgtggcaaaccacagacccttaatgcctttaagttcactactgatatctcctttctaacatttctttaacatttatgctatctaacagaccactgatttcaccaaagaaaacccagtttggcattcagttcattagaggacttgttgattcagtgaattaagttgatatgggaataaatagtaaaaatctaagagtcaccccctctggtgtgggtgtaccgtttctgcactaaaactcttgacacctcttacttgtggattcctgatcagaagaggaactgcctctggatcgcaactttaactaaaacacaaatgcacacaactctataccatctgtgctgaaaattttaaagtaggattcaaatgttaaaataaacacatcttaagaaatactagtatagtggaaaggagaattgactttgttctaaaacacgagctttggaatcctgcatacctgattttgaatatggctttatcacttaattagtggatcctttaatactgtatcttactttcttcatctattaaatggcaatagaatctgttttctgaacactgtgtggcataaacttaaacctgggatctgaccctaggaaatgctaaatgctgactgactttccaatgcatcttgagcctttcttttaactctgtaagagacagcctcacaaggaacactggagacttcagaccattatttatttaatggcctctcatcaacttctgcaccactcaaagtatttcttccccacactcactgaagaaaagtatttttcctgctcactgaaagcctcaagtaaaggctttcctgccgtcctacactctgttttgtttccaaacccttaaatacgtccacattttgtttcttttgaagttaagtcccggttgtgtagctttctttgcagcccaggctgggccgtttcactccagtgtgcaattttatctctctgtgcttgctccctgctaatgccggcaaagtcttagtcctcctttgtaacatccatgatcagatgatgtttaatcaccaagaattcttttaattttttttttcttggggataagcagacaaagagatccgttatttggcatgtttcttcagtaaagtgtgttttagctgctttaacatgttttattttcctccaactagaatttttttagataacactccattaatgttaataatcaaaagaatgttaaacacaataattaaatttacctattgactgtttacgtggtaataagctttctgatacaggccggaatccatggctatgagacagcagtatgatttttaaatttctaaattttctttgttgtggtcatttttatttcctcttttgttatcattaaaagaaaaaggagctgtgggctgaagaggagagataagaagcttctagagccagtcttactggaagaggagttctaaagaactcaatggggaagcaggcaggtcttaggaaggtaccaaagcaagtggtgaaggcaagagaaaaagaaagcagtggagctggcctgagtttgataggataggatttgtgttaatgaagtttaataagagggcacatctctttccagctcaccagtacataactgtgttggtcagttttggctgctataagagaatactataggttgagtggtctaaacaacataaatatgtttttcatggttcttgaggttgggaagtctaagaccaaggtatcaaaatgcgggcagattccacgtctgctgagggcacataatgagaagctgcagacaaccattttgttattgtatgttctcatcgaagaaaaatagagacagagagagaaagacagagagcacacactcttaagtctcttcttatgagtgcaccagtcccatcataggggctccaccctcatgacctaattagcccccaaaggccccactcctaataccacccacaggggctcggggtttcaatatgtgaattttgagggacacaaacatatagtctataataatggcctctcaatcctcattgaaatagaccatggattttaaatattaggttgtgcaaaaccagttggggtttttgctattgaaagtaaaggcaaaaacgagctaaccagataggtatgtaaatatagatttttatcaagtagttatgttttaaaataattaggggatgtggttatcaggctccttagctatttattataggaaaataccaacactccttcaagcatttggctgcctgaaaatttcttagtgatggaatacactccatgaaaagcctcccagatagtttcccagaaatccttggtttggctcatccatcaaagaatacgaacttgcagcatcccattcagaatccacttgtcagcactgtgaagtatcagctgccttgcttttgtaccaacaggaaatctattgtttagaagtttgttttctagctctttttcattgttctcccaaaaagaaaaataatggaatgagacacattttatcaaatgatataagttagacaatgtgtcatttcaggagtgtgcaaattgaatcctaaacaaactttttgaaggtacgtattgattttctagggatgccgtatcaaagtaccacaaacacggtggcttaaaacaacatagttctattctgtcaatgttctggaggctggaagtctaaaatggaggttcaacaggatcctgaggtgtctgaaggccccaggggaggatccttcaactcctctggcttctggtggttaccagtaatcctcgttattctctggcttatagatacctccctccagtctctgcctccatcttcacatagtctcctcccctttgtgtttccgcatctgaatttccttcctctgataaggacaccactcatgggattaggtatcatcctaatcattatcacctcatcttaacctgattgtatctgtaagaaccctatttcccaataaggccacattcataggtttcacagttaggacttcagtgtatctttttggaggatacaatttagcacatagtaaggtataaatgctttattttacaaccccctctaatgaaaaattagcagacttcctaaaggagattcatacttctaattttatattatctattctcaaagatggctcttatgaagttaaaagtcaaacacatactttgagaaatgtggataactaaaagttagaggcattcaaacaaacaaaaacaaaaagtatcgtgcatagtggataaaaatgtgctggtcataagaatttgatggtcaaatttctgaatgtgattttgtaacctctgcgtaggaccacgtatagaattgcaaggaaaccaattttaaaattctccaagggaatttcatgtccatatgcataagagagagaacttatctctgataaatattggaaagctttgtgtaaaaaaacaaagtgtaaatgataagaaaatgtatcattggtttgaaagcacattctacgtggaactaaccgaatgttgtatcgttacatttgggtccttacacatgtaatgtagagagaagagaacacccagctaagacttggggttagcaaccctcggagcaggattatacttagggacaaggggaaagaatctggcttcattgctttggttgacccgaaaaattttcaggaacaaaggaatttgtaacttgaccttgatatgcagcaccatgggaacctcccactaccaaataaatgaaatcattaaagactttacttgtagatagtaataatactggaaataaaacaaccacacacacacaaagagtgcaattaaaagaagaaaaaaatcttaaatttgctttcatttttccttagaatgtagttccctttccaaaattacatgtatttaagaataaattaagtcatctttttgtcatactgtacttgtcttggaattttgtacgatgggcatctactaaacagtgaagcataagcttaaaaccatagaaatattacaaagtgttcccagagagttgtttacgctaaaacaacatgaaaagttgaagagaacaccactggcaccccatcgatatacattaaatcccttagcagcagtaagaaatgtcctcacatttaacatataaatgctgggcaagtcagctgtcttatatctaaaatcttctcataagaaatgccttcaggccaggcatggtggctcaagcctgtaatcccagcactttgggaggccgaggcgggcagatcacctgaggtcaggccccagcctggccaatatgatgaaaccctatctctactaaaaaaaaccacaaaaattagccaggcatggtggcacacgtgcctgtagtcccagctacttgggaggctgaggcatgagaattgcttgaacccaggaggcagaggttgcagtgagacaggatcacaccactgcactccagcctgggtgacagagcaaaactccataccccacctgcccccccaaaaaaggaaatgccatcaattaaatatggttatttccttcaaaatataagtccttaaactcaaactgtaattagattaatgtttgatttttctctacactggctgaaatagtaaatctttttatcttttttctaggcctgcttttgcaaatgtttttgaattcgctttgatgttttcattcatactgtctgttatagaactaaggcctacattcattcatttatatccaaagagattatgggcaactaacaagtagtagagcttggattaataaatattttctgaaaacctggcattattgttcatgttgaggtagtgaacaaatcaggggaaaaagtgcttgctcttggaagattacattctaggccagatagtaaaccaataacattggttaaatgagtgtatttgggggaaaattaatcagggaggggacaggaagttcttgggaggggattgaggattatctttaaatggccagagaaacctttgattaagaagatagcatttgagcaaacccctcaaaggagtgagaacacacacaccatgagaagatgggagagaagaacactcttggtagaggggaaagcaagtggaacccgatatccagctggtgtgtgcagggagcgattaggaaagggagtcagtgtggctgagaaaaggtgaggttggattgtgaagggtctttaacaatgactgagaaggttggaccgagtgaatctagtttattttaaaacagtctctcaggctgctgttttggtaaaaggctgtagttggatgagggagaacagtggcaactattgcagtaatccagatgaaagaaaatcgactagattgtagcagtggagccagtaggtaatgatcaattctgcatacacatttggaggtccagccagcaggacttgcagacaggtgagatatggggtgtgaaagccaaagggtcaaggatgacaccggtcttcctgacgaaaaggctcatacctcccctttccactgttttacactttctccttcccctttcacaatttgaggtccacttcactgtgtttccctgaaaatgacttttgacctatacatcctaaaactaaggaatttgttctgtatgtggtcatagttccaccaaaattaacggaaccatggacagctccctcccaaacaaaattcccagcgtcctgtctcttctagtttcttttgatgggttctcagtcagttccgaaattcctcagatcaagtcttggctgaatgctctttctgctgcatctagggtcaagaatctactcatctaaaacctgctatggtaaattaaaattccaatcagtctctaatttggggaccttgccatttagaaataagcaaatggagaaccctgacttaaagctaagaagctgttatactaaaaatagcctttaaaaatattgattcacaaataacctcctcaagcatatacttccaccttgaaaataccacctaactgtaatcttttccttttggcctttgttccatcagtgttccaacaatactactggggttggaggggggtagaaagtaaactatttatcgcctcttaaaatctaaactggaaattagctctcatccacatttacatagtgctgaatatccttcattaatgctaaagtacttggttaccctatctcacttttgtgtaatatgcctctctttgaaatgctaatttagtattaaaagcaaaagccaactttttctaaccaaatgactaacaatttattaaattttagagtgagatgaggaaatcacaacttagaaccttagcaatttctgtaagttgttaatggttaatttaatttggcttggctaatattatataattggaaattatttttatttactgcttccaaaccttttagttaacattttgttttatatttttcttagtatttttaatattttccctctggtccattattattatgtgattattttttccacttttttcgtagaggagtttgtcctcccctaattgtagtgagtcacctagaaactctgtgtcaattaacattttaagcagtacctgattatgcaaaaacaactccttgtccttgaaaatattcaaatcaatatttgctattttatgcaatgttcctcattttaaaaaacactttttttaacttttatttttggttcaggggtacatgtatagggttttctatataggtaaattatgtctcatgggggtttgatgtacagattatttcatcacccaggtgtaataagcatagtaccatataagtagtagcttttaatacaaaaaaatttttaagccatcactttctattatgagaatatcaatgagaaaaaaattttcaatctaattcccaaagaactttcaggctttttttatttgtttaccaattatatgcataaaagaaaagagcacaaaaaaaggaattacacattgaaattgaacatattaacctcatcagaaactgtttttccacttggagattggaaagtatttattatgtagcccaagattcccaagacttttttttatagctcccacaagtaaaatttgattagagctatgttttaaactaattatcattacaattattgtgatattctacatgcctttgcctttttctggctcttacaactggcttgcattggaaatactcagatttaaggaatgattacaagaagttttcaaagaaaaatatcataaaatttcaaaaactctttgactttcaagaattggcttaaccctgcggccatttaccattgacatgttctgctttcttttttcttgatactgattttgctcttttaaaatgattagcctaaaagaacatcaagatctgactgtgaaaataatacggataacactaaagataagtaaattaaatattattttgtatgtgaattttttagcaaatatcttctatatctaaaatgctcttaagtagagaaactactggccaaatttttaaaactgtaatgccttgtatatctggtgcaaatatgtgataggtgtcaagtgattacttgggaagcataaataagtctacagtttatcctatgaagttgattttattgtgctttaacaaaaagaaaaagaaatctttaatgtatccttcatgtttcatgaataatcagtgttaaaaaaaattcaaagagacatgttaaaagcatagtaaggaaggctttattcagaaccattgcaatagatacagggaccactgcaatataattttgcagcgaggaagagagattgggctcaactccaagtataggaaggacaagcgggaatttatagcaaaaagcagggttgggtcagtggatagaaaattactacaaagaaacaatccaggagtataggggtttctaaccaaagccacctaaccagaattcttgccaaaaacaggctagagtgatcagacatcatctgtggggtggtgcaggaggaacgtggtcaggtatcaaggatgatgagatactgagaacgatcagctctcaagggcggggagttctggctaaactgacttcgcagggttcttttgctaaaactggattttacaagagagtaaacagatgggcctaggagaaagttcagagcctgattaaaatttggtaaagaaaagaatcttcatcatgggttagttcaggtactctaagaagcagaggttaagacagaatcagacaatcaaaagatttattgggcaagtacttctaaaggaaaaagaggttaaagaggagctctgacattcaagaatggtgaaagggaaggatgagtgagtgggtagggccccagatggttgcacagctgaggcagtattggccagtctctagcaaaaattgtctgttagaatcctgtgtcagaaagaaatggcctggctctcttactcctgctgtgttcagactgagggcagtccaggcagcgtggcctcagctggtaagcatctgtggaccctatttagagcagccaactctgacctcaggtaggaagggaaatgtcaccagggcccttccttagtagccacaagtcatttggtaatgacacaaaaatgcaatacataaaggtagttacaggaagttattttaaagcacttcttgacaaaccagaaagaagtttgtgtttttttttccccaacaaagttgatatttttgtttgcatatctaatactctatgacagaacaagtaggtagaggagatgaatttagcatacttacttttttgaactgctggaaattcaagtaatattcttatatgtacagaaacaaacagaatgggatcccgtgcctataactgtgatggtctgttattgcttattttgtctgcttgcctgttttgtttctcctttaggcaatcaattatttgtatgtaaatttaattattaaatttattattatttacatgtctctcttttaactaaaaagttaagttctttctggttctgtggcttgttttccattgttgagtttttaaaaagatcagattttaaaataagttagtttttctagtttggtttactcacgtagtaattaaatagagcttttgctgaactcacccctccttttatttttaatttctctttctactttgggttccctttgtccatcccagcaaccagatgtttctcaagtaatgaaaaatattttctactcctcctgggaattttattttattttattttttattattattatacttcaagttttagggtacatgtgcacaatgtgcacgttagttacatatgtatacatgtgccatgctggtgtgctgcacccattaactcgtcatttagcattaggtatatctcctaatgctaaccgtcccccctcccccgaccccacaacagtccccagagtgtgatattccccttcctgtgtccatgtgttctcattgttcaattcccacctatgagtgagaacgtgtggtgttcagttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgctgcaataaacatacgtgtatttgtgtctttataacagcatgatttatagtcctttgggtatctacccagtaataggatggctgggtcaaattgtatttctagttctagatccctgaggaatcgccacactgacttccacaatggttgaactagtttacagtcccaccaacagtgtaaaagtgtttctatttctccacatcctctccagcacctgttgtttcctgagtttttaatgatcgccattctaactggtgtgagatggtatctcattgtggttttgatttgcatttctctgatagccagtgatgatgagcattttttcatgtgtcttttggctgcataaatgtcttcttttgagaagtgtctgttcatgtccttcgcccactttttgatggggttgtttgtttttttcttgtaaatttgtttgagttcattgtagattctggattttagccctttgtcagatgagcaggttgcaaaacttttctcccactttgtaggttcccatcccactctgctggtagtttcttttgctgtgcagaagctctttagtttaattagatcccatttatcaattttggcttttgttgccattgcttttggtgttttagacatgaagtccttgcccatgcctatgtcctgaatggtaatgcctaggttttcttctagggtttttatggttttaggtctaacatttaagtctttaatccatcttgaattaatttttgtgtaaggtgtaaggaagggatccagtttcagctttctacatatggctagccagttttcccagcaccatttattaaatagggaatcctttccccattgcttgtttttctcaggtttgtcaaagatcagatagttgtagatatgcagcgttatttctgagggctctgttctgttccattgatctatatctctgttttggtaccattaccatgctgttttggttactgtagccttgtagtatagcttgaagtcaggtagcgtgatgcctccagctttgttcttttggcttaggactgacttggcgatgcgggctcttttttggttccatatgaactttaaagtagttttttcccattctgtgaagaaagtcattggtagcttgatggggatggcattgaatctataaattaccttgggcagtatggccattttcacgatattgattcttcctacccatgagtatggaatgttcttccatttgtttgtatcctcttttatttcattgagcaggggtttgtagttctccttgaagaggtccttcacgtcccttgtaagttggattcctaagtattttattctgtttgaagcaattgtgaatgggagttcactcatgatttgactctctgtttgtctgttattggtgtataagaatgcatgtgatttttgtacattgattttgtatcctgaaactttgctgagataagaaattttgtaagactttttggctttcaagaccctaaaaatggttgaatatctaatgggaaaatttgaagtgtttttggggaaatttgaagtgtttttaggtataatgtgtgggattgagggtccgggaatttaggccaaagactttcctagtaacatataattcagcctacttcaaaagttagccttaaacttacattgtctttaatacttttccaatcaaaaaaatccccaagcctctctgacatctagatctttctatctcattcactgaagttaaatacaattagtgccaaagttactatggcatcattcctctgtagaacttaatctataataaccagtaagttcactacctcacaattgggaagagagaccttctctgtttttagacacccttattagatcagtatgcaaatataaaatttgagtaaagatattctctgccagcattggactatatggtattatttccaggagaagctacatgcttcaaaaagtcagcaataaaaaaaaaaatcctttaatatctttggaacttttcctattatctatgggctattgaacaaagagatggactcaaggattccatatgtatacatgattttaggtttaatatttaaaataaaagaatatttgaagggcagaaaatacatgtaaagggggaattgcccctagtaaatatatagtcaatgttatatgtagaaaaaaatgttggaagatcaaaagaaggaaaaaattcaattgggctttagggtggaaatgcaagctatcaggctgaatgaagcagacgggtaataaccactatgtaaaagcttagaagaaatagaaatagttctactatttgctagcctagtgcaaaagttgattcgaagagcagtgggcagagattttgtgtgtttgctaagataatacatgtttcataccaggctttcacactttaatgtccttaagaaccttctagggtactttacaaaaaaaaaaaaaaaaaagtctttggctgccttcttagtaaaattctgattcagtaggtatgaggttgggcccagaaatatgcattttaaacagattttctttttttcttatcattttattggccaagaaatcatatgctataaaattcaccatttaaagtgaataacttggtgtgatactccgaatattcacagagtcttgtaactatcaccacaatctaattttcggccattttcatgaccccaaatagaaccccaaaactattagaaatcactctgaattcttccacaaaaccccaaatcgtaggcaaccacggcaaccacgaatctactacttcctgtctctatggatttgtttattctggactttttttttttttttttttttgagacagagtcttgctctgtcccccaggctggagtgcagtggcatgatctcggctcactgcaagctccgcctcccgggttcacgccattctcctgcctcagcctcctgagtagctgggactacaggagcccgccacacgcccggctaattttttgtatttttagtagagatggcgtttaactgtgtcagccatgatggtctcgatctcctgacctctgatccacccgcctcagcctcccaaagtgctgggattacaggcgtgagccaccacacctggccttattctggacattttatataaattgaattgcttaaaaaattatcttttatgactggcttctttcatttagcatgttttcaacctttattcaactgtagtttattcaattcatgtaacagtactttatccctatttattgccaaatatttttacatatatgtatatacatatatgtgtgtatatatatgtgtgtatacatatatatgagacacttattcattcacaagtgatggagttttgggtctttccaccttttggctattatatataatgctgatatgaacattaatttacctatttttgattgcacatatgtttttctttctcttgggtatatacctaggagtggaattgctgtgtcatatgataagtctatgtttattgttttgaaaaattactaaattacttcctgggtgatctcaatgcttgtcattctctctccatactttgagaaacactaatgtaggcaaagatttggggataaaaatgtaggaaaaaaacaaatgtctgttattatcagacatttgttgcactctgataataaaaaccttagatttcatgaaatggagaggaggattagaagagaggcaaagaaagcatcagaaaaataagacactggataatgatgtgaggttagcatcatcaagggacaagttagaaatccacattttaaaaaattaaaacaaaattatagctaagtgattaagtagtataagaaagtttataatgtgtgtttattaaaaggagtgttaagattttatttatgtggagatgatacaataaggttagccctcaatcacttattaaaatcaatttattaagatttaaatacatatagtaaaatttagttacacgaattttgattcatatacttttgaaagaatataaataatggtaacggatcccattgtatgattacagaataaagtagttatatacaagaatgtttattgcaacaacatagtcatcaataactagaaaatgcctaaatgagcaacagcagaaagatgctaaaagatactgtggcaagtctataaaatggagtattatgcagccacccaaagtcgtgattttgaataatattaaatggtatacaaaaaggttaatgacatagtcttattgcaatggggataaaatattttaatacaatacaaatttataattgcattctcctagacctgtctaatattttccatatcagtgaatgtgccattgccctccatccaggataaagaatgactttagtcttagttttatcttaatgcaacaaatccagtccttcacccaatcctatttaagtatttatttattatccataactattcatctcataaatgattttataatccatctgcctctcagctgtttcactgccactgtgataaaccagactaccatattctctctgcaggactgcttaacagttccctgatttatccactgacggtttcagtccattctagttagtcctctttcaatctatcttccactgactttgtcttgccaatttcccctaccctttccaccctcactgacttcctgtttctcttgtgattgcaatacttatttatttgtttagcaatgcaaatttataacctgaattacaaggaccttgcatcgtatggttcctttctgtgttacacacatcattcatcctcacccagccttctgcttctgtgcaccagcatcatgttggccttccttgagctaatagagtgttatgctgcctttgtcacagggatcctacacattctactatttcctctgtctggaatgttcttcagcctaagatgactacttctttctcaaatctcactttaatcaacacttcttcagggaagccttccctttgtctcagcccctggctaaggtcaggttctttagttttgagtatatataatagattataaagatatatgaattagggagattatttgtttaatgtctgcctacctcactgtcgcttaaacttcaaaaaaaggatatatatatatatatgtgtgtgtgtgtgtgtgtgtgtatatgtatatatatgtgtgtgtgtgtgtgcgtgtatatatgtatctcttttttttccttggcttctcttttcctggttttcccttctcttaactttctgctttctacggtttgtctctttcttcttacctagttttgtacccacccattcctcactgtaaaagaaagtaaaacagaattttagcaatactatctctgattcgaagaatgaataattttaatgttctcctttcttttttcgttaaaattttctacagtagccatttgtaggtataaaaccaacatgacaagcacttttatagtactaaaaaataataagtgaaaactacttgaatatatttccatataaaaatgtaaagttcgctgggcgttgtggctcacacctataatcccagcactttgagaagctgaggtaggagaatcacttgagcccaggagttcatgaccagcctgagcaatgtggtgaaaccccatctttgcaaaaaatacaaaaattagctgggcatgggtacgcgcacctgaagtcccagctacttgggaggctgaggcaggagggtctcttgagccttggagtgcagtgatccaagatcgtgccactgcactccagcctggagaacagagcaaccctcttttgtttgtttgtttgtttttttaaagacaaaaattataagacaaaaatttaaagacactgttatactatgcagccataagaaagaatgagctcatgtcctttgcagggacacagatgaagctggaaaacacaggaacagaaaaccaacaccacatgttctcactcataagtgggagttgaacaataagaacacatggacacagggaggggaacatcacacactggggcctatcgggaggtggggggcaaggggagggagagcaataggacaaatacctaaagcatgtggggcttaaaacctagatggcgggttgattggtgcagcaaaccaccatggcacatgtacagctatgtaataaacctgcacgttctgcacatgtatcccagaacttaaagtaaaattaaaaatatatacgtatatatttaaattttcaaaacaggagaaaaatgtttactttagaaaagcatgtctttaattttttctaattttacatagacaagagtttcatgtggtaggaaacaaactagataagataaagggaggtgaaatttgtcaggattatttttaaaaatataagtggataaaagtaatcttctgacatagcacttgtgtttaaatgtacatttgttacttacagttactaataatttattcatgtaacaaaaattgttgaggtttcttcttttttgtcattggtgagtggattttactttccagtatagaatgtccataaacgcaatgtgtccagtaagtttaattttaaaaggctttatattgcatcaataatttcagaattctttaccatacttcttaattctttaaaaacattaagtatatatacatttttattagggaagttaatctcttgtgttatgtcaaagtatataatggtaaatatcaactaaatacattgtttcttttatttttcctttgcacttatatataagtaatgttattttgttttaagacaacagtctcactctgttgcccaggctggagtgcagtggcatgatctcagctcactgcaacctctgcctcccaggttcaagtgatcctcccacctcagcctccctagtagctgggactataggcgtgcaccaccatgcccagttaatttttgtaattttagtagagatgaggtttcaccatgtcggccaggcttgtttagaactcctgagcttaggtaatttgcccacctcggcctcccaaattgctgggattacaggcatgagccgtgacacccagaaatgagtaatgttaaatataggatttctatattgaaaatattatagatataataatattaacttttaagatagagggaaaaaatccaaattattaggatagtcttcagctatataattatagaaatccaacttagtaacgatttaaactggatgaaggggctggtatggcattttgtggtttcacgaagtatgaattctatttcaagcatcagcaaactcttttatatagggtcatatagtaaatattttaagctttttgggccatgtgttctttctcacaactactcaactttgctttgtagcagagaaacagccataggcaatacaaaaataaatgggtatgtttgtattccagtaaaacatttacaaaaacaagtggtggattgcatctagcatgcaacctctaatttaacaagttctaatctatctagattttccaccatctttagtacattgtttctcactcttggtcaagatgtcttccatccccattccatacagcaggaagaaagaagtgaaaagagtcatggagcccctttctttaaggacacttcctgaaagatgctgaagatatttctacacatatcctgtcagccagagcttagtcctgtggctacaactagttgcaaagcaagctgggaaataaaattcttccagacattcatgaatccagtgccccctcccctcaaataaaaggtgcagggagattttttactgaaaagatcatgaaaacagattgtagggaaaactgacagtatgtaccaatattagtacacagaaatacctatattaaccctttttccaatacataggacatttttatgttccttcaagtgagaccttcccaaaatctcataagttattgcatccatctcaaatccatctctgatgatgtacagaactctacgtcaggtcaaggtttcatttcttgtggtagagtagtatataaattaaaaacctgtttactgtgaaatacactcctcttatgaaaataaaagcatgagagacacatagccattgctggtccatagcaattttaaaatcttgctaggcaggaatagcaaagaggctatttttccagtgccttttgtgacccaaagtttcactctcgcagaggtccctatgagaagccatatcgtgatcctatctgagaagggcattctgctttttcctgtctagtgggctgcatgctttcataactgacctcctgctgatacaaattagtgattaaggactgctgaagtcattgaaagggcacaaaactttgcaggccatgcttatggtttccttggcaatgtaagtttctcaaaaatgttatagtcttctaatctattttctttcaggcagttctatgtgcaaataaccacacctaaacatctgttcttgacatagtttaaaacctgttgactattctttttcatacttacctctgtgttctgccaattcccagtggaggtgagccctctaatctgccttcaagagaacttgcacctccctccttttcttctctctgcctttcagctaatgtcaaactaccttgaggtcctgaaaaagaataaacctttagtggacgatgatatcctcaatctgatcactgcaacagtgctgtgccccagtgtctggtagataacccttacctgaaggttatgaaagacatcctggggccacaggcttacttccttctaaagctgcctcttggcagctgtggtttagacttacaccataatgcagtttaggatacagagttattttttatttttttcatttttatttttttaaccctttcaagcttctgaattagggattttccatcattttagactgtcaacataagaagaaagcaccttctacttcacagtagctttactctcatctcagcctttaggctggtgagttctagactaacttcatctctctcctggagactttgctaaacacagcaagaaggagccagtgccagtgcgcaagagcacttgagtctttccaagcatttctcttaacatggaaagtctcagttggcacctaatttgccttccaaagacagcagttgacaatataaccaaatatttagctacggtataacaaagatctcagctttccacagctagagtatcccagtcttcaaggcctggtgtccaccacaggcaattccatatgctttttaggctttgtcacacatagcaccctatttttatgtatagtacaaactatggtatgagtttggattaggttcagcttgagtaacagagactgaaattaacaagatgaagatttcttcctttgttatatgagagaatatagaattagactgttcaaggctaatgcagtgttccatggagtcaggaagctaggctttttccatatttctgctttatatttagtacaagcaaatatcccaaatggcaatttgagtgccagatattacatccaagttctagataggaggaaaaaagcatcaaaagatatggggtgattctcacccttcaaggccactcccctgaaatctcatacaatgtttacgcatgtatcacctcattggctggaacatattaatgtggccacatatagttgcaagggatattggataaccaaatatccaggtaaagatctaagtctatgcaaggggggaaagtaattattgaaggctaattagcatctttgtaatactcctatatttgatattaaacagtttatattatctgtgaatttgattatagtttgtgtgctcaattgtatttaataaagtggcattcaatatttattccctccgtgagcaaatcttgaaaatttgtatacggctgtttaacctaaggatatttttgcatcagtgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggattagtcttgggagggtgtatgtgtccaggaatgtatccatttcttctagattttctagtttatttgcgtagaggtgtttgtagtattctctgacggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctgtatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccgactatgtggtcaattttggaataggtgtggtgtggtgctgaaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgtgagtttggaaaattcatttaaaggagttcatttctttttcaagttttcaattatccatcatcctagcctgaagctttttataacaaattatttagagtagtaaaattagttttttaagcaatagaatattttttaattacgcatttatatctctgttattcccaatcatatttctgttctccacaaacagctttattcaataaatttcttgcctttaatttgagagaaaaatggaccatttcccaaaacattaggatctattaaaaataatgtggatggttatctaagagcttttttttctttagcttagaaagcaaaggattatacatttcttagtttccgtatggcagaactattaggaaaaaaaaaagaaataagatcatgaaggtatagtgtgtagaataggaaattaagaggccagagaaagtatctttggaattaggaagctgtctaagacattgatggcttgaaaagaagtaaggtgtattaggtgaacaactagatcacaaggttcaggagagcaggagctactcttgattttgtttatcccagtacactaaaatataacacagtgtctgatgcatgcaaagcactcattatacatcttttcaatgaattcataaggataattaaccatattttaaaaactattagaaatgtttatattattgtgtcctagaagacaacagtgtgcatgatttaagcatttttattttttgcaatcacgttattaaagaactctaagttgcatcatgccacatcagatatgtaatccattcagccttatgttttcatctctggctgtagcattaaagcttaatttatagaaaggtgtgttctttccctagatatcaacttaaaggttaaagacatactttagaacactttagtctttcctcaataaacatctccagtttttcctcataacaatttcatcaaatctttcttcaacttatttgtatattttaaatttatatggtcccttaaaaaatcacatgctgattttatttttactttttttttctagtttatcatttgtttttcaaagaaaaatatcttttaaactacttgtttaatgttaaacaatgagctgggggggcattttgtttttgtttttgttttaagtactctattaattttcattgccagtgaagacctaactggctaaacaaagatacacctcagcagtattcttgtttgaaacaacatatgtaccaactaggaaaaatgcattgttaaaattcactgcatgcctgtaggtaatggcagaagtgtggaaaggcagcctctgactttttaaaacatccatgtttcaaaataattttaggaaaataaatgtataggcctggcacagtggctcatgcctgtaatcccagcactttggaggctgagacaggtgaatcacttgaggtcaggagttcaagaccagcctggccaatatggtgaaactctgtactaaaaatacaaaaaattagctgggcatggtggcacacgcctgcaatcccagctactcaggaggctgaggcaggagaatcacttgaacccaggaggtggaggttgcagtgagccgagatcgcgccactacactccagtctgggatgggagacagggcaagactccatctcaacaacaacaacaacaacaaaaattagagtatttaaaactaactaaacacaacttatttatagtggtataatatatccatttaatgttttggaatgccatgtctgcctctgtgaaactagactgttgggtttaattatgcggttcttgcttttctgaagaggtgaaagaataaaatatcttggtgggaggaaagtcctagactgagggaaggcatggaaatagtttgctttatttacaaagaactgaaaatgaagcgtaactcctattattgctgtataattattgatttggcttttctttttagccagtcaaatgacagctaagattccctaaataatagtgggaaaaaatatgttagtcacagcttccatctatgtgttgaatacacagaatgtaatgttttcttattgtgattaaacacataaagcataaaagttaccattttaactatatttaagtgtacagtttggtgacattaggtacatttaccttgttatatgaccatcatcactattggtgtcttcaggacttttcgtcatcacaaatgaaaactgctcattaaaaactaactccctatttcttcctcctccagcctccagcctccactaaccagcattctattttcctttttttttgagacagagtcttgctctgtagccctggctggagtgcagtggcacaatctcggctcactgcaagctccacctcctgggttcatgccattctcctgcctcagcctccccagtagctgggacgacaagcgcacgccaccacacccggctaattgcttttgtatttttagtagagatggggtttcaccgtgttagccaggatggtctcgatctcctgacctggtgatccgcccgccttggcctcccaaagtgctgggattacaggcgttagccactgcgcctggacaccagcattctacttgctatctttatgaatttgaatattctaggtaccttatatgagtggaaacatataatgtttgttcttttgtgcctggcttatttcacatcacgtttctttaggatccatatatgttgcagcatatgtcagaattttgattcttttcatggttgaatcgtatttcattgtatgtgtctatcacatcttgtttattcattcatgcatcaatgaacatttgcggtgtttctgctgtttcactattgtgaatgtactaatgatatacaaatatttgtttgagcctctgcttccacttcttttagatatatacccaggagtggaattgctggattacatgttaattctattttaaattttagagggactgcttcactgtttccacagcaatgacacgattttacatcccactagcagtgtacaaaggttctgattgttccacatccttgccaacacttgttattttcaaggttttactttgttttgcttttgtggtaacagctcttctagtgggtgtgaaatggttttctttcacaaatgaggtgaaacgtatagaagtgaatgtttcctgtcctcacttacccttggcttttatacttagcccatttcacatttcacaatgagaccactagactataagttctttgagggtaggaagtatgtctgtcttatttaccagtgcttttcaacttctaatataatgggtacttaatacatgctgaatgggtacatgcataaatacaagaatgtatgacaaaagtaaatgaataaacaaacaaatgagtacatcttagaatccaatagaaagtattgctaatttttcttttgttggtcaggcaagctgaggaaatttctaagcatcataaaaccccaaagctgatatgaaggggcttgttaggtttttctacttaaaaagcatacatgcccacaacagaaatattcattggcttcttactagttctaggaactcttctgagcattttgctgaacttatctcactaatcctcatgatagccctagctgctggctctaccttatgatgtccattgaagagcctccagtgatgtgatttgctaagaatcctcagctcttaagagtccaagtggagattggaatctaggtgtgtctgactctagacactaatctcttttagccagcataatatattgttcaccagaatgcctgcatttcattggcattttcttaattactgaaaagtaattaagaaaaggttaaattgcaatcactgcttttgatattccacaaacatcttacgttaaaatttaatgaaatcaaatagatcagaataaaaaagcaaaatgtcagattagctacattttagaaacctctaaaatgtgggaaagctgttctgcattccttttgtagctgtctgaattttgcaattatgaatgtgcattattttttctcatgttgactttcctcatgttatttataagaacaagagacttacatatagttgagcactttaaaatatctgttctgagcttagtgggacttaagaaaagctctcttccttccacaagtttttccttattgtctccacaagaatacttgaaattctcatatcatgtggtcttttggggtaaggatttaaaagcaggagtgaaaatgcaaatgtcatcccaaagagttgatccattaagccgttatcagccaccaataccttagcaggaattagttgattagaaaccaaagaatctagagagaattaactgtgtaaaaaaaaaatcacatactctagtaggccagaataagctggcacttatacaaacaaaatctagagacaaatttttggaaaaaaaataaaaatagaggtaagttgggacaaaaataacgagcaagtgtcaggttggccgcgaatgacaggaaagaagcaaggtgggctacttcagtcatatttttcttccacatcttcccacaaagaaaatgagtttccaactggaaatgggagaacttggcaagtatcagaaaaaagaaactggaatccacgataaagagggagagagcctctaattgcctgtgaaaggagctctcagcaaaggatgtagatcagtgatacaaattttaacagttaaaaactaaatcatacattctgtgaattcaacaactaatatagctggaggttgtgaccagtacatttgtttgagtgtccaggtcatccagggtcaataaaagtacacagcttctccactactgtagtcacaatggacggttcctcagccacatgtgtgcaaggactgggacgactgaatcgactatttagagggccgaggccagaaactacaggcaagaataagccttccatctctggaaatattataaaattaattcttaaactgataatttatcagcacagtcattaatgaagcaaacgggttgcactaagaataattccagaactaatttcttttaatagaattggtagttggcaagatcaagaggctttcactgacaagtaaaaatcattggagaggaagcccccacccttatacatgcatataccatttgaaataactactataataaaccagcctgcaggcgggtgccatattactcagctctcttggtgcagcagtggttgggaactggagagacacagtaactttaccatgatttttcagcaaggtctttggcaaaatctgtagttgaaccttaaaactctagttaagttaactagcttttccttcagtatgcatttgtaacctcaaattaaatagacacagaccaagaggaaaggtgaaggaatctgctgcttttacaaagcgaaggcacctctcctcatctgtctctaccttgaaactgcaatgaaaaataagacagaaatgggatgagaaaacatgataggatttccagtgactgttgtctggtgattaagggattgagcacccccccacacacacacacacccacgcatatacacacacaggtatgtataccacattctctactaccaccatggataatagagtgaatctgagttcattgaggtgaaggtgggtgaaccatcttttataattcttacacattataaaaatgtataacattcttataagttatacattcttataatttatatatacagtattaaaattgatatacacagtattataatttataattatacattcttgtaatttatatatacattcttataatttataagaatgataaaagatccagttttttatagaataatggtagaagttgtctccaaggctgctttattttaagaagacttactgaatgttgtaagcagctagttggtgtatttgtaacataagatacgattgccagaatcctggcctcatggtgcaggtgtaagcatgtaagtgtgtaagcatctctgcccagggaggaaagtatggaggagggcagagggcatggctctccttcccactcatgaggccttctgacatatcttctccaaactctggaccctagtcttgatatatggttcttacttagtatatctcaattttttttttctttaggcactagttcagatcgccatttatagttcttaatttatgctttacatcttcctctactcttttgttaggtcctttgtcacggtgcacttatgacatagaaatggtcaaccaagaaaagtcttcaagaggcaaccctaagccattactatgattcccttcttatgtaatgtttttaatcagtgattcttctggcataataaatatatttggcctttggctctgactcctggcacagagcccctaagacccttggagcttcctgagtggcaggaatgtcttttattggtcacaaagagtttcttttgatcacatccaacttagggcgaaacccctagaaagcctcaaaatgaggctggtcaccagaaagaccaaatgatgagagggttggaatcttttaccccacctaccaacctcctagaagggaagcagggctggagattaggctctatgaaaattcctgaatgacaagagttgataagcttctgagttgatgaacacacagaggtgctaggttagtggcatccccagagaaggtatagaaactgtgtgcaactactcccccggtgcctcccatcatgccttttcctatgcatttcctccttttacctgttcctgaatgtgtccgttgtgataaaccactagatacaaataaagtaccatcttgagttccctgagatactctagcaaattattgaaccctaggagaggtttgtgagaacccaagatttaaagctggttggtctgaagcattgatgggttggacttatgattggcatctgaattatgattttggaactgagtccttcacctgaagggttttcactaactctgggtagttagtatccaaattgtattgaattgttggataaccagttggtgtgtagaaagttgtagagttgctttactcccaaacttataacatccttctttttgccatcctaattggtatgaacagttttactagttgtacaagtcagtgatcctgttcatcatccttggcttcaccctgaactcctcatcaggtaaaaacctgaacatttggtgtcagaaatgctgtgattagagggatcgttattttccctactctgattataacatcaaactacgcttatcaaatttacagatgacacaaacttggaaggaatatctaaggacattatggaaaggttaaaaaggatttgaagagaaatgaaactatctgtattcaagcttcctttctaccactaactagtgggactcagttttcttataaaagagtaatgtttggccctgggagttgagtaaactgctcatacaactagggactagtgagtgactgaagcataatcagagcctaggtatatttgccttagcttttaaccagaatatcagagtggtccaagcaggaaattatgcacctgaaataaggcaatggcagtgatcatggaaagggatgacacagaaaaagactcaaaggactttgaggtacaatgttccctggtaaaagctaaagagaagggcctgaagaattcaggttgaagccaaggatgataaccaggatcgctggcttggacgactagtagaacggttctatcacttagaatggcaaaaagaaggatgcaaacatttggaagtaaagataaattctattataaatgtcaaaaaggagatttcaacattccttatgtaaacaccttgtatataattgggtaaataggtctaaacttcagaagagataatttgggagcaccaatacagcattagccgtggcaacaatagtcaaaactgtacatatgaatgagagtgcacagaatgaggaaccagcagtaccaaccaagcagtgagggacagcagcattaaggagtggacagaggagacagagacacaaatgagacttagaaaaagcaggtagagggatcggcagagaagcacagggcacggagtctatagaagccaccagaggagagagagagggtcaagcagttgcagaatttggcaaaggaggatataaagactcatcgagattactagaagtgttctccttttggccactggccagaccttgttcacttcttgccccttgttcatctcattgcccatggaactaaccaatgatcagttctcaagacttttccaccagtatcctcactcaggagtgatctcaccagctgcttcagtatctcagaaagttcccctatggtcagctggctttactgttcacaacatgtttcaaaacatgagattgacatgttttaaaaaagctgttctcagctgccctctccttattaaggtataccatgacatggctttggcaatagttaatgcagaaatactaataagaaatgagaacattgttatttgcttcaaggtaaataagagttggcagagtaataaagctgctcaaatacaatgttcggatgatcttacctcacattaatgaagaagggccaagaacacgggaaataatagccgtattttcttctacactggttcaactatatgtactatgatgcgctctattctgggtaccaaacttcaagaaaaataattcatttgaagatacagaaaagagggcaaaacggaaaacattctataagtgtttttgtgtatttgtttttaatgatgaagttatccattatagcaacaagttggacacattttcagaaaggaaggctcctttctgctttcttcatcatttctaaaaatgcggatatttttacttaccactcagaaaatgcctgattaacacctggagaggttcagtactggcaatccaaactgtttagcagggcctcctgggaagagcagagaaaatagctgaaaaaaaagagaaaataattctaatacagtaattatcaggtcgagcatggtggctcatgcctgtaatcccagcactttgggagaccaagacaggataatcacaaactctgaagttcgagaccagcctgaccaacatggtgaaaccccgtctctactaatagtacaagaattagccggctgtggtagtgcacacctgtaatcccagctactcgggaggctgaggcaggggaatcacttgaacctgggaggcagaagctgtagtgagccgaaatcatgccactgcgctccatcctggatgacagaatgagactccacctcaaaaaataataatcatcataattatcaatgtgggttggtttctatttatttatataggtggatttttcataaacagatttggaaaacactggcttaaaaacatgcaattttcatgaagcagggcctcctgcacagtctttaatatacaagggatacattaaatgtgaatgtgcaagggacacagtttctcaaatttatttgaccctttttggactgtcttgaggccatagtgctccccagaacacacattgggaaactgatctaggaagtgaaaagagaagaaggaagtggtagcacaagccaagacagatggaacttgttgactgactgccacataaagttcctgttccagagaaaacagaaggcatagtgatgactacagagagaatactgataaaaggcaaaacttgatggtgagaactctcggcgttctgattcttatctaacacattcacatttttatatttatttccattgatccatggtaaggctaaatgaaaggcactttaggcataataagtaagcattaaaatcataaaatagacaaaaataaaataaaaacttagtatattgtcattgaatgctaacagctacagaatctgaatttgcttgagagctgcatacagaaaatgaatccttttaaacaactttctataataaaagaaccaaaccactattgaagatagtagtaaattttacttaaatttttgaaatatcatacttgttcactttggagagatgactaagtaaatataattgacctagaaataagtacattgggaagttttcatatttttaataatcctatatattttttcaaaacaattggttaatagatttatcctagttcttctttattacctacttagagacctctgtacaaatatgtgcttgttaatcacataaataatgccataagtaatggaaaatgctggtgatttttagcaaatagaaaatagtaaaaatacaggcagtcatggactagagtataggcataactgttaggcacaggtaacaatatttaggacccaagtcatcggtccagggatgtgtggctaagatggaagaggtaaaacagggcccttcacatcaaagcagacttggatccatgatgagacacaattgttttctgtatgccaaagccatgaaaatctttcaagggctcatgtgcttgaattccttgaactcagtttcctgctagaatctctgcatttttcagtcctactcccatcttgactgccatcccaaaggaagatgtgtctaactctggtcctctcaaagctaatgtcttaatccaacacttctattctcccctttggtacatcaatccatcttttgtagttattctatctgcctcctccttcctcttcaacttttaatgggctctgatttccttaacttcacaaatatgcaaataccaaataaaaccccaatcatcccttgactttgccttttcttcacaggaattgcttgtctctttcttcacttagtgggtgaaattattggaaaaataaccaataactgttgactgtagttcttcccttgccatttatttcttagggaagcattctggctcttattatcatctctaataacaacaataatggagtaacaggcacttataaccataaatgcattccatagaagatagaaattgttatacagttggccttttcttctgaaaaatctcagtgggtttggttatgttcttttggagacaagactagaagtgaactgatctgcacaatttggagatcaagaaggtaattctagaggaaaggaatagcagagcacggaagctgagaaggagccagtgagattgagagtagataaccctctctgcagtgtgactcccttactgtcacccctagctgtctagcaaatctaactgaataacatgcataccatgaataagcatgttcgtgtgtgaaaacgagggaagggctagtttttctctcccaggttagtgttggtaaacaaagatacatatagggatattctcattacatatgtctacctcccttactgtgggtcttatttaataaaagaatgtttcttcagcgtttgttatccaaacactcattttattttcacaataatctcacagagtaccacatgctattatccctattctgcagatgaggaaattgaagctcagagagtttaagtggcttgccaaggcctacagaaccagtaagtggcaggaattcatattaccttgtacttagtaggtattcagtttatattaaatttacctagtttgagaggcagcatgcattttagtgaattggattgtgagtatattcatcaactcttgttctatggtaggatactgtcttaaatctaatatacaagcaaggactcatgctgagttaatgcttctaatagaataacctagaaatttattattttactgtggtgctgtcagcactagaaaaactttatttggtttctgtttttctcatttttgctgcaaataaagagaatagcctcaggaaggtgatttgcctgtcatttgatctttatgaagaaattacacataattaacttatttcatttttagtaagctactaattaggtgcttcgttgagattgcaaaggtttaattttctggcttccagcatggaagtaaaaaagaatccactatcatagagaaaacaaaatcatcaggagttcttgagcccccaaagaaaataaatgattgaacaaaagaatagcaatgggaggctttaatctgagcatttaaagagaaacagagacggaggaaatcttgcgatcaaagccaccaaatgaaaagagaaataaattatttatttagcagagggtaacatttttcttcgtgatacttatttttcttagaaatcaaacccatcctctctattgtgtcataatattttagatttcacagcatggattactgtactcttttatttttaaatttagccttattattcccaacaggcaacttaacatttaatatctgaaggtcattgctgtacaaatgtgatgtgaaaaaaaataaaatttagcagctgtatcatattatactaatcagaaaggaaggaaataaagaacaaacagcagtgtaagatggctgcagtgtggatgagtgagatggactaagcaattaagtattttgttgcagagagaatctgactgtgtattgtttttctcaaattttcagcttgtattaggtagagtcaaagagaatatagaagtgttgagaattaggacaaaattcagtttatcttatatgaccttcatttgtggagtaaaaagaacatatttcagaagacagatatgctagctcttgaatactaggtgattttaatagtattatgataattttattagagattatttacaatcaagaacctgagaggtttgctgttgttgttgccattgttgtttttaggaatgttcacagaggtcacattttccaaccttagagttttgctgcttgatttcttttgtatttgtagcttacgtggaagcagcaccatgctcagcacaagaaaagcctttcaacaggagtttaagcacagctatatgcaagtgaaattaaacagaaaacaatcccaatagtcctattcttcataagaccttaagacacttggggtttggtttaatttattgaagtctctcactcttttagcatatgggtgataatagtcaagagaaattatttaccatcatctactgatgaaaatcgtaggtggaagagatcttggaatccttctaggattggtaagaacatgaaggtttggggagatgaaatcttgctaaaattatagaactagttagtggcagagatatgattagagtccaggacattaaatatctagttcagtcctctttccactgttcacctctgagtctctgctccctcaatgctaggacccaactattgattatctcttgatttttaaagtgtaagaccatggtactgtttttcatagccacctacaattctctagaactctatggaaaatttcactggcattttatgataccaaccatggaaattccctctcaattccaaagggacattggcagaattttataattaagggccatgtctagtgttatcagccaagttatgtcccccaccagcttaaatttttttaaccaaaatgtcctctatatactgcaggagatagggaagattatcaattagggaaatggtaagaaaatattaaaacttttatttttataaaatttaccaatatcatgcacccacatcagtccacttgcataagtcaagagtgataaaatatttacacaacaatttcagtgaagcaattttattactcacagataggtagcaaaagacaagggaaggttaggatgtatggtgagccagcccccactaaggcacaggaaaactgccaagggcagatgaagtctcatctgtgcatattctgtgttgcactgcagctgagggccccccaaagcacatactgccctgggttttatacccaggggcaatggaattgctgagctaaagcatttcaggacaccctgttctgggaacaatgggaacagagttccagcctgttccttcatgtcttcaatgttgcatttccaatgtattctacagttactctgagaactacaagtgagaaaggggccatatggggacctgtcctgcagtgctgtgtgtcttctaagttagggtatgcaatataaaaaaaagtttgaacaacaatatcttaaaaccccttttagaaagtcagctgtagtcatgaaaaggagtgattctaaggtctctacaaattgttatcacaaaataccacatagtctccatcacaactccttaggtctctgtaagttgtcatcacaaaacaacaaaaacaaatcctatttgaaccctctgccatttctaggatgagcttgctcattatctctgaagatttacatggagtattcaaagcctgcagggtggctccaattagtatccattttgagcattggaatagaagaaaaataactctagtcatcagtaaaatgtccttaaatagttgacccctgaccttactgataaaatttttaaatctgcatgtcaagagaactgaccttgaccttgacatttgatggggcactgcatctgagtggttagaatttgatttgtggttttatatttagtctggaaaagatgaataggctactgtgttagttagttctcacattgttataaggaaatacctgagactgggtaatttataaagaaaagaggtttaattgactcacagttctgcatggctggggaggcctcaggaaacttacaatcatggtggaagggcaactcttcacagagtggaaggagagagagaatgaatgccagcaggggaaatgccaggtgcttataaccatcagatctcatgagaactcactatcacgagaacagcatgggataaaccacctctatgattcagctaccttgaaattttaaaaacttgaaatttttagcctaagtatttcttttcctcatgtaaaaaattcacagaatcaaataaaattacagtgattgtcttaatcacctttgaagagcaagggcagtctacactgatttttttaaaccaaatatagaacataagaagaaagagtgctctttattttattgtgaagtaaatgccctggtgattgttaataagtcaaagagaagtggttttgtcacagaactgttagaatttaagtagtatattattaaagcctattagatcaccatactccttttcaaatttttaatagtaaggtttcaagtctaatttaaactgaaaacgttacagagaataactaaaacattttaggagacttttttccatactaattagcattttaaatcagcctttcagagtacaggaaaaaaaactccataaaattttatttttattaagtgaaaactaaatattctgccaacacaaatatttgctaatatgtatacacatgtgtatgtagatatataaaaagtttggaaggacaggggccaaacagaaaatgggggtcttgaagagggctgggggtagggggagctcatatttatcatgcttctgtattatttgaatactttttcatgtaccatttacttaattaaaaattaataaaatcatcttaaggtacttgtatctgtattttaaatatatttattcaaatgtattttaaatgctgccttacaagaaatacaaacagcttcatataaacaattctatcatcattgaaatgtctactttgacaaattttgaattcacattcattgtttttaaataagttatattatttgttatttataaacaataactattgctattgctgtggtttggatgtgatttgcttccaaaaaaaatgatattaaaatttaatcccctatacatcagtgttgtgaggtggggcatagtggaagatttttggatccatgggggcagttttctcatgactaggtcaccctcctgtgggggtgtgtggattctgttttgcaggaatggattagttcccataacagtaggtcattataaagaatatgacttcttctttcattatgtgaactctttgtgtatgtcagctcctcttctgctttccaccatgagtggaagcagcacaaggccctcaccagacacagctgcccagtcttgaactttgcagccaccagactccatgagccaaataaacttttccctcataaattactcagcctcaggtattctgttattgcagcactaaacaaactaagacgagtactaaaaataaaatattcataggtgaatattgtaaaaattataaaagaaaaaattaaatattctgtgtatacagaaatctgagtttaatcaaagcaagaattttttttccttcagaatgtaataataatcatttaatgggcttatttccaagttttacttctctaaaatcaaacagtaggtccaatgaatgtaatgtgcttggcatatcctcaaaataaatttgcccatttgagaacatcatagagataatccagtaaattggccaaagaggtcatagtaagtgaaaaggcctaaatttgaactgagtcagcttagcttggaagctcttgctgtctctctcagataaaagctcctgcactgcagtaagcagctgcatctacataagtgccggacttttcatgtccagctaatctaccacattcactctgtcaccaatggcattggacacattctgattccaccctttctgtttcgctttggctaatagatccttttctagcctgcatttacataagagataaagatactatccagtagtaactttaacctgaaggtacagaaaacaattctgtgtgtccattatgtttgaatatcatgtataccctgtcaaagggcagcttcccttactcctaagtttaagggaatctgctcactggtcccctcacatgcaacaaggttgttctcttaatgtatgctagaaaggaaccatattttagcacaaatatgtgtcctttatgtaaaatgtcacacttttaaatcacaaaatacatacccccaagcaactccaatcataggaagctcttctatagatgattttctgtgctttttatttttatattctgtaggaatactctttaaccagataatctcattggttcagccagtacccaggcttctagatgctacatttgcacatactaagcaatttatcttggtcgtggacatgttcaactcatctcctcatagtatcttttgcacttggagaagtaggagctccttgtcaacctctagccattaaagagtcttctgaagtttatcttatatgtcctaaaaacacttatatgtcctaaaaacagtgacatattctgtcattgtaacaaataatggtaattattcattttctttcatatatttaaattgggataaagtttaaactaccatttcacactattttttcaacactctctccacattattgacagttcagctatgatacagtatacaatcactatctttttgactattgtctaaatactgcttgctctgtcagaaatgacctcctatctatctcctgaggttcagtttcaatgcctcacttcctatgaccttactctccccagctctcatcagctgccaccgctagatgctcctccctctaggattccataagaatttgttcatatttctattaacacatttattatactacttgagactagttatagacatgcctgcctcttccagcattgtgtgtttgtgtgtgtgtgtgtgtgtgtatatatatacatatatttatattataaatatagctctagtttctggggagaatatctgctccattgcagccatgtaaaaattgtatgtagacaagaacagaaaaccaaacactgcatgttctcactcataagtgagagtcgaacaatgagaacacatggacacagggaggagaacatcacataccggggcctgtcggtcggtggagggctgggggaggaatagcgttaggagaaatacctaatgtagatgatgggttgatggatgcagcaaaccaacatggcatgtgcatatctatgtaacaaacctgcatgttctacacatgtatcccagaaattaaagtataaaaaaaaaatttaaaaaataataaaaagggaaaaactgtatgtagagtgaataaatagattaaaaatggaattgtctgagaagttggttgaacttcttatgaacttttttcacaacttatttaggttgatacaacatggacttcaagagcctgaggttttagaatcagaaaatatctgatatgagctgagacttttattagcattgagaaattggctaagacttgttaggatgatcttgatcagtatcatctgatgattttttttttaatatacaactcctaccccaaacccaacaaggttctaatctaggctatcacacacacacatacacatacacacacacacacacacacacacacacacacaaatgctacaacacatctaaatataagaaaccatttattcatcttaaaagttgacttacattaatagtaatgcattaagtatatacattaagaactgtcttaatcagtttaggttgctatacattgccatagaccatgaggcttaaacatcaaacatttatttctcacagttgtggaggctataacttcaaaatcagagcaccagcatggtggagttcttgatgagggtactcttcccggtttacagatggccagcttctcactgtgttttcacatgactgagagagactggaagcttgctggcatctcttctactagggacactaaacctgccatgaaggctacactctcataacctaattatatcccaaaggtcccatctccaaatcccatcacatttgggatttcaacatatgaattcagttcatagcaggagcagaatgtaaataatgataatggaacatgcaatatttgctaacttataaggcttctaatgtatctaatttaaagacatatatttgagttttctttgatcaaagaaaaaatatgtctataaatgaatgtcagctataaaaacatttgcttatgatctgtcatttccacttaatgataataatgttacattgcatccatgctgctttttattttcaaggcaatttcacatacattatctgatttttcaactggtggccagtttaatgtcagaaatgtttccaagcttctatttatatttggttgtttaaagaagattctatacttatatgtggttacacatgaaacatacatttacttcagcacaccaaatcagtgaaacccgtagcaatttcagttgtgctcatccaaggacaaaattaggttttaggatttaacccaggtggcataataaaatttaaataacttgtttacctgagagcagcagcaacaaaaagagacaatcagaaatacaagccacaacagaacagtaatgaaatgtgatcctaaaaatattaataagtgttgaccctctgaaataaaataactaagaaaaggaaaaacaaaactaagggtgctcccaaagttgataaacaatgcatgaataaatgagcccctccactgtattccttcctttatatatataatacatatatgtaaaagtgatgtatatatcacttttttcacgggtcataaaatttgtatgttaataatttgcttgtttaccattctaatgtgttaaaaccttatacacctttgattttcccattgattactcttaagcagattaggcaatcaatacatgtttgttgaattgcactgaacttttaagcaagggtaaaatgatgccagctagaagcctatatattgtttcctgaatggtaagcagttcaaccaagaaaaaaaggtgaagcagatcgctttctttgctgctgttattcgtaacagtcgaatacaggttaccgtgtttttttcaatataaaatatggttgtcctagccataatcttggtctcgtgctaaatatattattcatgacatataatgagtagcttactttgtaaagaagatgtagtgatgttagcagtaagagtgaaattggccatttccccctcgtaaagctgtgtcttccccaagcaataaaatatggcttggttaagtggaacatgtggataaaaagatgaattgcccactatcttggagcctcattttaatatttaattttactttgggcacatcctgatacactagagaaagcctttatttacttttattttccagcattcattttgttgctctgaaatataccaagtactttactaagtgttaaattagttttaatattgtgaatataaagttttaattttatgaataagtttatagtactgaaatcactcagtgcggcaatgataatactgatcttggacctgattctcgattctcccttttttggcaaaatatggtgcatgggtgacatgacatttcattaatttccattcaccaggttaattctctattgcttatcttcatgtgagtgtgtgtctctgtgtcactaggaccacataaatgggggcatcaaaactacagaccacaatttcaaactgtccttctaaagtgaccagatttaaagatcaagaccagtcatttggagatgaaatgaagaatgctgataattatttattacctattacctgccaggcatcctatcaaacatatcacatgttctctcatttactcttcaaatcaacactggtgttcatattttgtagatgatttgctgaggctaagggaggttaagcgactctgaaaagataccatagctaaaaaatgtcagagatgagactgagtcccaagactttgtgattttaaagcccatgtcttttccactgactccaaagaatgagcagttgccagtagcgctgatttagaatcatcaagcagtcatgttgtctcaccattttctcccatcacccaaaattctacccacgcagctctgttattttagcaaaagactctaaatgctattaaaatgcagacaagatacagtgaatgataacatttaaagatatttagggtcagtccttttcttcttaggctgaccaaaagctaagaggataaattgaactggctgattaggcagaggtaacactaggaaaaaaaaatgtttagaaaactcgaaagacagattttaactgcttcataatttttctctgggctattgttattgctagtcttcagagaagcttgtgtggcacaaggaatactaagtgaactgaatgatctgaaaggtatatatcaaatgtgctgttaaagggtctttatacatagatggtaaaaccccatgataaaacttttgtagatacttcagcattatgcaaatgattgatcactttatgagacaattttgaataatatgtgtgaaattagttttctcctacttgtcttagttctttaaaggattaacagcatccattattctttgatgttattactgttaatatttttgaaaattagggactttttttaataaacgtacattaggatcaaaatatttcacatatcatctgattcttctgttgacctctaagtgatgatgatgtagttgacagatggtaaccctgcatatccaaatcaacatctctttgttttgtatgtgtcatgtagctttttattttgttactataattaaagtaacaaaattaaagatccaggttattatataaaattttcaggaaactatatgtctttttctagtttgacatgtttgtgtttttatccatttcttggtgtacacataaaatttaagtatgtgccatgggtttatgagccagtactcataatgcatcctgaaattttccagtggcagatataaatacagagctgtcatatttacgctgaattataaaacaactgaaaacaatgaaaactggtatattctgagtgggtggcatgttaaacccacacaattttgtcatgtttacttttatttgtactcgtttgacagcagggagaaagtactctgcttaaatctatttcgataagatagttttaaaactttataactttatgtaaaagcttacataaattccctttgctgttagttgattgaaaatggaattctttagtcacacataggtaattataaaatgaatgtccttccatcaacatatgcttccttgtttggatcaaatatatgtcttcgcatttgtagacattttcccttacttttttgttgaacttgtgaagtgaatgttaagtttatgtattcaattatgtggcgtgttacatacagaagttttctcccaactgcaagactttattttgctgggttaaaacacttggctaacatatggttgccaaagataaggtgcctatttaaaaactgatgttcaaaaaagctggtcagtgatagtttttttctgtttcattaaagacaatacatgctttctactgttttctttttttccttcagcagagttactatagaggaactatattcagattatttgtaatactttggaattacatttaaatttatcactgtatttccatgtttgaatgtcagtgagcatgtaggagcatcacatagttattttgtagcaaggaactagaatctaaccctcaaagagatggcaattttaagcatcctgtgtattcctatatgcttaagctcaagcttaattaattaataggccgcaaacagttaataggttaattttctacccattaattttacgaaatttgaaagaaatatttttgatagctgcaaaacgtattacatttctacaaaggaaaactaaatatgacattgtaaatagtgttccagacttatttttggctgtgtcccataatcgaagattttattttattttattttattttattttttttttttgagacagagtctcgctctgtcgtccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccataatcgaagattttaaagcattaaagtttattcatccctattgtcaatcctattctttctggctatattcatcagtcattgccttttcagtaaaacatattaaacatattaaagggatctgaaaacttacatgcaaatgagttgtgtgaatgtggtgaagagagagttgcaggatgttcagatacaattttttcatgttaattttatctcagaaacttcagggactaccacaatttacacagcaaattttaaaatttatagactgacattttgtttcttctttttatttatttatttaattttcaaccttcaaagagtggatctagactgacctttcaaactttgcgtagtctttttcaaatttatctttcaaactttattttccacttgctccactgctccattgctgtaccattgcttttatcacttttttctcaaacatgttactcttagtcctgtttttacttggttgtagtcactgttattctcctaaaaatcatgcattcattcattatcctattatgaacaaaaaatacacactagtcattgaggatataaaaatgaagaaaacatgaattcctacatggaggagcctattgtttagtggaagagatataattacagaggcaaggcactagggtaaaattatcttatctgttttcagattttgatgatcaacaaatcattggtccttccctataagaataaaggtagctattccacattaaaaaataaatatgagccatttgtggaagtcatcttcccttgatggtgagtgaatgaggagggtagttgtaggtcaatcttggtcagtggacttgtttgcaaccctaaaagagagcttgtgttaggacaaaacacactgaagataatgagtgaagagttgtgaagaatttgaattctatatgatgctgatgggcaccagagactaccttacctctgtatttcctcttatgtgaaaagattatatatatatatatatatgcatatatatatatatgcatatatatatatatatatgcatatatatatatatgcatatatatgtgtgtgtgtgtgtagcgtttattccaatttgtcaaagtattcttttgcttggatccaaaagtttcctaacttacctaagtaccattaaaataatcagatactaccagaagcaacctacagattcaatgcaatctctatcaaaataggaattacattcttcacagaaactgaaaaaaattctaaaatgtgtgtgggatcacaaaaatcccagagtagccaaagcaatcctgagcaaaaagaaaaatgccagaggctttgcgttacctgacctcaaaatataccacaaagctttagtaaccaaaccagcataatactggccttaaaacagatacatggactaataaaacagaatagaaaactcagaaattaatctacatgtctatacagccagctggtttatgacaaacatgccgagaacactcatggggaaagggtagtctcttcaataaatggtgttgggaaaactggatatccatatgcaaaagaatgaaactagacccccacctcacacataatcaactctaaatggatcaaaaacctaaatgtaagacctgaaataataaaactgctagaagaagacatagcggaaatgcttcaggatgtcaatctgggaaaagattttatgaataaggcctcaaacacacagataaataaggaaaatgagattatatcacagcacaaatcttctgcacaacaaaggacataatcaacagagtaaaagcctacagaatggaagaaatattttccatctactcattagaagattaatatccagaatatacaaggaactaaagcatctcaacaacaaaaatatattttaaaatgggcaaatgatctgaatagacatttctcaaaagaagacatacaaatagcaaaaaaaaaaatgaaaaaaaattctcaacattactaattatcaggcaaatacaaatcaaaaatcacaataagttatcgcaccgtcagtaggaggctattatcaaaaagatgaaaaataacaaatgctcacaagtatgaagagaaaagggaactcttatatgctattggtaggaatgtaagctagtacagccactccagaaaaaagtatggaggtcctcaaaaaactacaaatagcactaccatatgatccagcaatcctactaatgggcgtttatccaaaggaaaagaaatcattatagcaaagagatatctacacccccatgtttattgcagcactattcacagtaaccaagacatggaatcaacccaggtatccaacaacagatgaatgagctaaaaaatgcggtatatatacacaatggaatactattcacctattaaaaagaatgaaatcctatcatttgtggcaagatgtatggaactggaagacactgtgtaagtgtcaggaatagaaagttcaccaccacatgttctcactcataagtgcaagcttaaaaatgttgatctcatagaagtgaaaagtaaagcacaggatactagaggctgaaagagtaaaggcaagggaagatagagaaaaatttgctaaaggatacaaaactatagctaggtaggacgagtaaattctggtgttgtataccactgtaggataacaatatttaacaataatacatagtttcaaatagctaaaaagaggatattcaacatttcgacattctcaacacaaaagatgagtttgagaggatgaatacgctaattatcctaatctgaccgttatacattatatgtattgaaacatcactgtgcatttcatgaataggtacacttatttgtcaattaaaagtaaaattttaaaaaaatcagaaatattaaaacaaaagatactattagcagcttaaatatgaagggacctgaattctcaaaaagcaaaagtagataaaactgtgagaatttcaactctaaaaatatacttttcataagttaaacaatatttttccttgtgaatttttaagttcaaataatagtgacataggtgcctgctattttgtagggtgaatttcattaattttatgacacttggattccataataacctgtcaagatagatagaaaaaaatatataacattccaaattaaatgagaaaattgataatcctagaaatgtatgttatttgtaaaaatcaacattatagtgcagatatcccgcatttgattataagaactcttctcatttgtctatctgccatacttcttattggaactcagagctgatataataattctgatggttttaaaactatctgtgaacatatgtactaccctaccatttggtgagtttaaagtttggaaatcattaataaatgatattcccattaacaaaataaacatcactgaagatatatgttgagagatgggaaggagttggtgggtcaagagagacactcttttgtcctttgtccctgtctacaacaccattttgtggtctggctattatttcatagttaccactaccatctggaaagaaagattatcccacatgcctgggctcttaaattattgcaatattttttgcatgaataatgaacaaatttataaattataacatcattcctgttatgtttctaatatgaatgatattcacttgcaagtgtagggcctttgccctgattatagatgttagaaaagaatatgtgagaggtgttatagaaataactgaagtaagaatttacacgtttgttatttagtaaaagtcaatatatttctaaagacttgaataaaacaaatgcaattttgtacagaattcttcagtgcattttctaatttctcctctctgatgtgaaaataacacaagatttagaaatcacctgcaataaaacatgtttatttacaaagtgaaatagtttatgttgtattaacttaaattttcctatttccgatgcccaagtaatacccctctaagcgaatcatgattattgacaagtttacttttatacactttatagtactcatttcccataaataatgtatgattctttaataaaattgataaatattcaactctcaataaggcaaaatcctatgtattcaaaataaaatttaattgaacattaaaattcttgtctagttcccattttgtgtgtgtgtgcacgtgtgacttaggctgtttttcctgacatttgtgaagtcaatgagtttttctgctgtacattagtttctccccttcagtgctgccttacagtaccctattgtataaaatatgcattcagtagagaaaacaatatactgcagacatcagacttaaacaaaacactttttattgttgctttaaaaaccagactttacacccctgcactgaaaataggaactatttgttcctagtccatgtgcctggaccaaagcattttaaagtacctaaaaaaatttaaatttataaattcaggtttataaattgaccttattgaccaatacctataagtccttttaactttagaaaaccctccacaaataacaaatatgatcattttcatttggctatttttaatataaattaattttttcttacagaaaggaatgaaaagttttattaattagagcacttacttaaaccaatgctttcaagcaatctttctttggagtcagtgattatctttggctctataccaaaaacttcaggtattttttcttctttgcagtgttttaaaatgtatttggttgggtaaaagtcactgtttttaggtttcaaaatgtttctacaatatattaagccctgatatatactaatttacctctttatgatttgagtgctagattagttttacacctaataatgtagaaaaaaaatttaagcttataaatttgtatatattatactaatttctgaatataagcacaggtgatagcttattatatttgttcatatgcagctcctggaataatcctagaacaacgcatagtttataaaaaaaatagaaggggagtaggaaggaatgaaaggagagaaaaatagcatctgagcagtctgagaatttcacaataatagctgttctaaagtttagatgactataaattattcttaaacagttatgttttgcctatgtttaatatatataaaacagtagtatttgtatttctgtaattaacatttctctagaaaacagtgttaaatatatatttgttatagtctaaatttgtgttcataacatgtaaattgcaagcatgagtttagaaactcatgattttgccccctcctttaaaaatcagttaatcaataatttgtattgatgcactagaactccaagcaagcgtctcagagtgttctatcacaaagaattattaaaaggaaagcttcaaagctaaatcttcaatggtagctaaagagcagataaagactatatgaatctgattccccaagacaagaagttcttataaattaaaggcaaataggcaagtgattaggtaatatgaacatgtgatttaaggtgaaaatcttctttcaatggccgtgaataaatctcctttaaagacattatattgtgttcactaaattaaaatgtgccaattcttcaatgatcaatggcaatttgttttgctttaattagctgataaaacaaatgaataaatagcatcagctaaggtcatctgttctacctgttgctttaggttaatgtgtatttcatcctcagattccttagctctcagaaatttgactgacatgactcaaggaaataaaaatatttgaaatatgtatataatttataacataatgttagttttatgtaaaagcaattcagcaagtctgaaattacttttctgcaatgactataatgtaacaaatagaaataatttgtaacactgtgttctatgtcaattgtacttaaacacttttgagatatggcagaggatcttgcttccctcaggactaataatgtacacttcatctaagtccaaattttaattaacagttcttgttaagatagttttttctacctctaaacctaatcatacttggtatttaaatggcatattcaataaaagttgtcccatttcacctgttttgaagtcaaaggtttttgctttaaaacatttttgaactagctctacagtttttagaagctgtttagggacttcacatactatatgcaggagtaagtaactaattggtgctatactttatggtattgacacattcaaagaacttcattgattcagtacactttctctttcttaaaaacatgagacccttaaccatggtagaattctcattgttaatttattttggctgctctattgcctgttactaagttattctgtttcaagggcaaaagtatattttttccacatggaaaaaaattcaaaaccaggcagtagatagataaaattattctttgccattagcatgctaaataatagtattgcaaacagcagttcactatgcacagcttgatacgatagatgaaaatattagtttatgaatctgatacttaaactttactaagtaaagttagtaaagtaaacagtctttactaagtaaagactgggttctttaaagcccaacctttggtcttttgaatcgttctctatagcaattagtcactcatataaagtgagatattataaaccgcaactctgtttcagcatgtagaattctttatatatatatatagacacacacacacatgtatatgtatatatacatacatatacgtatatgtacatatatatatgtatatgtatactttaagttctgggatacatgttcagaacgtgcagttttgttacataggtatacacgtgccatggtcgtttgctgcaccaatcaacctgtcacctacattaggtatttctcccaatgttatccctcccctttcccctactccccgacaggccccagtatgtgatgttcccctccctgtgtccatgtgttctcattgttcaactctcacttatgagtgagaacatgtggtgttggttttctgttcctgtgttagtttgctgagaatgatggtttccagcttcatccatgtccctgcaaaggacatgaacccatccttttctatggctgcatagtattccgtggtgtatatgtgccacattttctttatccagtctatcattgatgggcatttgggttggttccaagtctttgctattatgaacagtgctgcagtaaacatatgtgtgtatgcgtctttagagtagaacgatttataatcctttgggtatatacccagtcatgggattgctgggtcaaatggtatttctgggtctagatccttgaggaatggccacaccgtcttccacaatggttgaactaatttacactcccaccaacactgtaaaagcgtttatatttctccacatcttctccagcatctgttgtttcctgacttaatgatcgccattctaactggtgtgagatggtatcttattgtggtttttatttgcatttctctgatgaccagtgatgatgagcttttttcatgtttgttggtcgcaaaaatgtcttcctttgaaaagtgtctgttcatatccttcgcccactttttgatgtttttttttttcttgtaaatttgtttaagttccttgtagattctggatattagctctttatcatatggatagattgcaaaaattttctcccattctgtaggttgcctagtcactctgatgatagtttcttttgctgtgcagaagctttttagtttaattagatcccatttgtcaatgttggcttttgttgccattgctgttggtgttttggtcatgaagtccttgcccatgcctatgtactaaatggtatttcctaggttttcgtctagggtttttatggttttaggtcttatgtttaagtctttaatccatcttgagttaatttttgtataaggtgtaaggaagaggtccagtttcagttttccgcatatggctagccagttttcccaacactatttattaaatagggaatcctttccccattgcttgtttttgtcaggtttgtcaaagatcagattgttctagatgtgtggtgtcatttctgaggcctctgttctgttctattggtctatatctctgttttggtaccagtaccatgctgttttgattactgtagccttgtagtgtagtttgaagccaggtagtgtgatggttacggctttgctctttttgcttagaattgtcttggctacatgggctcttttttggttccatatgaaatttaaagtagttttttctaattctgtgaagaaaatcaatggtagcttgatggggatagcattgaatctgtaaattactttgggcagtatggccatttccacaatattgattcttcctgtgcatgagcatggactgtttttccatttgtttgtttcctctcttatttccttgagcagtggtttgtagctctccttgaagaggtccttcacatcccatgtaagttgtattcctaagtattttattctctttgtagcaattgtgaatgggagtttgctcatgatttggctctctgattgtctattattggtatatagaaatgcttgtgattttgcacactgattttgtaccctgacacttttctgaagttgcttatcatttcaagaagtttttgggctgagacgatggggttttctaatataaaatcatgtcttctgcaaacagagacaacttgacatctggcttgaggagctttaagtgaccagatcatggccattgtttcgagtaaagtggaacccgtatacttgagggacgtggtaagaccaatgactactgggtaaataatgaaactaaggcagaaataaataagttatttgaaaccaatgggaacaaaaacacaatgtaccagaatctctgggacacagctaaagcactgttgagagggaaatttatagcactaagtgcccacaggagaaagcaggaaacatctagaatcggtatcctaacgttacaatttaaggaactagagaagcaagagtaaacaaattcaaaagccagcagaagacaagaaataactaagatcatagcagaactgaaggagatacagatacaaaaaacctttcaaaaaagcacggaatctaggagctgtatttttgaaaagattaacaaaatagatagactgctagtcagattaataaagaagaaaagagagaatcatatagacacaataaaaatgataaaggggatctcaccactgatcccacagaaatacaaactaccatcagagaatactgtaaacacctctatgcaaataaactagaaaatctagaagaaatggataaattcctggacacatacacccacccaagactaaaccaggaagaagtcaaatccctgaatagaccaataacaagttctgaaattgaggcagtaattaatctaccaaccaagaaaagccaaggaccacacgaattcacaaccgaattctaccagaggtacaaagaggagctggtaccattccttctgaaactatcctgaacaatggaaaaagagagactcctccctaactcattttatgaggccagcatcatcctgataccaaaacctggcagagacacaataagaaaagaaaatttcagggcaataaccctgaggaacattgatgcaaaaatcctcaataaaatactagcaaactgaatccagcagcacatcaaaaagcttatccaccatgatcaagtcagcttcatccctgggatgcaaggttggttcaacatatgcaaatcaataaatgtaatccatcacataaacagaaccaaagacaaaaactacatgattatcttaatagatgcagaaaaggcctttgataaaattcaacaccccttcatgctgaaaactctcaataaagtaggtattgatggaaggtatctcaaaataatacctatttatgacaaacccacagccaatatcatattgaatgggcaaaaactggaagcatcccctttgaaaactggcacaagacagggatggcctctctcaccactcctattcaacatagtgttggaagttctggccagggcaatcaggcaagagaaagaaatagcaggtgttccagtaagggaggaagtcagattgtctgtgtttgcagatgacatgattatacatttagaaaaccccattgtcttagcccaaaatctcttaagctggtaagaattctttatttagtatttagtctagttttaagaaagtcttctctcacctaccactattgaagttttatgggaacacaaatgatattatagtctaagtgaaagacatgttcatagtaggcttacaagaaatatttcatgaaaaaacactttgtactgtaaaatttgtacataagccattgaccattttttcatgagggaaaatataatgtcataattcggattggtattttagtgaaatggaaggtcgctgtatggcctcttcctcattcaaagtttgtgaaactctcttctcttttctttgaggctgtgtcttgagcaaagttttactgcaagttggaaccaaactgagatcaaatggccaccagttagtagtgacatctggaaagtcatcttctgtattgggaactcacctaataccacttgaaattatatccttgtctttcattcaaactctgacctccatctttctgattgtaacatagtcatcaaaacctgctaattgctcatcttcttgtaagttatttatgtggatgacctcagcgaatcttctcaaacattctatgaggcaggtactattattattctttctgggtctacccctttgtcctctagctattttttggagagctgataagtgaacttgaaatctgactacagggacttttctaataaccagataactttatttctctcttcttgatatatttgttttctgtgctcctgcatctagactgggtcgtgataaagctgagtccagctgtagggccagacagagccttcctctccacacagcattcttagcattgtggagctcggcttcaggaagcattttccttacttaatagaagctgttgctcctcttcatgggaagtcttggcaatgccagtgatctaaggtgatggaatctgttgatcctacatgcagcagcagtcggtactgaaatgagtaatattttaataatttttttttgccctttcttcttccagttttgctattcaaggtgatgtttcttagtcttctgctccttaattagcacctgttgactaaatggatcaacaaacctatcccacgtgtgacttactctcctggacacgagtcttgttttatagtctagcttagcagacttcccactggtttctgtcatgatactgtccatctagtgaacactttttttgttataatttcctccctctaaacttcatactgttaagtagtttctggagtgcaggatttttttctaaagtcagaacagtgggaaatgagttaataaagcttctacgttccttggaaagacccctgagagatacttaaccagttgcctgctgtgtaaatgttattgagaatgaaaaacaaaaagtaaatttacagcttctgttgtgtccacatccattccaaactagatgcaccataacaaaaataacacttagaactttaattgtagtatctgtgaaaaggcaccagtgtgatttatgtaataaattggatactaaaaactttcttatgatatcatgcatttaaaaattaggaaatgacagccctgaaggtaaatgtaacttgaatgatagcattttcccaaaagaaagcattagttttcaaataagtgtacttttaccaatttaccagtaaacagatcttgtcacagaaatacatacttataaaaactttggacatatttgaaaaataagcagattttcttaaacctcagtttttgggtggtcttattttcctcttctctataagcaaacctttgcccatcaaatagatatgtactttttaatgaaaatatcatatggtaattatattacccataaatttctcctatggaattttctagtaagtaggtgttattgtcacagaaatacttatttgtaaaaacataaagtaaattaatcattatatgctcattgagtaaacatagctgagtaataggttgcagtcatttttaacacaatttaacaaatgtttgaacgatctataatttttattcatgtgtgatttatggcatccattttaactaatgtaaagggtagatgatgaatattagtatcagtcaattccagacttcaaccttaatacacataaaagtgactaccaagcattttctcctaattaaaaaaaaagcaaattttatttattttcaatgaaattttagcttctaatagtcttcaaaagctatgtagttattataataatgttgccattcctcaaaaacattctcaggctgctttggaatcaccttaagcatttatttctgaaaacctattcatgtactccctaagcatagatgaacacaatggcctcatttgttaaagctgtttactccttgtttggtaaagctgagctcacaagtcaaaaccggcctgcagacatacggttttgggcaccatagtgttttctaaagggattttaagaccattaggcacatctagctcaaaggtaattgtcttatacctggcacacttcattttaaacttgcttaatctctagaaacctatgctttagttatccctaaacaagctgaatatttagtttacttttctgcatctcatagtgatgtctaataggcatcaaaatcactcaaaactgtgctcttaatctttgttcataaacctgttctgtttcagttttctccacctctgtaaatggccgctctattccaattactcatactgtaaaacttggagttctctttgactcaatcatcagcaaatcctgttgcctttatcttaaaagtatgagcaaaatctgctacctgctgtcccgagcccctatagctgtcacctcgctttactggcttatcacagtgatctttgaattcatctcccttttccacccttctttgcctatagcctgctctcagcacaatgggcagaatcatccttttttaaaacacaggccagatcattttaccctctccttatgacctttcaatgctccccattttactactaaagaagtcacatccttgaatcagcctttaaagtcctatacaacaggtccttggaatgtttctgacccaccccatgctatttctccttcattgcctctgctttaactgtgctctttgtttagcacactgggaacagtgctgccccaggatctttgcacttcctgttccttctgcctggaatggtcttctcttacttgctcacatggccacttgtctcctcttcttcaaaatattgcccaaatgtcaccttcttgatgaagccttccctgaccgccctaaagtagaaacagcctgccacccacctctctactccctaaccctcttttctactaatttaattattttttcatccaaaactcttacctctcctaatatgatatgttctttattcatttgcttattgttttttataaacaacataaacttgaatataaacttgattataaacgtgaaagttcaaagaattttgtctgtttttttaactgccacatctttggacactgaatgagtacctggcatgcagacacaatcgtatattaaagataggtgtttctttccaaaactcctaacaatcctagaaaactaaaatatacaccactactagtattcaaaacatcttgtttatgcatggcttcaagctttgacctaatttgtttatatatgtccctatattcagttactgttttcataaactttatttataaccccttagctttcatcctgtgtcttcatccttgtggttcagcaatgatatctagtctatatcttggtatataaataatcattgaatttttatgatatttcagtatgttaaggtctcctaaagttgaatattgtaatcttaatcttttatttatcccgtgtctcctgtgattcatatatttgaaagtaaattttaattctttctccaaaagtgtgttgaccataccagtccctatctttaaagacatgagataatttttcaatatttattgtgcatctgtaattgataccattggcttattttcttgattaactcttactactttagatttctctatctaaggcattcatggtgcttttttcactctttatatatcctcagtgtaccacattcctttctaccataaatatttcttttgaaaaaaaaactctctgtaccctctgtagatgtcacactgtgttctttctgatgtctccatgacccctatgtgttcatggatatttattaattttatatagtgactggacactccagtgaattctcaccagccatttcgaccccccacctgccattccaactccccatccctaaatgaaatcagcagagagaagattaaggccaaggcaacaaaattatatgaaaaggtatgtaggtggtcgcagaaggggtcagagaaggtaagtggtttccttgaacattaccaatgggttggattcatccattagaaggattttcaactgaaggtcatgaagcccaaaacaacaaccaaaggttatattataccaatgaagggtgtaagagttcacagacataaaggctggagattgtagaaagccaagaaaagtcaaagtgctggaacttatcatttaaagaaaaaaacctaaaatatagaaaaccaaaaaagattaactaaataatctggaagtccaaggacaagagctacacagtgcaaatgaatttggaaagcaattatgaaaaactttcctttaggatgtatgatcttcttgagagctgtatactcttttacctattctgaaaagtaccttaagctagcagagtccatgattttctgacaacaatgaattttatacattcttgctatatgaacactaataatataatgttaggttattcagttttgtgtgcatgctttgcaattttcaacaagatgttccattattcgatctgtctatcttgttcttgcttactcagagatttctaggaatgcaatctataccctgtataatttaacttttaagtcacgttgtgttagacaagagttatgccttatcttctcactaataataaagtgtcctaggattaattttattatttagtgcatagttccctagttgtatatattacttcacaaaaaacaacctcaaacttattgagtaagatagtcttattgagtaagataaacttacttattgagtaagataaacttgaatataaacttgattataaatttgaaagttcaaagaattttgtctgttttttttaactgccacatcttgagtaagataaacttactcaataagataagatagtcttattgagtaagataaacttattgagtaagatagtcaccttttttatttttaacaatgacatattgatgagtcaggaatttagacccagaatattgaggatggctcttctctactgcatgatatcagatggctaagggggtaactcaaaattctcaagagctggagctggaatcacctgacagcttcttcacttctgtgtttgacactgagactgggaaaggtgaaggatgcattcggctggaacagtgggcctgagccctcacctgtggcccttccaactagagagtctcaggctggttaagtattttatataacagtgcagggctccaagattgagtgttttcagtaaaggagtaagctttgttatggtttgttttgagactaggtctcgctctgtcacccaggctggagtgcagtggtgcgatcacagctcactacagcctcaaattcctgaactcaaacaatctttccacctcagcctttcaagtagcggggattacagttgcatgccaccacaccagctaatttttctcttactcttagtagagacaagatctcactctgttgcccaggctggtctcagactcctgagcccaagagatcctcctgcctcggccacacaaagtgctcggattacaggcatgagccaccacttctggcctaagctgtattatcttttatgtcctagccttagacatcacataatgtcacttccaccatgatctgtcagtcacagtaatcataaacattctcagattccaggggaagagttgtagactgggatggatattgaggcatttgtagctataatttagaactgccacctcacctacaggcatactgactgaatgttctttactcctattccttatgttatctttaactattacagtagttgctgagtgttatggagtgcatatctgtgtcccttcaaaaacgtcataaaacgcatacccaaggtgaagccaactctaaaactgcctgtcctagatacagtttttggaaacatggcattggagaattgagcctaaatggataaagaattactggcataatttttgtatatttccctaaggccctataaatactataaaatgaaatacagaagttaataaaaaaaattaaaaaaatcaagagtcaattgagttggaaatgacttcaagacagagttgataacaatatatgctttatcaaagagtctattcagtgatgactgaatcagatttatactgatccatgaatttgaggtacaatcaagatgaaaccctcacctccaatgggtcagtgggtctgaaccttcacctgtggctcaggtgatagcatccaacgggatgctaatacgtggtgggacctttggaaggaaattagattcagatgatatcatgagagtgtggtcctcatgatgggattagcactcctataaaaagagaaggagactagagcttactctctgctgtgtgaggatatggtgagaagatactgtcaacaagccggaatgcaggccctctcctgacactggatctgccactgccttgatcttggattccccaactctgaactgtgaaaaaggaatgttattgtttaattcattaactctatggtatttcttcatagcagctcaaactaagacacctatttgtaaagagaatgtgactgttatttgtcaccccgtataaagacagttacacagtttaatgattatttccatatttttctaactgcacattagctgaggcataatttttcttgtacacattcttttttaaaaatgttctctttattctgatcatacctcaaattcatggatctgtataaatctgtatgattcagtcatcaccaaatagactctttgataaagcatatattgctatcaactcagtcttggagtcatttccaattcaattgcctcttgattttttgtatgttttctattaacttctcattttattgtatggcatttatagggccttagggaaatatacaaaaaaagtaattatgccagtaattctttatctatttaggctcaattctccaatgccatgttttcaaaaactacatctagcacatgcagttttagagttggtttcaccttggatatacctttcatgacattgaaattatataaatctttaaataagctttttgtgttatatagacctcgcttgtttctgtcaacagttggcgtatgctagtttgacccctacattgtccaagttattaaataacttgtagaagatcactgaatagaatacatgcttgtagaaaagaaatgcacatcaagtaagattctagtagtttttctttcccttatggttaacagattttaagatattatctctcatcaaataatcatgttgagagcttacattatctttttatattatctctttctatttgcttacataagctagtctacatgctgctaagaagaatgtggataaaagatccaaaatacttggtaataagtattcattggaaatgagtgtcactgtgtaatattgccaactttttctagttttgttatttccatgtacacactgaacacttagaaaattatatgtgtaactttaagtatttgttcacatatcattacatacatatacaattgtatatcagctgtcaacctgctatgatgttttctggtgttaaaagggactcagtttcttctatgtcatgtgaagaaacatgctgtcatccatcagactgttttacatttacataataaatcatgaaattccagacagtgttcactcatttatggttggtcattccttgatgttaatggaagacaaggcttatgagaatatttcacttctttaagttctgttggttaaaaatattcctaaccagcggatcacaaggtcaggagattgagaccatcctggctaacacggtgaaaccccgtctctgctaaaaatacaaaaaattagccgggaatggtggcgggcacctgtagtcccagctactcgggaggctgaggcaggagaatggcgtgaactcgggaggcggagcttgcggtgagccgagatcgcgccactgcactccagcctgggcgacggagtgagactcagtctcgggaaaaaaaaaaaaaattcctagccatgttaaaaattactttggcgttttaaaaatgtttaattttgatatactatgtcacaggaacaaagagtttataaaagaatttgtatttttttaagtaaaagaacccttataaccaagagccaattagagatgttcttctagcagcatatagactatgtaagctagtgtgaatttgggatattttttgtcattctttaatttctattctttacttagtttttcctgtttttaaaacttatatgaataggccgagtgcagtggctcatgcctgtaatcccagcacttgaggaggcagaggcaggcgaatcacctgaggtcaggagtttgagacaagcctggccaacatggtgaaaccccgtctctactacaaatacagaaattagccaggtgtggtggcgggtacctgtaatcccagctcgaacccaggaggcggaggttgcagtgagacgagaccaggccattgcactccagcctgggcagcagaggagagacactctatctcaaaaagaaaaaaaaaaaaaaaaaaaaaaaaacaaagaaacttatatgaatagaaatataaagtcgttcctattgtttctggctattgtcacacattatctttgtcagatgaatgtttgaattaattaataaatattttctactattctatttcccccatctttttgaatgttataacttcactttctattattttagtggttaccctaaaaattaaaacatggatatttaatatgtcaaaacattatcagtctctttactcacctcttagatatttcaagaactttaaaacactttctagatttacattatagtgtaaaatatatattctagatttttagtcttacaaagttatatttcctattttataattatttgttcatttctatcaacatagtcacccactgtttcccattgcttctagaatctcagaaggaaacaaaatcctttagaatttcctctacttaatgtttcttgatttttgtttgtctggaaatacattataatctgttgctgattttcctagttcttgaattatttgccagtctgttctgctggctttcattctctttccttaaatagttggccgttttttattcggcactgattatgatgctgaaataattatttgtgtgaattctttgaagtctatggtgaaggtcctttccttcatcaagaattttcattagattctcctgggtacctggactcacagtcattattttagatgcaaatagcataatagtcttaaggctattcaggcgtgctgttctttgtagatattatatcacaatctgtacttttatcccattcattagatttccaaaattttacataaagttcataggattctcattagctttttaatctggaatgaatctaaagttttgcctccacttgagccttctccatttttttctttatctgtctcaatggagatttgtcttatctttccagagaatatgttcttagactcactcattcctctcatcagttttctattttagtagactgtaatttttttcataattttcataaaatctaattttctcataatttccttttctctgccttctttgtattacctttcctttatttcagtagagtataaattttttcataaaatctaattctttcatagtttccttctctctgccttctttgtattgacttttcatttttgttacttcttaagatgaattctcaactgatactatattctttatttttagtataagtaaaacaataaatttcacttaaatcttctcttccgttgcatctcacaagttttgttatgcagtactttcattattgtttagttatgttcagtatcttttgatatccacaatcaagttttattagtccaggtatgtttttaagtgattttttacgaatttgttgcacgcacacacacacacacacacacacacacacaccccaatgtttattagtgatttctaatataattgcattataatcagagatattcttagacattttagagactcgcaatataatttattatatatccactttcgtaaaagttccatattttctggagcggactgtatatttcctaattgtcggccaaagaattatttatatatctttagatctcaaaagtttaggtgtgaagtttattttttattgtaggatcaaacaagttaatttagttcacaaccagcctggatgacatagtgagacccggtgtatacaaaaagcaccaaaacaaacacacaaaagataatttaacatggtgaccactctccaatgcattgttttaattagtttttcttaaaaaccaactttctcctgttgctttatttttgtaaatgtctttattgaagagaggcacatcagcaaggaaatagggccacatcctattggagggaattccgagttctaaaatgcacctctacattggcagagaaatgacaaccagttaatgaaaacgagtgtttggcagctgttgtctcctttgcctgaggccgttctctagtgtcacagcagggtaaagatgtgtgaaaagttgtatgaccagatggccatgagatccagaatgcctagaaataaaagttctaattgattctgcaaaagagaacttttaaaattgctataaggctagtcccagcatgatccagtacatgattaaagaacataataatattaaataacagcaaaactcaaagcaggaagaaagattgtcccatgctatcatgtgactcatccacacaacagaaaaggcaaaacacactcagcaaatggaagaatttaccacccttattctggccactcatcacctaaatgaacctaagccattccatctcaggactgtgccagttatcacacttccggctccagttaagagaatggtgggcaaacactggttaaacaatagagggtttttgtaaattatcatttttaaaaaattttatgagaagcctgaaaagtgggaatcctagatttggttaatgccatggaccattggtgttagacactttacttttcactctaccatctgtaatgggctaacctttgcggtcaggtccttccaggcatggttgatctcacatagccacatacaaggatgaggaaaagcctttctttctttctctctctctctctgtctctctctctcccccccctccccctcctcctctgtccccctccctccctcccttcctctctctttctctccctcctttcctctctctctctgtcacacacacacacacacacacacacacacacacacaaatatacaccatcagtgagaagtatcatgccagaatccctaacagattttattttggatcttattagtcaggattagtcaccatgtgctagctacatagaagcctgggcagggaagtctgtgacaggttcagggtcattctggacagctggtcaactctctaagcacagaaggaggtagaggacaattgagtagggcatccctgaggatattctgaagaatgtcagttgagttgtgttgggtttggttttctgtctccctgcaaacagtggcaagcctggaaacttgctttagctcttaaatagtacttttgtacttacttgaaatatagagtgtctaatattttgaggcatttcaatgatggcagccttgttctgtagatgttacagagagataatgaaacactcccactgcttggttcctgtccttttcctctgcccacggcccggtcagagctggaagggtcagtctgagagcaggagcagctctggctactgcaacctttgggcaaatcacttaacctttttaacatggaagtcttcattaaaataagggcatgcatgtatcaagggcattgtttgacttatgtgattatctcgcagttgcttttgccaatcacatctttctaaatacaaaagagttcctcttattgctgaagcacccagctaaaacagagttggtatttctcacaactcattcagtgtaattaaaaacaattaatagatacctactatgtataagatgccaacatgaatagatcatagttcctttccttggggacccacagtagagatacagttattgaaatgtaaatcaatacattaaaatgcaaaacttgtggaaggcagagaagtagcagaaaggagggatgctttgctgaaattaggtcacaagtagtaacttgctgagtttaaggacttttggactatggtctatacaacggaaaaaagtatgggagactttgaatactttctaaccacgttaaatactttataaccaggttattttatagacacaaagtaaaggatattttataaccatgttagaacttgaaaaagcacttgctattttggatttagtttattccttcttcttttgtgactctttatttccagcatcgtattggatatcttctcatgaagatggcataggcctttcaaactgaccatgtccagaaccaaactcattctctgtctcccccaagctaaacgtgtctcatttgtttttggtgcaagttactgacatgaccatgaacacagtcaccaaatagaaactaaggtttgttcatgagacttccctcttcctctcctactacacacatccaccagcatgtacgatgaattctatagtaaatcatttctcaaaatcgtttctgacttttctttctcgctcccttactctaagtcaagaatcagcagtctgtttttccataaagggcctaataaatattctcagttttggaggccatatggtctctgtcaaaattactcacctctgccattgtagcacagaagcagtcgtagacaatatgtaaatgagggaacatactcctgttcctcaaagttattatttctaacaacagattgcacttggcttaagggtcatagtttgcccatgcctgattgaggccctcctcaactttcacctggattaatattgcagcatatctctaattggtcttccaggctttaattctgctctacaatctcgcctttgtatttacctgcataaataacaaatcgaattcatactgtctgtatgaaaagaaatcattgcccataagaaagtgatatttcctagcttgtcacacgtggtcggtccttgcggacttagattcgtgtggctctttgtggcttcctgttccagcccttgttgcttcctgtagtcctcagaaattctgtcccttgcctctccccaaacacagtaacatcttccgtatttcctacatggttgcagttgtcacctcagtgtatgggtcactcacttatatgtgcatactctgtgtgcatgagagtgtgtgcgatttgctacagattttaattaaaaatattatagtcatatgcatgattatatttgtgtgtacttaaatatatatggaagaaatggacaatgacgtgtccatgacaacagagatactgtttccgtgcatctgtatttgataaattcttagtcatcttttaagacagagctattttgtgaagccacaccacacgtccttggggcagtcattgtctctctgagcaccctttgcacatcagtcgtttcttgtctatcacttgcagtggtgtgctggagcttgcttagactggctcaagaaaactgatggttaaattttcaggaattccgtgagtcgcttgttaaattgttgtaacttgaaattaaccatgatgggagtatctacaatagcagatgctacaaaccaggatgtgtttttagggtttattttgttggagaactggttgaccagcacaccactgaatctttccttttctgatcgacaactatgtaagacaatatgcctaatagatacccaatatatagatacataataacccttaatccttagtatgttttagatgactcagtagacttcctgactactgtctttaccaatgttctattagatgagatcaaaagatgcatctttacattgaatttgattttagtagagagaatcacttatttttttaattagaaattaagctgcatttagaaagttaaaaaataatgattactgattttacatttaagtcaactttcaatatgcttagtattaccaattgttactttaataaggtgtttttctgggaacattgcttataaaatactatttatatgtttttgtttgtttagctccaatatcaaagagaaatagctatattgcatgtgctataactgactgtcaatgaatgggtaatttaaaatagcctcagatgcctcaaaccttaacgctaaattcacctcacaaagggaatttattcaatccaaacgccctcctattgcttaaatgaagacattgatatgaagattcatatctgaagttaagatattagtaaatcaaacaatgtaaaattcacgaccatatatatcatacggatttggaattagctgagtgatctacttttgtatatttttgtggttaaatttaagcactatacatttatgagaatgattttctaagaagaaaccccatttattttctaagaaattgcagcctacctttctatgctggtttgttttatgtactactattgacttttcttcagttttatataagatacacagcctagtgaataataaaaaagtattattacatttactttaactcttagcctttgctttgactgcacagaaggagacctttaatttttatatgctttgaaattcatgaaaattgacatttttgcctgacaacttatttctccactttcatatgcctttcctcttgactgaatttagtcttttgtagtgttgcagaggctgtagattaccaagttctcctagattcacagggcagtaactataggcttgaagaacattcaccactaaacctgagtgaggctcattcgatgttgtaagaaatagagggctcatttgttccctctgacagcctctccaggggtgctcacttatgtgtacatgcactatgtatacatgtcctatgtgtatgtatgagagtgtgtgcattttgttatgcattttaataaaatatagtcatatatattattatagatgtgtatatacataaatacatatggaggaaatggacaatggtatgttgtaatgttcagaaatgaacaaggtgatgtaaacactgtccctaaatcttgtttcacagtagagtttccagtagatgacaagtacggtagccaccacaaagggctgtgagagagagggtgcatctctccaaaacaagtattccccacaacacagtgacagtaggctaaaacatttcgaatattttccctgcctgcttagagaaagcatagggctcaggctgtcattccatgttacagtaacagttctcgtttaaattcattaataaacaagcactcttctaaacttagctaatgtgctcttactcctgaaagataaagaaatccagttttgggatgctgacaaagtgagtcttctgagcctattagagtaaaaacagcttaccctagtgtaaggcaactataactgtaagatcatgaatgttctcgagagaccacttaaggacagacacaggctattctgggcatattttaatgtcctttttggcctttctattttaaaacatttcatctttcttgtgtgtggctcctatcattgctttcctaagtttaagttggtatattcaactgttcattcctgaactctatcccaggaacttttttctcccactcttaacagaagtcaagagacataggtcaattttctgtaatttagtaagtaattcagtagcactcaatactcagtatcatcatttatacattataaccattataacatttattctgcacatctaagtttgctttgaatgacagaattaatactaagagaccttgtctcccttgaaaattgatgggaaggaagctttagccagataaatacttttttaaaaaaaaatgtcatcaagtgagagagcctgaaccacaatcccaatgggatcagaacacttgagtcaattagccaagactccacctacctgtgcactagtgatggcccagccaatggaaacccactacttaacatcctggcaaagctccctgtctatgggcactgcttaactgggccatatcctcacttcctctctgtctcccctttctttttatgctttctttgctgaccaagcccctgttcacattctttcctatatttgttaatatattccatcacattattaaaatctaactgatcgtaccgtccagggacacatcgtgtccctcgaagacttgactctattctaacccgttattgttaaaattaactttcaaagggcaattagcatttgtaatttcatgaggaatagtcaaatagcctgaaagtaatatcaacaggctctctctatttagaggggcctcactgagaaaaggtaaagaatttcccgttttaacccatgatggtgtttgtaacctagaatgccatttttacagcattcaaaatggccagtttcaaggtggctgacgtggtttcggtgattcatattatcaaaaaatgtctgtcttactagatttttttaaccagaagttgatgtagttttaaattttttaaactgccatttactatgaattttaggtaggtgcacaaataacctacagctttgaactttctgaagtaatattttcatactttttacttcaaatgtagaataattttttactggttaaattattttgacagcttaaacccaatgaaagagtatatgtgtatatatttatgagaacattgaaatactgtttgagagtaattatttataacagagacttctggatttgacaaatgttatcattgtcttgagaactgtttctagttgtaaacagtaaatagataatactgtggtcagaaactttcctggaatttagtagtgtttgtatgaactgtataccactgagaaccagagcagggagaactttagtttattatacttgagttctgttttttctgtttgttttttgcttgttggtttggtttggctttcatcttgtaaatagtaaataattatatttcatctagcacatttttatgtatagaagatatacattggagatggaataaaaatataaactgccaatattttacttatacttttgaaaagatgacttgttacagataaatttatcaggaaaaaaaaagcaaacatagactgcaaatccctttgttttatgtgtcttcctaacagatgatgggagtttagtctaaagaatagaaagccatacggacaataaaactcattcacagagatgaatctcgaatatttcaataatattgcatttggattggaaactgtaaacaaaccttcagactgcaattcaaattttacttttattttttttcttacttaaacatatgtacattatattcctatttctcaaaaatatgactaggaaggtaaaaagcaactaacgttatagccttcttataaagaaatttggccctttatgagttcaactaaatagctaaatgtctacttttctatttgtaacatgtttttttcactgttaccagtaaaaagtcatttatttataggcctctttagatatttgtatttttcttcaaccacaatttaaacattcatcttcaaatcttgcctaccattgcatttatttgaaatcgacacttgtgttttagttcatttttaataatctgaaccaaggcttctgaatcatttatccatatggttacatagtctaggttatcaatgcctgtgcatatcatactgtaaagtgctttgaagatgtgttcatctctaggtgaagcttgttggctgatggatttattaaatgatttgtgacatagcatatcccttgttctacccccaaagtcttccattgagacagtatgcttcctccagaggaggagccggtagtctctggctatattctggaaacataggaaaagaggaatttcccttttttcttttgaggggcccttttcctggtgttgccttaaaatatttttgtcacgtcattttcctcagtagcagtgagcgttactgggtcagagtgttactatacactcagtaatttcacacatatttactcagttcatccttgatatgatttggctctgtgtccccacccaaatctcatctcaaattataatccccacaggttgagggaaggacctggtgaaaggtgattggatcatgggggcagtttccccgatgctgttctcatgatagtgagttctcatgagatctgatggttttatcagtggtggttttccttcttgctctctctcacctgccaccatgtaagacgtgtctgcttccccttccaccatgattataagtttcctgaggcctcctcagccatgtggaactgtaagtcaattaaacctctttcctttacaaattacccagtctctggcagttcttcatggctgtatgagaatgaactaatacaatcctcatgatgatattatgaaatagatactattattttctctatttaagagatgatgacaaactgtgagtcacaatttttaagtaactcagtaacacaactggtgtgatttgtgttactgcaaattactgtctgttttacagtaacattggtaattatgccattttcaccccgacacaatttcaaacacacccttccccaccaaaaactgaatccaattgagattcccagttgcagattctctgataattactcttgcaatcttttagggaggaacagaaggttacatggctgccttgagtggtgtagggggccccagccaatctccaagttttatcttctataccttacattctgccgcttttcatgatacattctgcctcttgattttgagcctttctggcattgagtggtgtagctcacctcgcacagatacctctccccacaagtactaaagtagtttttcaccatttccattttcacttctcatggacttcattatctttaaaaacttcattgaaatctctcacccaacagttgtactcatatttcgttgacgtttcagcctttatactttttaaaaatcagttcactcttactttggtgagttttcagaggcagaggaagcagaactataatcaactaatcaagcccctttgagccagcagttcttccaggtttgtgattcacagataccctggaagaattgatgaaggcttctatcatctcccctagaaatgtgaagacacaagatattctgtatgacattggggctgaggatagcttttgtggttgggaagaagtatgataatgtgtggagttttcccacatatatttaggaactttactcttttattaaaaaacaaattaaaagttgcatctgttaaattttctcttacaaaaacatttatggattcatcattaaacatacatgttttggaagcttagtatttatcacgtttgtatgataactcggtagtgagagcacagagggcagtcccagtgttcagagagtttatggcagatagtcgaaggagagaaatgaggaacaaggaagtataactgtgtgacaggagactatcatacaacttatgccctgggtgctactgaagcactgaggggagggacctagcatttggagtaagaaacagtcatcagggaaggtttcatcgaggaagtagggttcatatgttttgaaaatgttatctatttgaacactctgttatcaggtacagacatatttagaatttttctaacttgtagtgaattttaccttttttcattgtatactaaccttccttatctctcagagcgcctttttccttgtgttgtcttaaaatattttttgacacctcatttttctcagtatcagtgagttctctgtgcttcagagtgttattctatgctcaataatttcacgtgtatttactcagttcatcctcataataatactatgagatacaaaccattatttcctctattttagaggtaagaaaaaacatgatgcacaataacttaataacacaactggggcaataaataggatcaaattcagacaccagcaccttgaagcctgaacctctccacacagtaacactactgtatattacaaatgatctcaatacgtttatactatagcactaagattggtatatgattgtaaccatactaattttctttttcttaaaaaagttgtatttgccttagttacctttctcaattcttttactttcaaattttcttagttcctgtgtgttagacatgcttctcagaaatagtattttgctagatttaagaaaaaatcaatagttctgtcttttcagtatagtatttcttaatatatttctaccatcttattttgctttttctttttgattttcctttattccttcttctccccccccttttggttgatcaaatatttttaaaatatcgatttcccctacaattgctttgaaatgtatgtatgtcatatctagtattttagggattatccttattttttttcaaaaatacttattaaattccaacatagcttaagatcttgatctttctcctgaacataatcctaatcacagtatttgaaacttacttctaatcacaccctatcatgctatagtctactttttgtcctgagttttagttctcttttttaactttaatattagtcattatcacttttataattttagtttatgtagtcaatatagttttagattttaccacatttgcatatttcttctgttattatgtcatcttgtatttctctcttttctggacatagttccattctttgacacacatcctttagtttagatggcttttaatgggaatgtgttggtactaaggtgcttctatttttacatttttaatttaaaattttttcattttttgtttttctgaaaatatcttaattttaccatcttccctgtttatttagcttggtatacaagtctatgttgaaagtttagtttctctcagtactttgagtatattatcctactaaattctaccttttgttttcacttttcttaagaagcttcctgactgttttaaaattgttccttagggatactctctcttttctcccttgctacttttatgttccgtggtaatgtgctgttatagcatgctgtgtttagtgctagattacctttataaaaatgtttaattgggatgtattgtcctttctgaatctgaatttttaaatgttctggaaaattcttagatgttacgtattttaattgattctccatcattctcccttttctctcctctgaaattctattaatattgttccaaaagtaattacagtttttgtcattacttttaatggcaaaaaccactattacttttgcaccaacctaatacgttagaactcatttttatactgtatattgtagaatttatatttaatgtttctaagtttttttaaatttctgaatgacattgtcgatattcaatctacctttcagtttacaaactcactctgtagctttgtctcatctgcttaatgcaactaatgagaggtttttttctttaaaaaaatttaacttatattggtatataataggtctatatatttatgggctacataagaatgtctaataattatatcagggtaaatggggtatccatcacctaaagaattcatcgtatacacaacagagtactattcagccatataaaagaatgagatcttgtcatttgcaactacatagatagaactgaaggacattatgttaagtgaagtaaaccaggcacagaaagacaaactatgtgcgttctcactcatttgtgggagctaaaaattaaaataactgaactcctggagatagttgaatgatggttatcaaaggctgggaaggatagtgggtaaggtgggaaatggtgacagttaacggttacaaaaatacagttggatagaatgtgtaagatttaatgtttgatagtacaacaaggtaactaaagccaacaatattttattttacatttaaaaataactgaaagagtccagttagaatgttcataactaatgcgtttttaattccaataatatatttttaattcctggagtatccatttatttccttatcaacaatgactggtaatttttaagtattatttgatatggtttggctgtgttcccacccaaatctcatcttgaattgtagttcccataatccctacatgtcgtgggagggacccagtgagagataattgaatcatggcagcagttccccccatgctattctcacaatagtgagtgagttctcacgacatctgatggttataagggactttccctcacctttgctctgtacttcttgctgcctccatgtgaagaagggtgtgtttgcttccccttccgccatgattataagtttcctgaggcctccccagcactgcagaacagtgagtcaaacctctttcctttataaattaccagtcttgcctatgtctgtattagcagtatgagaacagcctattacagtatatcttattcttttcttgtatatttaattctcattttacttcaaataatttatgaatgttttatttctcaatccccaaatttagctgaaattgaattcatgggggccaaatattccatgcggtgtttctgctgaattctgttcattatacttgttttcttgagttttatatttttggattgtgagtttaaatttttcagggctttgtcattagtaatcctataattccagagtgaatccagagaggggttacactttatttcaaaagataccagcttggaaccattttttctattttaagttcttgatttgggggttatatccaatagtcagtgtaaattcaaaagctgtaatttaattcagcaagtttatggcttatgcattctcaagaatcatcattttttttggaaaaagataaaatacagacaaatttccttgtcatccctctttgctgactagttaatttttctccagtgtctgctttactgtgaatttagcatttttaggttttatgtggtggggctaggggcgtgagggagttcctattctttgcacaggtctattacttgatttctaattctgtttggccttgaaatccaaaattctgcattgtaaagattagtaaataccctctgactactatagcccaccatcagctaacaccctgaatttcagtgttctctttttttcttgatacccaaaagcttctcctattttactggatgctcagatatataacttaaaagatgtatgttacattttatttagcatttctaggtgtttgaaactggaaaattttcaggctcccatgttgcctcgtcctaggaaatgtaatccttagagattattgtttctgtttcctattatgtgatgtgacattacagaatgttaagtattttaaataaattatcttatatcagaaaatttatgttataaacttttggggtgcagttaatattttagaaatgttttcagatacaaaaagccatgttttaaaatatctcagaatagacattataatcttgaaaaaaaaaccctgatttttattgaagggttttgttatgaatgaaatttggaggtgctcttgtagcattctgcatttacattctagcatcacgcttcatcaataaacatgaagacatttgtataacatgtaaaaccatcttatttataccaagtgcagaaaattgaaaagcttctaaagattatatcaagaggaataataataatacaaacaataacaaacaccataacaacaaagaaaagaagaagcaggaggaagaatggcagtcacaggctcctattttaggccaagcacactcctaagcatcaaagccaaaaaaaaggcagaaaaatgttaaggtgacaaaggcaagagcccacgctacacaaagcatttcttggctcgccaatttcaaagcaactcctgagatagagcctcacaatctggctttgctattgatttgaagttaatatcaaattaacagaataccaaaatatatagtcatatatagaagcattccaaagctaaataaaactgtgtttgatttcctactagttgggattgtccctatcatcttaatgcagataattgtgagtctagtttatatccatattttacttttccatctgcaatgatactaatttttttaatagcagagccatcccccatatgaaagtatttggaaaatatatagactttcaaaatgacaatatagacgagactaagaaattattttctgggtttttttttgttttttaaatagagtgaaaaacgaatctctcaaatacaaaatatttttaaacgtgagaaacttgcacgctactccctcaaagctgtctaattcaagcaaacactaaatgacactggcagagctgattgagcagctgctgggtgtcagtcactgtactaggggcttttaatacagtgttttatttaacagtttacaaaaaccataggaattgggtattattaattcctgccttacaaatgaaaacactggcgttaagacaggatgagtgagttagtcagggtcacacaaatacatcttaaaccagttctggctattctgcagcccaagcttccaaccaccggcattgtatttttcagaatattgtataatttcatagtaattaagcaaatgtttacacttataagaaaaaatcagtaagacaatattattttatgttatgactgtatctgccgatgttttagatatactagcagtttgtggatataaggaattaaagttatctgatgtaaaaattatttattttatatttgcattttctctatttatcaatacacaactaggtcatgaaaaagactatgtaaaaaatatatgaaagtgtcaaattattcagtttgttcatccttttattgtggcccctaggcaacgatggctttttaaatcattttgtataatttgatttgcaaattgctaagtatcctagtttgtcaacatactagtctgcttctctaatttcttttcaattttacgttcttgtaaatctctttacgcttattaaaagatactcaaaaatatcactatcttttaatgttaaaccaactttagtataaacatattttatatataatgagtattatatgaaaataagatgggaaacccacaaatactattaaaaaacagttgctacaactaacacaatatagttattataaatatccatgtataaaaataacattctaaaccttaaatattatgaaatattctagctaaagtataatttaaaataatatggctactctaaatggtccaataaattataccaaattaattttcattaaatcaattaatctaataaacatcacttttaaaaataagtattttcttgtttatatatggcataataatttgtaaatcactacaaacatattttgcatttggaaaaccagatcattagagggaaaaaaaagatcctgggcattttcaaaattcctgagtttgttttattaaataaataaaaggctcttgaacaggagcataacaggatcagattaatatttttgatagagacacctcaaacttcaagccagaaacaaattggaagtggacagtagaaaatctgtggtagtctgggctcaggtgggaacgaagagaaagagggctattcaacaggtagaattaatatgatatgattgtgcattttgcagagtgaggatggaagtgccaggatcaactcttgattgattaatatgcacaaacttattgataaactgaagctaagactttttgagtgaccagtgatatagagacaatgacagaataccagcaatatcttgagttttgaacatgagtgcaatattaaaatggaggagtcaaactaaactttggatatattagtgttgagttcagaggagagagctgagacagagatatgattagagacatcctcccatagttggtagttgaagcaatggctttggataaggtctttattaaggagaatctgccaagaaaacagaagtagcctaggacaagctttaggaactctctcacttacagacgaggtaagagacaagaagtcagtacaggaggttgaaatgtgattgtcagaaaagtagaaggaaaacctcgaatgatgtagtacattgtcagccaaagaaagataaattatcaagaagagagtggcaccttctcaaactttttaatactgccagtttatctactcatatgaatgggcagtaacattgtttttaatcctattatattactctttctgtagtttatcttcctaatgagattatagcattcctgaggacaaaagcaatatagtttaggtgcttaataaatataaacaggattgaaattgccaacactatttttatcctagaaaaaaagtgatacttaatattacatcttcacttcctttaggtcttggtgtcagttctcttatcagaaaggtctctgaccggcagtttaatatctttcctctctcctggctctgtatccgccttactcaatacatttttcttcataaaaattaatgcattcattcaagtgatcattcacctaacaaatacagagcggtctataagtctggaaaccaatatatattatgttttaaagaagatatttttatcactattttcagacttaataaataccttgtatcttgatcttctctctgatatcatatggattgttttagataagtaaggtggtgatttttaaggtttgtgaattttgtgtcaacaaatatttttaaaaagatacatagtgctgcaataaacgtacatgtgcatatgtctttatagtaggaacagaaacccaaacaccacacgttctcactcataagtgggagttgaacaatgagaacacatggacacagggaggggaacaccacgcaccggggcctgtcggggtggggagcaaggggaggggagagcattaagacaaatacctaatacatgtggggcttaaaacctagatgatggattgattggtgcagcaaaccaccatggcacatgtgtacctatatagcaaacctgcatgttctgcacatgtatcccagaacttaaagtaaaaaaataaaaatcgtttatgaatcattgattcataaaatgaatatactagaaaaagaaaataccatattcagaagtgcatacacacaaacacagcccccccaacacacacatatgtaactaaataaaccaatgcagataattataaattgtgacaaattctgtaagaagaaattagtagttgaagatctaaaatgaaaaaaatttatagaaaaattttaaattgactggtctgggagggcctcttggaaggtgacatttgaactgacctgaatcatatggataactcagccatgaaaagtacaagtgagaaaaataggaagaaagggtttggttttcctgagatgcatagagaagagtatggctgaaacatggtgaccaaggatagacatcttaagtattcactctgaaaactagcaaagtagccacacaataacatggcagaactattgctaaatatgatagatttccttgaagagtaaagtatatattacagaaaaagtgaaactcatgtataattttcttacacatatttaatggtttaattcatattgttttaatttgtaaatttcagaagagggatgctctaagtgggtgaatgtatcctacgatttttagggttagggatctctctatgcctaaatctgcctaaaagagatgtgaatttaccttgcagtgagagtcaggagtcagaatattcagagtctttgaaagccacagaagtcaccctggtttgatcatatagaatacatatatgaggatcaagtgtaaaatgctactgacaggtctagtaagagaaagactgaaaatgttctttagtggcctgaaaattatcagacactatgaagagcaatctcatcaataatccatagaggttgaatgcataacaaggtggaataaatgtaatccaaattagagctcttggatgacagaatttttagcgttaagtgccatttcagttggaacataacattttatacaaatagtttttattttgaaacaatttaaaacttaccaaaaaaattgcaagaaggataaaaaggccactactgtacccttcacccagagacctccttcaacgtttgttacttgtttgaaaatgtccttgtattagtctcttttcacactgctgataaagacatattcatgactgagcaatttacaaaagaaagaggtttaatggacttacagttccacatggctggggaagtctcacaatcatggtggaaggaaaggaggagcaagtcacatcttacatggatggtggcaggaaaagagagagaacttgtgcagggaaactcccatttttaaaaccatcagatctcatgagacttattcactatcatgagaacagcacaggaaagacccatgcccaagattcaattacctcccaccagattccttccctgactcgtgggaagtgtgggagttacaattcaaagtgagagttgggtggggacacagccaaaccatatcattccttgtctggccccttccaaatctcatgacatcacatttcaaaaccaatcatgccttcccaacagtcccccaaagtcttaactcatttcagcattaactcaaaagtccatagtccaacgtctcatctgagacaaggcaagtcctttctgctcatgagcctgtaaaatcaaaagcaagttagttacttcctagacacaatgggcgtacaggcattgggttactagagctgttccaaataagagaaattgtcaaaataaaggggctaaagtccccatgcaagtccaaaatccagcaaggcagtcaaatcttaaagctccaaaatgtgtcctttgacttcatgtctcatatccaggtcatgcagatgcaagaggtgggcccccatggccttgggcagctctgcccctgtggctttgcaaggtatagcccccttcctggctgctttcaagagctggtgttgagtctgtggcctttccaggcacacagtgcaagctgtaggtggatctaccattctggagtctggaggatggtggccctcctctcacagctccactaggcagtgccccagtagagactctgtgtggggcctctgaccccacatttcccttctgcactgccctagcagaggctcttcatgagggtcccatctctgcagcaaacatctgcctgggcatccatgcatttccatacatcctctgaaatccaggtggaggttcccaaacctcaattattgacttatgtgcacccacaggctcaataccacatggaagctgccaagacttggggcttctgttctctaaagcagcagtccaagctgtatcttgcccccttttagtcacagctgaagggactgggacacagggcaccaagtctctagactgcacatagcagagggaccctgagcccgacccatgaaatgattttttcctccctaaacctccaggcctgtgatgggaggggctgccgcaaagttctgacatgccctggagacattttccccattgtcttgatgattaacatttggatccttgttacttatgcaaatttctgtagcaggcttgagtatctcctaagaaaatgggattttcttttctatcacattgtcaggttgtaaattttccaaacttttatgctccgtttccctttaaaagctgaatgcctttaacagcacgcattcacccctcaaatgcttttctgcttagaaattgcttctgccagataccctaaatcacctatctgaagttcgaagtttcacaaatctctagggcaggggcaaaatgccacccgtctctgctaaaacataacaagagtcacctttgctccagttcccagcaagttcctcatctccatctgagaccacctcagcctggatttcattgtccatatcattatcaacattttggtcaaagccattcaacaagtctctaaggagttccgaactttcccacattttcctatcttcttctgagccctccaaactgttccaacctctgccgtcaccagttccaatgttgcttccacattttcaggattcttttcagcagcacctcactctactggtaccagtttactgtattagtctattttcatgctgctgataaaaacatactcgagactgggcaatttaccaaagaaagaggtttaatggacttacagttccatgtggctaggtaagtctcacaatcatggtggaaggcaaggaggagcaagtcacatcttatgtggatggtggcaggcaaagagagagaacttgtgcagggaaactcccatttttaaaaccatcagatctcgtgagacgtattcaccatcacgggaatagcacaggaaagacccacccccatgactcaattacctcccactcggtttgtcccatgacacatggaaattgtgggagttacaattcaagatgagagttggatgggcacacagccaaaccatatcagtcctttacagcaaaaggacccactctgggatcacatgtcacaccctgtttttctgattctccagtctctaacaatcataattatatcttcactttagtaatttcttcactttcacaaccttctcattcttgaatattctatcccagtcatttgtcgcttgtcctgaaattggattagtttgatgttatacccagccttgtatttttgacaggtgtcttacacaccatgctttattcttctcattgaatctcatcaggtggccccccagtatcaattggtcctgttactcatggtgataacattgatcacttgattataaaggtatctgcctggtttctccaatgtaaagtgactgctctcccctttgaaattaataaacatatatatttttaaaattggggtacttggtgtatatatttatgaggtacataagaggttttgatacaagcattcaataatggggattggggtatccatctcaaacatttatcctgtgagttacaaacaatccaattacattgtttgttattttaaaatatacgattattattgactgtatttaccctattgtgctatcatatagtaggtctcgttcattagatgggggtggtttatgagttttttaaaaaactatatttttaaggagatagtttgaggctatgttctgcttccaactttcacccacttatttgagcacctattgatatgccttgcctgaattaattattaacatgatggtttccaaatggtgactttcttcttcctacattcctgttacatgtattacttagtgtagtgctattggaggagctttctattttccctgtgtatttattcacttttagacaggcagactcttggattcctactttattcagtaggatatgatctgtagcttcctctttttttctcctcccttttttattttgatattcaaaatctctttttgatactcaaattatttattttgtatgcaaattgcccttaatttgaggagcagatgccatttcaggctggctcctgtgtcattctgacatgaccccatcattctttgggcacttcattactttttggtgtggcaaaatgttccagattcttactgtactttccctaacacagcttagaatcagtcatttctccaaggagtcttggttttgcccagcatagaaaccaggatctgggaaacagaactattcattgctttgagagtgaccctgtacgtaggctgtcttcagtggatgataggaaccatctgtatattgaccaaatatacaatttcattcatacttatttctgtatctatctacatatagtgaaaaccacaaatttacactaattgattaaatcctaatgcaaacccactgggttcattctgtctttttttttcttttcttttttgagatggagtctcgccctgtaacccaggctggagtgcaatggcgcaatcttggctcactgcaacctccacctcccaagttcaagcgtttctcctgcctcagtctcccaagtagctgggattacaggtgcacaccaccacacttggctaagtttttgtatctttagtagagatggagtttcaccatgttggcgaagctggtctcaaactcctaacttcgtgatctgcccacctcagcatcccaaagtgctgagattacaggcgtgaacattctttcttatgtttcatatgtgtaccctctttctttgacgttgggaatttgactctcactatcctccatgtatttacttatttgcccaatcaacctgtactgtaaccaatctcccagccacatggggtggagatcctgtgtggacatcctctgtgcacaggtcctggacaccactagactctcttcccctggactactctatcttcctgcctgctgggaccctagtttttatgaggctgttttcctgcccctgctcaatgggtttttgactaagttattcaggaaggttgagtaaacagtagagattagtagacattttgttattcaggaaggttgagtaaacagtagagactagtagatattttgtgcaatctgccaagatcaaattgaaaggaagacagtaggtggttttaaacatccttaaagcattccaccagcctcccttggacctcccaaccttcccaactttaaaaaaggcagagagaagctttatatgcacttggttttaaacatgtcaatttttcaaccttgttgtccaccgtttgctttttctgtcccatcagatgaacattataacttacaacaatttaggttgccattttaatgtcaaaacaaatatcagcaagtttttcactgatgtatttctgaattaaaattttaaaaccttgaaaatgcttgtgttttctttgtcagcaagaatagcaatatactgagtggacttcaaatcaagtatgaagtttttatatgcaagtcttgaaacagaaatttcagacatgccagtgaagtaatataattacaatgttcctggaaagaagaaaggtttccagtgcatggaaagtaagatgcaattgagactgacaagattacaattcactgtgggtgttttaacacattgtcagattgtagaaaccagttacaatgacccatgtatagacattgtattttttattccaaattcatagaaattcaaagatataacaaaaatacgcaaaaattttaactttatatttttactaacttgacaattcgttacattcactttatttccattttatagctattcatttctgaccctcaaaatgccagctgcaaatttatattaccaaaaaatcccactgttaatctaagtaggttaaatcctgagctttggagtagtcactgaaggtatcacaaacactaatacactagtatttttactgaaatttcatttgttcataaagagaacaaacacagaaaataaataataggttctcctctgtttctaagggagttaaaacagcaggaggttcagtatcagagatccaacatctttagctcattgttgactaagggaactgtcaatattccaccagttacataatgtttcacaggtgtgagtaatcttcaggttctaattattaaaactgatttgagattataatagcaggatgtgtttgttatactttgtattagttatatattgctgcatagtgcattgcctcaaaactcagtggctcaatgtagtaataatttattatctcttacttttctgtaagaggccagtaatttaggagcagcttggctgggcagttctgacttgatatttcttataaggctgcagatacatgtttcctagagccacaatcagctgatgacttgactaggattagaggctccatttcaagatagcagactcacatggctagcaagctgctgctggaacttggtaataggctttagttctcctcctaggtgcctctccatcttactacttgagggtttccatggcttttaggctggcttccctggagtaagggatcaaaagaccaaggtgcagcctctaatgcctttatacttaaccttggaaatcatatcaccttgttactactgcaacattctgtgtcacacggagcagcactgattgtgtgggagggaactatacaggccgtaaatattaggaggtatttaaaataacataattataatgtgaagatttatggccatcttggagattgattgccggtgttcaccctacagcccacagagatacatatctttttccacacacgaagtacacccaacctcctctaaaagccatccaaagtctcattccactaggccatctgctcaaattccaggacctcattgtctaagtcaagtcaatccaaaatgaatctcagagagtccaagagaaaatgaagctgtttaggtatagtcactcaagtaccacttcccaagtacagttgtcaatcttaagacctgtaaacaagttttgtgccatcctcacaccacatatacaatggtagattatgcacagagaaaccaaattagactctctggttcaaaagtggagaaaataagagagacaagtcactggtccacagcagttttgcaatccagtcaggcacatgctggtcattcttgattagaactcagtcatgctgtttcccggacatgattctccatggctcttggctctgccctctgtgttagttctgccactgtaagtcatcctttttttatgtatatagaggttgtctatgtttacagctgcatagactcctgaccataaagtttggaagtcaaaggcctgtttctattttgtcccaactctgtccctttcagtacaagctggtggtgttacctccaatatagttatcttaaaaatgaatgggttttctatgaattttattcaggtttactccacttaataaaaggcacatccacaattatataaagataagctcccccttaccccttgagcttctgtagatctacagaaggaaaatgcttttaagataattagaatccctattgtttaactgaaaagacctgtaaagcataaaaataagctctttagagggtcttctgtctcatggagtgtctccctgaggaatacctaataattttcttgggtctttatgtagattttatagtcacgcttccttgtcatccttagatcatgttttcctggaatttgatctttgcttagaaatgtgatttcttaatgtttgcattgttcaccatctggagagattggaattgaaagagcattttactttaaaattcagtaatgcctggcttcttcatttgtaatagttcttctttagctttttctctcccattttctttttcttttactataaacagaagatgcccgatggctccttcaatactctacctggaaatgtccttagctagattatacaatttcatttaactgtatctttttcttttccatattatcacaagaaacaatgttgctaaactttccaccagaacatagcaaagatctaattttctctaatttctgatgacacttttctcaccttcctttaagtcattacagctcctcaagagccatcacgcttcttttaaggcctgtcccgctaacttgcatattcctgtccctaaattactgccacattttcaggtttctgttataattctctgccagtatcaaattctttttttttttggtactaaagtattttattctattttattttatttttaatttttatttccataggtttttgggggaacaggtggtatttggctacatgagtaagttctttcgtggtgatttatgagattttggtgcacccatcaccttagcggtatacactgaacccaatttgtcttttatccttcacccctctcccacctttcttccctgagtccgcaaagtccattgtatcatttttatgcctttgcattctcatagcttaactcccacttatgagtgagaacatacgatgtttggttttctattcctgagttacttcacttaggataatagtctctagtcccatctggattgctgtgaatgccattaattcatttaattttatgactgagtagtattccattgtgtatatgtataaaaaagccacatattcatggcagcacaattcacaattgcaaaaatgtggaaccagctcaaatgctcatcaatcaacgagtggataaactatggtatatatacaatggaatactactcagccataaaaagtagtgaattaatggcatttacagcaacctggatggcatgtccagacatcacattctttatttgatatctattgttgcattatgtgtcaccttaaaattaatttcaaacaatgatgaatattcattacctctcctgggccactccagaagacagtgtatgacatggtgatgacttgccacgaagtaagtgatctcagagaccaagttgcagagttttctattgttcacagaagtcaggcctaattgattatagaaggggacaacaaaagggtgtgaagtcaggagccaaagattaacgatgtccatcttggaatattatggagagaaaaaaattaatgaatatgtagtattttgtcctataattatcttctcctagaatatatctcctattggaaaataaaaggacttaaccacttcaaacttcaaaattaccaagatcaaacagaacattgttataagcgaatgatgaattcttgttttacaaccttaattatacccaatttgtagtaatcggtatttatgcagctgctgtgcttcagagcagcttttattttcacacatacatccattcattttgaaatctttcaaagctagtgtggatatggtgagactcccaattattcaaaaaaaaaaaaaaaacagaaacaaatgacagtcttcttaagagtggtcagtaagttacaactgggtgttttctctctgctaagtttagacattacactctattcaattttatcttgattaaacaattgaaaatcatgtgtgcacgcaactggtataaacagatcatttacctaatatcagcatttttctgaagggactaagtcaatgcgaatgaaaaaaatgtggttgactagaaaatacacatacacacacacacgagccatatattaacattaaagtagagccttacatggattttttttaagtcaagaagttaattcaaatacaatcttatttttatacagtactgtgttaataggaaataatatatacctttgtgattaatccttataggagattcaaatgacagttattggactttaaatattgtaatccattaatgaagagaaaaagaagatttctgctctactaaaatactatccttggtcaaaaagaataggatattttgaaaatgtcacttaataactggtatggtttggctgtgtctccacccaaatctcatcttgaattgtagttcccataatccctgtatgtcatgggagagacccactgggaggtaattctatcatttcataatagtgagtgagttctcatgagatctgatggttttataagagtctttttccccactttgcctgacacttctccttgctgctgccctgtgaagaaggatgtgcttgctttcctttctaccctgattataagtttcctgagccctccccagatattctcaactgtgagtcaattaaacctcttttctttataaattacccagtcttggcatgtcttttttaacaacatgagaacagactaatataatggccattttttgtttttattgaaaattcacttttatccatttaatggaactttggttccatcccattttatataaattgtttgttgttacagatataatattagatgaagtgaatgtgtcaataacttcagatttgcaagcagacaaattagtacagtttaaatttgcccagtaggcagatttggtatggtgaaccatatgaaaagtagaagctctggggactttctggagatacttaatgggattgaaaaatatcattttcttatggcctacaaattttccatccataatgggtgtttctatccaattatgcatgtttctcttaaaaagatataatagtaattgattggtggtgatctcttaaagttatttagcaataaactcttaatgtctgatttcaaggttggtgtgggcattctatttcctaatagaatcaacagtattgtgtgtgtgtgtgtgtgtgtgtgtgtgtgtgtgtgtgtgtttactcttgttatttactcttttaattttagttctatctgttattatttactagtatatataccatattatggtattttatatataccatattatggtattttatttataccatattagatagtttgtagaagatgtatattcaaagtagggtggctgacccttatgcctaaatttatttgcttctaatgttcccttagattttataaattaaaaaaaggcatctataatgcaaatatctctttgtaatgagttacacactaatctactttatttcataatagtaagtttggcttatttgacatctgaataacaggcaatagggaattaagaaaatagaaataaatatcaaagaaacaagaagaagaaagttggatagttgggaaagttctaaagttttgtgtcctaatctctgagggctggctcagcagagaaagaataacagtgagtctttgacagcagagggacagaaagatgtgacagtgagaaagatgatgtcaaaagagaaaatttgagtgacagtagaccccagaggcaaacatttacctggtaacccattacaattcaaccctgacttcttcctctgtaataatctcactttctcaaaaaacttcctttttctacactgaatataacatcagcaaggattaaagaaacagtagttggatgtgatggctgtggccaggtagaatacccacaagaattttagtgaaggttatactgtacaccagatttacattcccatttcttctgtttcacaggttttctgaaccagatgaataactcaagtcactctgtccttcagccttcattccaaggatgcatgcagctcattcaagtggacgatcaacttgtaaatttatacgaagtggcacaaaggaagccgggaagtttcgcgaatgtcagcattgacatgtgtgcgatcatagacaggtaaatgatcttttcatcctacctcacgttgtccaaactttccaaacctgtgtttctgttgtgagaccagtgaaacatcccaaaagaaaattaaagttaaaaacaggtaaggtggaaattaccattcaaagtacgtattgtagtatacttgtgatattagcagtgattatgtttatgtttttatgtggatatatatatcatatatctatcatgtatatcatatatagcatatatatgctatatatgagatatatcctatatgtgctatatgagatatatcatatataacatatatacatatatatgtagcatatatatgtatatatagcatatatgagatatattgtatatatagcatatatatgataaatatatatgagatatatcatatatatatatagcatatatatatatatatgtgataaaacacactgtggtgttatatttgttcaacagtctccaatcagagaatctgagccttcaataagtagttttgcaagcaacagcagtgtggcagagaaactctgacagttgatttttagtttacagcagaaatgtgccttctctttctgtctcaatcatgacttggcctcagcatgtgccttccaaaacccgcttctgaaagaaaaggaatattacaaaagtgtcagtgtgcaagatgggtatttatgaagcagaatatttagagtaactggttcagcttacaaaatacacctattaaaatatgacaaaaatcaaatctttattggttttgcaaacctggggagaaatttttaataaaaactttaattgtattctcacacagtgggaagatgcaacttttctgtgaaatattatgattatactgcatacactaccttaatatacttctagatagggcctgtcattccactatgaacaagtttcattttgagatgctttgtctgtaaacaaattatatatgatttgaagttaacctagtgaatttatatgattttctaagatatattgaagtcttttgaggaagaactgtcttatcctaaaagctcattttattaattttgtgtttagggaagatgaaagttctttaaatttttttaaaattttgaactaagatattaatcctatctcagtctacccacaacaaaatgtagaccataagtctttaacaaatgtattttattcaagaggaaatactttaagaagtcactcaaaaatgaattttacaaacatataaaataatctattttgaagtaagtttgctttcataaaatctgaataagatggcgttcgtgtgaatggtaagttacagtttgtggtggctgtaagatagaacttctataaagccttcacatgtttataagaagactttatgacatagtatactgcttatttctattcatgtatgcaagtactgatcttagtagcctaaacagtttatatttaaatagaatagtgaacaattttaatggaaatatactcctaattattgagccattaataatgtatcagctattatttctgcctagagcaagtagcagcaataatcagaaaagctgagatgaatgttttaaagatcatttgttctgattttagataattatctacatattgttttgtacagaaaaaaatattttcttcataatagttatggagttttttagtatctactctttttttcaggtcagtaattgtgatgatacaataatttcattacctctttcagcttggtaaaagggctaggtaatatgttgctgtttctctctaaacatcgtgtttctaggcattatatataaattgtttgctactaaagaaagaggggtgatatgttgagatattaatgttttactctgatagagacaggagttaaattggtcccaaaagaatgaatgggattttggtaaattaataaaatggaaggtgatactcctggtggggagaccaacacaagggaaggtatagaaaagaaaatacaagtttcaatttttcacagatacagagatacacaaaatttttttttttttttgccaaaataggtcaggcccaatattcatcttgccaagtttcctgcagctaaaagaacaaagttcacacctttcttattctttaggatgacaaatgaaaagattagctgcagggaagtagccacctgtgacacatctccacgcattttctaaacccattatgggacctatttttagcttacactttttttttaaggcaacaacatctgtacattaaataccaatgtgtgaaacagcagattcctttagtcacctaaaatgttcccagttcaaaatcttaagcatgaagtgttgtactttcataggtatgagacaggactattttacttaaaccactgaagagtgtattgatgatatcacccttaatctgtgtctttccaggtaaaagtaccagtggttttagtctgtcctcatagagcagtgatgtatccagataatcctttaatgatacacccctagcacatctctgcttctttctcctcgctgagactttgcaactgccccgtatctacaactttcttttcagattacccaaattctcccaaaggaagcctacagtggcttttcttttctccttcccagttccagcttgatcgatttgagagttatttttgagagggagaaaaaaaaaagtataaatgagaacatagggtaaaaaaaataaaagagctacacaagcctgacttttatagaatgtttggagataatagtcacagctgcaatgatttgatgagtagaacttagggaaacaatttgtctgaaggtgtttttctgtgtgttgtattggaataccctacgatttgaactttttttttttttttttttgctttgtgtgtagatttgcatgtggcttattttgttcacgtgcttattttctgaacgcagctttgaatcaaggaaaaagcaagcttgccaagctacagaattatgcattcagtatttattttctgagtgcatactagatgtcatgctattctaggcacttggaataaatccttgaacaggacagataaagattattgaaaattctaagctgacatggtagagggaggggaggaaggagagatgacaaactctaattaaaaagtaaataatctagcaagtgagaaggaataaattttatgggtaaaaatactagaacaaaacaaggaagcctggcatgtcagtagatcaaggtgttgagttgtagtttaaataggttgaccaggataagcctccgttgaaaagataatattactgcaagacttgaaagaggtaactgaatgtactaatgcagggaaagaacatttgacccagagagcacaggcaacgaaagaggcacttgcatgatccaggatcagtatggaagccatggtggcaagtttcgggaggtcaagaatagttgaaggaatagacgccagaacaagccctccagacttgtaggttattgtcagggtgtggcttttactttgaatgaatacaggagccatttgcagcgttctaaatagagcaacatgatgtactcacgtcttaaaaggatgaatctgggctgtgggagcaagaaaggtagaagcaggaggctaactaaaattatgccattataatccaggtgagagacgcgtgtaccctagaccagggtgctagcacaagaagtagtgagatgtggccaattctgaatatattttggaggcagagtcagtagggtttctttacaaattagatgtggggtatgagagaaatggaggaaatagggataaatccaaatgatttgctaagaacagcaggaagaaaggagatgccatctcttcagactgggaagactagttgtagagaaaattagtcaaaggggctaaagaaaaagtcagaaattcaaggttggacatgaattgaaatgtctactggacgtctaagtagaaatgtcaggaagagagttggatatatgtatgtaacaagcctgtgtctgcaggtttacacaataaacctttgtgattgacagaatcccttttgtttaactcttgagggtctttggtgtctttagttacattttataagcaatcatagaactggaaggggaggtggtggataatgggcagaaattgctctctaacaatggaagctgctagcttgattcccttagtgataatctgctcttagagaggaggattgtcatcaaccttcagtttccaaaacattctctgagaaaggtaaaatacccagagataacatttttgtttcttcttgcattgttactctcttttactcatttctagaacccttgcattattgactgcttgtggcaaacatcttaagatgcctgactcaactcttattctcaatctttttctctccagcctctttccaggtgtgaaaacctgagagcccaaaccttcagaaacactcctttagccacagttaggtccactcacttcttccttcaagagagaatcacaaggagaaccatagggcatctcaaagttggggagagggggtgcttggggagggacggacattgagggagagtcagggagggtattaggggatggagtgagtcagtccttgttggtattggctagaattcctaaactcggagactcgctacaacagatctgatagttggcctcagaacttgtgaattgttgtagaattattgtttgacctgtttttctgtggttgtagccaggacacatggttaggaagaagctgatgttaacatattttgagcttaattaagtggtgatcatgcttggtttgacaatttttttttctgttttgtgagtaatagtgaagtccattttgcaactgtggtttctgtttcagtcctaagagcactcttcacagctcagctgccagaggaatgttttttactttatgctaggcagaagcagagatgagacacagttctggctgctaagagctaagcagaagttagctgtggtgttcttgggaaagcttttgttctcctgatacagttgcccctcttgctctccaccatccttggtaaaatgtagaactgatgtctagagctgtagggtcaagaaaaccatagatcgagcagccactgatactaacttgtatgtgaaaaatatcaactatcacttatctaagtaattatgaattaagttttatttttcttggagccaaaagcacctgccctttccctagtccccacttctaaaattaaccagtaccatcattttaccagaatacagaagaacaaattcctaaatatggaaatgactttgaaagaaaagataatactttttggagtgtattaagttgcattttagtgatgtcccctagaggttgaaatctggggactaaatagctgtttagaggccaaagcaaattcatattgttagagccagcactagtaaaaagtgactcattagaattagaatctcctctgctctttcctgtctaactccattgaaaatatattaaaaaatacatttagaaacaaaatcagtaaacatcccagataacacagagagcggaaaaggaaatgcaaattgcccaacttaaacatagcctacaaaattaccacttgagaaattatgaatagactagatcctattccagagttagtaattaagtcttcattatatttttggatgaagtacataatcacagacccagtttttttttaattcaatgctttattttcaagaatatccagtttgatttttttctttcaaagaaaagaataagtaaatgaattttcataagaacatttaaatgaggattaggtagatacatgaaaaatatctcaaaactaaattgactctgttggaaaggcgaatgaaagcagtcaagaaggatgatatggtttggctctgtatccccacccaaatctcaagttgatttgtaatcaccatgtatcagggaaggggactggtgggaggtgattggatcatgggggtggatttcccccttaccgttctcatgatagtgagtgagttctcatgagatctgatagtttaaaagtatggcactttccccttcactcactctctctcctgctgccatgtaagatgtgccttgcttcccctttgccttctgccatgattataagtttcctgaagcctctccagctgtgtgggactgtgagtcaattaaaactcttttctttataaattatccagtctcaagcagttcgttatagcaacgtgaaaatggactaaaacaaaagaggtcatgagtttctacaaaagcaggcttaaattttgcgttcataacttagatgaagaaaacatgtaacatttatcattttctaaaatttgtcttcattcgctaattccctatttctagtcagtagcagaaaagataaatacttgaacacatacattttggtactgtaatcactcctcctttccgtgtatattcggtcaacatgggagttgatctcagtcaaaggtaaacttccttttgtggttgtactaccatttcaagagttctagatgccctagcatggcttgggtcagagtcagcttatgcaatacgttatcaccacaggggtgggatctgtcccacctgctccaccaaggttccctctgagctccctgagagtccccagcctggtcggccttcagggtcccacttctgtccctgccacccactgtcatgacaactgctccttctggccttcagatatgtcatgggtattgctggacttaggttctgggatctgtgtttaaggtgacagctattcccagcatgtctgagtcccatttggttttagcattgagagtcctgcttctggagaaacccctcagttctgggtaaattaggatggttggtgactatacacactaggtcttctttctcctaataccttcgtctgatctaccagccatctaagcattttataggccctatagggacacacagtgatttctatatcttttggagactacataaagctgaaataaatcatggcatatgtgttgttggggagaggttaggcattagggacagcttccttaggctacgccccctttacttcagcatgccatccctccctatctgctctacacagccactcaggctgacatgaggccctctacacattagaccctcaaaggccatcataggattcctaagtctctgctgtataaaccaaatataaaattctaagccatcatactgactgatgaaccctccccttagccaaagacattccaaataatcctgaaaaaaaaaaaaaaaaaaactagtttaggtcagacatgcctcacaaacatcaacacagagaccttaagactgatagaatagtctctttaagtctgataagaaacatctacaatccattctctctgaagactgctacctggaggcttcatctggatgatcaaagttgggtccccatgactgcttatcctaacccagacattcctttctattaattccatgtctttaaataataactctttcaaccaattgccaatcggaaaatatttaaatctacctatcacctgggagcccctgctttgagttgtcccacctttccagatggaaccaacatacatcttacatatattgactgttgtctcatgtctccctaaaatgtataaaaccaagtcacaccccaaccaccttggccacatgtcctcagatcttcctgaggatgtgtcatgggaatgtccttaacctcagcaaaataaactaaattgattgagacttctctcagattcttttttggcttagggttgagatttattcagtcaacaaatacttcttgaagatcacaccaaccagcagacagtacctcctgggactgaatgctgaggtgacgaagggagggtgattgatcagactctacactgttttaatggttgtttggcttttatgtcttaacacttacaatgcctctgttttgctctcaaaaatatagctttttccaatcaaaagctacttggttttagactacttttccaaaattaaatccacatgtttcttaattttctgtttcagtccagactctagaggtgaattatcccagaacctactttatatgataattgtataaccattgatccactggtaagacagccatagagtaagaaaaaaaaaattttattagtgtttctttagtgatggtttttatgacagatttcctttctctttcacctgaatcttgctgactccaaactgctaccctctaggtcggacacctccttttttcatacatttccaggttgaccatctccttctctttttttctttagaaatgttaatgtcatcatttaagctggcgtcaaactgtgcaggcatttctcttactttgggaaatattttgtcttttaccattaggtgcttatttcattacgcatactgtaggcttctggaaataccttactttcattcatgataattattgataagaggtaaagggggcagaaagtctcccagataaattcacgttattcaaaactctacatttgctcaatcctgacatcgttgtgactgtgatcccatcaaactacaaataatcaaagaacaggttggctgaagctaattctgaaagaacttgagccaacaagcaatttttcataagtgaaactggatttccttttagagactgtgcttcggacaaaagctcttgcgtcctaaaacctaatccccaacttaaacatatagaaaaacgtcagttttctcatggggtcatcctattgtgattctttcaggtagatacgttcatcttgtcccttcaccttaactcggtttatttcccatattggattccactgatttttatgttgcaaatcgctatgctctatcttagtttctgataaatgaaactactggcaatttctgagaagtcccatttcatcatgctaaatctgacttattcataatattagatgtgtgactctttatttaaactttattggccttccatgctaactccagtctttcatttgatctttagcttcctttggtttcttttagaagggaggagcttcctgtttatacataaacatttaagccatgggcatctttctagcacaaaaacatcagctcaatgacctaaaagtatcacatacccaggcgaacccatgttcaagtcagttgcctctctgaagtgatttcaaagtgattttattttaagtacaaatagaatactagagtgacaaaaacatattcttttttaaaaaaaggtagtgaaatgccagaggagataactctcctaagaaataaaggaaaagaaaaaagttgaattagccattttaagattcaacagcagctgtattcttctttgatgcattgcatgtattaggacaaaagaaaactatatttgcttttggcatggcatatagctgtgctttgacatttaaatcccaaggaaggcttagtgcattaaagtaatgtcagaaaaacagttatatgtttgaagataagcagaaaggaaatagataaatagttttaacatgtagctaaatcaactacggagagatttaaataagccaatcgattttatttcttgcttttgatatcatattacctgcaaaataaaaataagagcaattgattttaaaacatttaaaatatctttcttaacaagtgctttcttcttaaaataattgtttttgtcaattacttgaatacattgcagttacgatttcacactaagaattcatttaactgctctcccctaaaccaagattacagactcatggacatgtaccattctttttgtaaaatattgggactgatacaacttaatgaaggggaagttggagcttgtaggacactatccttcatttgctatatgctccctaacatgctgtgtgggagtcagttgttcattcctgaaaatgcatatgcaagtcatacttgttactgtaataacatggtttaattaagtactaagtacattttcaaatgagcagagacagaaaaaagtttctggtaaaatcaaatgtaaaagttttagaaagacaagtggctcaaaacaaacacaaaaccataagtttatgtgtgggcctagacaactgtaaacatttgcagagattcataaagcccaaggtgaactcactgaaattcattggcgattttagttttcgctgcacttgaaaccaaaactgaaaaatgaaggtgatactatatggaaatggtttgataaaaaggccggtggattgaactacagacttcaaataagtcttcaaaaaagtctttgggtgaactcacacccaaaggccccagagtaattccctctaacaacgagtcattgaggtgacataatgtaggttttcagttaaattaaaatggttaaggtgtgtatctttttaatgacatttctttactggatttcattaaacccaacatattgaagacttgtatcattccccaatctgaataaaaggagagttcattatttctttttgctttctctttttgaggagtctttgcattccaaatacagagaaaaaagaaaaggaaaggagaggagaggaggggaggaaggacaatctgttacatcacattgttatctggtttattagtataagactcttttactttcattaaatgtcaggagtaaaaatttacaatggtatttattatagcatttgaaaataacattttgtttgaatttttttctttggtatttaaatgatctataagctgaaaagaagaggagtcatagatttttctatgccaagaaaaaaacagttttaaaaagatgaagttgtcattttcattttgtttgattaaaaacacatatttccatttcctctttgtattgttgtatctatactgcccaaaaactagttttaagagggcaacaagcttagtttttcagatagcattgtctaaaattctcatggcacccattgctatattagagataagtactttgttgtctttgcctatgaattcattgaggaatattagagtctgaatcttgttttgtttaccaaatcctgcttacatcaaaaagaatgttacatgagtaagaaaggaatgcagatggaaggggtgaggagtatgtgtgtgtttatttgaaatggttttgaaaaatgagtctgtaataaattttaacaaattacggtatctgaaaagggtgtcttaatcagtaaacaggttgatttaaatagaccattatctacaattgtgatcagggtaaaaccactaagtaccatacaacatttgtgtatagcattaactttgtttgccttcaacgagtcgcagctgttatacttttactgtgatagtttcatgatttttgcttctttggcatagtcccagacaggcttcatcaacaagaaacttatcttcatgaacacacttcagtgaagacccccccctctgggaaattagacatgacataaaagtgcattgcttttttaaaacacttcaggcatttgaaaattacaagagaaattttcaagtggcacttcctaagttagaaataccatacacataaggccgggtgcagtggctcacgcctgtgatcccagcactttgggaggccgaggcgggcagatcacgaggtcaggagatcgagaccatcctggctaacatggtgaaaccccgtctctcctaaaaatacaaaaaattagccgggcgtggtggcgggcgcctgtagtcccagctactcgggaggctgaggcagaagaatggcgtgaacccgggaggtggaggttgcagtgagccgagatcatgccactgcactccagcctgggcaacagagcgagactccctctcaaaaaaaaaaaaaaaaaaaaaaaaaaaaaaaaaaaaagaaataccatacacatgaaggcaagtttctctcacatagttattataggacacttgttaatctcctatgaaggtcaaggccactggtactaaactacacaatgagaaaaccaaaagttacaggataggatctcttctcccagaacaggtactgatgtagcctagagacagtaaacattcacaagaaatgttaaaactatgttaagaagcatgtaagcatttgcttcttaattgttacagataatgatttctatagaaaattaataagaggaataaaaccactatcagctgcgtggttaatgaaaaccgcataaaagaagtaggttgaacttcagaggagcattagcctcggatgatgagaaagaaaggcaggaacatgccaggcaaaatcagaggcatgagcagaagtgtggaggcacagataaccatgtcccatttctgaaacagtcaagagatcatttaaactacagcaacatgtttgtataggagagtcatggaaaagttgaaaagatctatttttcatttattcatttatccattcattctacaatgtttcattgattgcataccatgtgtccaaggacagttttagccttgaagaataatttgtaaacttatggattctactttcttactgatttatgaaagagttagacatcagaaaaagcacacacacacacataccccatggaattgttggaaaaaaacacacaaacgccaaaatcaaagtatgcacaagggatcttgtgcctaattctccctgggatctaggttgggatggagatggcagaggagcagttcaaggcacatgctataggcattccagggagctggaaagtacatgggtgtgaatgacttgagtacgtgcagtaaactcaaggatttacagtaggttctttcacagactggcagctactagtgagggaagatttgaagctaggaatttagggggatcctaatgaaagaggaccttgcggccgggtgtggtggctcacgcctctaatcccggcactttgggaggctgacgcgggcggatcacgaggtcaggagatcgagaccatcctggctaacacggtgaaaccctgtctctaaaaaatataaaaaattagccaggcgtggtggcgggcgcctgtagtcccagctactcgggaggctgaggcaggagaatggtgtgaacccgggaggcggagcttgcagtgagcgaagattgtgccactgcactccagcctgggcgacagagcgagactccatctcaataataataaaaaaaagaggacgttgcattactagaaagactgtaatttatcctttgagcaatacgcagccattgagggattttcaggaaaatcaagttttgcatgactaacacttgttctgattacctgggcagaggtgatgagaaatgaattactgcagtagaaccaggtgaaaaaggaaatatccaaggtatttaggagttggactgaggagagagggctcattagatgtggaaaccggaaaaggtattggctagaaagagaaactggtttcagagtaagaaaaggctttaatgaaagattgttatattcactagtctccccaaacaatgtcttaactgactatttgtttagtagtgggtctaccggttagggtaagattttactgggatctggaagatggtgaaaaccagtagcagcaattgagcaatagagagtggtaaaagagaaaattaaaatagaggcagaattgagatagaagtgcaggtacacttagaacgatctgatctttgacaaagctgacaaatataagcaatggaaaaaggaatccctattcaataaatggtgctgggataactggctagccatatgcagaaaattaaaactggaccccttccttacacaatatacaaaaattaactcaagatagattaaagaattaaatgtaaaacccaaaactataaacactttgcaatacaacatatgcagtaccattcaggacataggcatgggcaaaggtttcatgacgaagacacaaaagcaattgcaacacaagcaaaatttgacaaacatgatgaaattaaactaaggatcctctgcacagcaaaagaaactatcatcagagtgaacagacaagctacagaatgggagaaaatttttgcaaactatgcatctgacaaaagtctaatatccagcatctaataggaactgaaacaaatttacaagaagaaacacaatcccactaaaaagtgggcaaaggacgtgaacagacacttttcacaagaagacatacttgagatgaaccatcatgaaaaaaaaaaaaacctcaacatcactgatcattagagaaatgcaaatcaaaaccacaataagataccatctcaggctagtcaaaatggctattattaaaacgtcagaaaataacaaatactggcaatgctttgggaaaaaaaggaatgcttatacactaccggtggaaatgtaaattagttcaaccattgtggaatacaatgtggtaattcctcaaagatctaaagacagaaataccgtttgattcagccatcccattactgggtatgtaaccaaagaatataaatcattctattagaaagacaatccatgcagacattcattgcagccctattcacaatagcaaagacatggaatcaacctaaatgcccatcagtgataaaatgtggtacatatacaccatggaatactatgcagccataacaaataataagattatatctcttgtgggaacatgaatggagctggaggccattatccttagcaaactaacacaggaacagaaaaccaaatgtcacatgttctcacttataagtgggagctaactaatgagaacacatggacacatagaggggaaaaccacacactggggcctgtcagagagtgaaggatgggaggagggagaggatcaggaaaaataactaatgggtactaggctcattacctaggtgatgaaataatctgtacaacaaacacccatgacactagtttacctgtgtaacaaacctgcacatgagcacctgaacttaaagttaaaacaaaacaaaaacaaccacaaagaaatgcaggtagtgagatactggattaaaaaggaaagcagaagatgtgcagagctatactctctaatactgcagccactagccatatgtggctatttcacacttaaaaagcagctgttctaactgagacgtgatgttagtgtaaaatgcacaacagattgtgaatacttcatacacacacaggaatataagacagctcattgatcatttttgtattcattttattttgtgttaaataaaatattaatattattgtcacctccataagattttaagctacatatggcatgtggctcacaagttattaatattagtgctgttctggaatctttctctaggtagttccagctggatgctgtattgcaagaatgagtgccctagcttctttgttggtcttgtccacagatgagtaaagagatcctcgcaacttctgataggactcaacaagttgtcctttataactgttttatctcagagacaatgcagatccccagaatgtctgtgaaactggcatcattctgaaatcacagtcccttttcattagttagaagttttcttaagcctaagtgtatttgcaataccatctccagagaatatctttacagacttagaagccagatgtgttggttttctcccagaatattaattccctgttcattaaaaataaaataagaagtattcaatgggaaaaaaaatgtggcctaaattaagatggtattttaattgagcacaagttagaactttcctggctcaaagattaattttttctagtaaagtatctgtcagttacacaactgtgtataattcatcatccttgaagtgaaagtttgggtctcagtaagaaagtgctttcagctgttaggaacagagacccaatcagttttccaggcaaatctgaagtttatttctgcacatgtaagatgtctgaaatagacaattcaggctttgtataatatatctagaaagcgatccgagacccagactcaaacattctgctccagtttccttagctcatggtttctattttcccagtgattaagattgctgctagaactccagaaatttcatctgattttcataaagaaagtaggagggtccaccttccgttttaaaaagccattccagaagttccgtgcaacattttcaatcatatctcattagccagatttaatcacaaccacagagttgcaagatagactgagaattacagtttcattctaggtggtaatatgcctgctaaaactttgaggattatcactaggaaggaagaggaaaatctgtaatgagatagatagcactctctgcccagttgatgtttcgaaagattataaaatataaatagtaaaaaagtgcatgcttccagaaaaaaatatttgatgcagcatttatcttattcaaaccatatattttatatttttcctccaaaaatttaaaatatagttatcaaacttcaggcttagacaatcgacattttagggtattcaagagtgaagatgatccagcctcccttcaaggatttcataagagagtggcagaggtatctagttcttattctgacctcctactcgaaattcatcagtaacttcttattgcccttaagaaaaagacccagatccttaaaagcagtgtattagcctcttgtggtctggcctttgtcttcctttgcagcttcatctcacatcactctcctccatcccctctagccacgctggcctgtgctcagtgcctcagatgttctttcagtggggcccctgcctgtactgatctctgggtctagaattgcttcaccccaccacccatctctgtctctgtctcttgctttcttatccttcatatctcaattcatagataaactccattaggggagccatctcaggatctgtaagactgggttaggcactttttaacctgtttataatcacacattcaagactgtaattacatcttttcttcttctagactttgagcttcccaagaatgggaaacaggcctgagctcatgccccactgtgtctctgtgcctaacacagtgcttgatacgcaatatgttctaaatacattttttatagaatgaatggaaaaatataatagtagcataaaaaaggactatgaaattataaagaaggaaaagaacaattctaaatggagggatttagcaatgctttatgagtgaaatagaattaaaactggtccttccaggacagaaaggctcatatcagataatatagggcaaggctgtcttggaaaaatggactatataaactaaggcatgtgacacagctgaaataagaagttgcccaaaattctcagaatgcctgagaaaacattctaagaatttatgctttagtctgtagtccaaggaattcataaacttttggaatgtgcatacatgtttgtggttaagtgtacacattccagagacactgtcatcacattttgcctgttagaatggaaactcgtgtcaactcattcattcttaaaactctcctaccagtgtcttcccacctatcctcttcgagtcaatggtcagaaaattctagaagtgcatacatcggaaaagagtttactggaaatagttttaaaataatggcttagagtcaaggaatgctctacacccttctactttgccagtgaattgagtaagaaaacagctggtttctatcgaaaaatttactgtagagtgttttcttcatggagaaactagattttggatgtcacgagggaatggaagcgttggagaaaagtattcaaggtaaaacagtagcttgttccaacacaacaggctttcccctaagacaacactctctaaagaagtcctggaaaggaaaatgagaatgtggtagggcggttgatacagatcagtaaggaaatgaaagtccaaaagttatttacatggtaaacatctgtgccaagaggagtactctcaataacagggattagtgagagagcagttggctggagatggaagctcaggcaggtgagcgtggggtgcagagaaaaaaaaatgtatgaagaataaatcaatatttttttgagaatgagtattttagttcagtacttctcaatattttaggtgcatacagatcatctgggatcttgtcaaaacaggtttggctcagtgtgattgaagagaacactgggattctgcttttctaacaagcttcaaaatgctgttgctgcagctgcttgtgggccacatcttgaacacagcagagctccagcctctgcatctgggcccccagatacatgaaaaatgcagctcaggtagtgacaaaaaagatcagtgatgtgggcctttggtgtgttatggtttataaaacagaaaagcctattttcttttcccttaccatttccagggaaaataaagtaatggggatgatgtagaaatcacctgaaatagtctggcacagtgcttgcaaggctgtaggaaccaactgaagtttgctcaaagctttatgtacttctgtttctcacttgtatcacctgttatctttggagtgtcatgttttacgttacatattagcaatggaaacagaaaatggtttttcaatcactcactgtgtctatgcatagaaaggctgggcgcagtggctcacacctgtaatcccagcactttgggaggccaaggcaggccgatcgcttgcgatcaggagttcgagaccagcttggccaacatgctgaaacccgtgtctgctaaaaatataaagattagctgggctctgtggcaggtgactgtgatcccagctactcaggaggctgaggcaggagaattgcttgtacctgggaggcaggggctgcaatgagctgagactgtggtattgcactccagtctgggcaacagagcaagagtctgtctcaaaaacattaaaaaaaaaaaaaaaaaaaggatgccaacaatataatataacaaaatatctaaatgtgtagttgtttgatacttattgactgacttattttttgattcactatcagcagctttttcttaatttggctctttcattgcaaggaactgtaagtcagagttcttagttatgaataaacaaactaaaaagacagatgcaataaaattcaaatgaatttaagaaatggattctcccaggtgcggtggctcacgcctgtaatcccagcactttgggaggccaaggtgggcggatcacgaggtcaggagatcgagactatcctggctaacaaggtgaaaccccgtctctactaaaaatacaaaaaattagctgggcgaggtggtgggcgcctgtagtcccagctacgcgggaggctgaggcaggagaatggcgtgaaccttggggggtggagcctgcagtgagccgagatcgcgccactgcactccagcctgggtgaaagagagagactccttctcaaaaaaaaaaaaaaaaaaaaaagaaaagaaaaaaaagaaatggattctctatctgagaactgatagaaaacagaacccaaagagggcaagacaaagtcaaggctctatcacctgtcaccagaacacaatgttctagactcccctcagccatacagaataatccctaaagccctacacctttgtatacctccctcaaaatgtggtttcaggtgggagcatacaattgcttatgctgacacctctttcagagctctcacccttattctcccaccttggtctgtcttattaaagggtgctgccctgccttccacttaatttgaaatttctttctaatagacatgtcttctacagagatcagttcaagctagtccaattgataaggttaggctttgtgtccctacccaaatctcatcttgaattgtcatccccataatccccacgtgtcaagggagagaccaggtggaggtaattgaatcatgggcatggtttcccccatgctgttcttgatagtgagctctcacgagatctgatgactttttaagcggctcttcttctttcactcatcacttctccttcctgccgccttctgaagaaagtgccttgcttccccttcaccttcggccatgattgtgtttcctgaggtctccctagccatgctgaactgtgagtcaattacacctctttcctttataaattacccagtctcaggtagttttttatagcagtaaaaaaatggaccaatacaccaagtaagaacaacttgtaaagctacacatggaatgattaggaaaaaaaatgtgaaaattcataacaagggagcataaccattgaatgaccatatcatttgccgttaaaccgggccttttttaatcatggaaggagtgtaacaagtgtgaactgattctacaccggacaggccaaggtgcatggtcaccttacctaataagtgtgagccctcctgtggcttatactagagaaacttcttgattcaatagagctttaaaggtatgcattcatggatctccacccaaacgccctgcattaaaatatctgagctgtattgcacttatctgtttcctttaatcccaaaccaactgaatttctctgcttatagtttttgcagtcttataaattctgtgatgggcatatgttgcttactttctcagcaatgacttcctgtgggtgattcacaccctatttctttccatcagcctctgttttctgtttgggttcagagaagttgatttgtcttcaattacaatcagtttctcaacctgtggccacagggactatttcaagaacattcccatgattaaggccacacagcctgaaactcatgcgtgatcatgagcagcttggccttggactgaagacaaagtggagaacacaatcagaaagagaaataaaccacaatcttggtggctgtcaagccactggatcaagtctacacccaactccacattgagccaataaagttcctttttttgtgagtgcagacttagttgggtttttggtttacagccgaaaccatcagaaccaatacaactccagtgttcacagtgccccatattttgtcctgagatccctccacagtcccctttgtttcagaatggccaactgttttcatatcttatttcaaatttaagaaaggaaattcgttggctcgatttatcttttatctccagaatctagtaatatgttgctcatcaacatatggttcggctgctaggtcaagtgcccagccataaaccagcctctggggctggatgggagggctgctgttcttctctgaagacctgtatccattttcctgccttgcagataccagtaggaccagtattaggacatctgcataagatttaattttagaggccgtgtgcagtggctcagtaatcctagcactttgggaggccaaggcaggcagatcacctgagttcaggagtttgagaccagactggccaacatggtgaaaccccatctctactaaaaatacaaaaattagcctggcatagtggtgtgcacctataatcccagctactcaggaggctgaggcagcagaattgcttgaacccaagaggcagaggttgcagtgagccgagattgcgccactgcactccagcctaagcgacagagcaagactctggtctcaaaaaaaaaaaaaaaaagattcaattttatgctgcatattcattatcatctttgccttttgactgtatcatctcaaccacggttatgtatcacagaggcttagaatattataactcattgttttagtttatccaggctgctataacagaataccatagactagctcataaacgatagaaatttatttctcgcagttgtggaggctgggaagcctgagttgaaagcgctggcagatctggcatctggtgaaggcttgcttcccaggtcatggatggccatcttcttgcagtgttctcacatgctaggcaggcaaaggagctctctggaatttctttttttaaataacagcattaatcctattcgtgaaagtggggccctcctaaaagccccatctcctaataccatcacactggggattgggtttcaatatatgaattttggcggggacataaacattcagtctctaacattcaccttttgcacattagagaacgtctacaaagaaaacgttaaattttagttttggaaaacttcctttccttttctcatttttattctttcctttagcaatgtaattattattgtatggaacccgtatctgatgatggtgagtttaaatggatcaaaattattgttccttaaaagcaacaccaaaattttataagatatgctgcatactaattaaagctcaaggagccccaggcaagaaagaaagataagccattgcttaagttatgcaaaagtgtattaaatatttgagattaattaaaatctagagaaagttttttaagagttccatttaaagtttgcataaaagttcacgcaattattataaaacatttgctatcaaactggtttgatgaataagggaagtcaattagtaacatagtgaaataagagttaattcatgtttctctaggtaatttctttcctttgttctgtaaaagtcatttataactacataatagtacaatcatacaataacaattatatgccaatacccactgttttacaaagcgatggaaagcatagttctatggtacttacttattttctaagtgaataatattcttcttaaacccatcctgaaaatttctacaataaaagattcattgatggaaagtcaaaaagtttgatttctggtggtttttgttgttcataaaggaaatgaaagcacagcttttactgagcaggtggttcctggtgtgtgagcccttaatggaagaatgatctgtgtcaacaggactgggaaagttctgattctgacttctgaaattgacctttattctccatttcagaacacataagccacggtatcccttttattatatagacatcgatatgaagagaacaaataaagtcacaccaagaatgtctgggcttgttcatcttacacaatttattatttttgaggctatcacttagtggggaaaaattttcctgcaccctaatgtaaaattgcaaatgtgtttccccagagtaatgatagtctaaaaatgagggacagtgagtcgtaattaggattaggcttgggaaacaagttcacttatattatagcatgttgctatggcaaaaggaaaaatatggtctgattttcaaacaattgactggcaaatgggcttatcccatgccatctattaataatcaatacagcttattcaaaggacaaaagtcactttctctataaaagaaagtgggacaaatttaacaacggtctactttactgcaagttaggatagaatctagaggtaagtaaaaagctttaggtaatgtcttcaagcctcgaagcaccagctttattctcaccggggaacaaagtctaaagaaactttcatgaccactgtgtctgataaagaatgaaaattctgctgaactcagtggtgaacgtactcattattaaacggactcagaaatactgtggttcaaagcatgcttcctaaaaataaaaccaatataatctatgaagaaagatttccaatgccaaaaaaatttcaatgagcattcaaaggttgaatccatagccaccacatgaaatatgatataagcaagtcagtaagagccactgaagtgtacggtttcagagtgaatgtttgtttcccagggaggagaatccaggccttcctctcttctctctatgccctgcctgccctgctgtcttccagcctgcaggcaagttccctgttgctttcaagctggagcttggcaccacaggagtccctgcttgccctctcattcccaccaccaaagcctcctggcagcatttttagctgtgtgggccttatattcaacaacaaagatgaagatatatggctaggagtataggagaaattatgttcttgatatttatttggaatattaaaaagaacaaaaaaatgagctctatgttctacatcacatcatactgtctagcaagatgccttatttttatttaataatttcatttataaattgcctctttacaattatgattgaagactgagaccaagggaaaaagaaggcagaagttacaatatttcctgtgcctgagcttaaattttggcttccagtttcttggaagctttcttacagggttagcatacatctcagctggagtttcccatttagattatctaccagtgtttttgtaggtgttggcttagtatattaccaacattactgcatcaaatttgaaaataattcttcttgatctggtcccagatttgatccaagaagcacatgagtctgcaggatgtattcagactcaaagttctagaatagttatagattgtgatctctccaaaactctctaatctgggtgtcattaggtatttcttgagtctttgctatgccacttgctgtgctgggtggatcactagcagcagtcaaatttccttcccgacccagacatcttatcaaataaagcttagaggcagagattccactagacacacagggccacgagttaatctttgtgaataatttcattgttaactattgggacaaggtacaaaaaacaaaaacagaaacttgctaatggaatacactttctaagattataaattgcaccatttgccaaatgtatactgttagaaatgagagcaataatttgcacttactgtaagtccagcatacggagagggtcatatgttgaaatgccatctctattgaggtgtcataaaaaatatttcctccagcagcacccagtcattctaaggtattaggtataatttttaaagtattatttggtgttctgaataccaaaaaagtacatcttgagtaccacaattggtgacattaaagttaattattttcattaaatattgcagtgctgtcatgaggaatgaaacagaagagcaaaatgaggttagagatgggatgtgttcaacattgctccccaagtatttccaaataattaatgtattcattgaatgatatttattgagggtcagaaaaagtgccatggtatttgatacagcaaaagatcacatttatgatttcattctgtcactttctgcaacaggtagcatccccttgccagcaccaaggcagggttgcatatttgaaagttactccctcaaaaaattcatttaaataaatagatttttttaaagaaattatgaaatactaacgttgcattcagttagtgattttatatggtgtaggattgacattaaaaaatacttgtcattaattttactctgtattaatgttatattaataatttctgaaagtaaccaaccattctaactgcagaacccagctgtggacatgagtttctaggggaggactctgaaattgtgtcaatgtttgtaatctagtcctcggagaatacaaaatttttgacaaagaaggaggttaaggagtgttttctttttgatgttcacctccaaaggaggatcataaagaagtaattcttgaaaagtattgcaatgcagtcttcacaaaaaaagcttatccctgaagtacagaaacacacttaaaaggaacatagatgaaatctctattcaaagagtttgggtttgacctttatgcattacatattatcactgttttgaattaagctattactgtctcattgttattttagcagctaacaaatgagtaggtgttctgaaaagcagtgtttagcatcatgtaaaatgttattttaaaagttcatttccactgagaggattttctaataaccacgtttctgctagtaactcagccatatatatataaaaatattgaaattagagaaatagaaactactgctgtgatataatttgatagaaaaatattaatagatggtagacattgtagagtttctttccatgtagaaatgttacattggaggattaacagcacttttattcattcaaaatagtcacagcatccattctattttaaaatgttaaaatacaaatacaattaactaatgtatttatccacattatctaaattacacaaataaaatatatatttaatattattaaaatatctagggatctgatatgtcctggtatgtctatctaatctgtgtgtgtgtgtgtgtgtgtgtgtgtgtatgctgagatatatatacataaagatatatacatctatagatattgatatagtttggatatttttccccacccaaatctcatgttaaaatgttatcaatggggcctggtaggaggtgtttgggtcacgggggtggatcccttgtcaatggctagggccattcccttggtaatgaatgagctctcactctgtgttcacttgagacctggtcatttagaggtgtgtggcactgccccctcaactctctctcctgctcccattcttgccctgtgagatgcttgctccctcttggcctttttccataagtaaagctccttgaaacctccccagaagttgagcagatgccgtcaacatgtttcttgtacagcctatagaccgtgagccaattaaatctcttttctgaataaattaccaagtcttaggcatttctttatagcaattcgagaatggcctaatagtgtgtgtgtgtgtaactacagtatatatacagtatatatatatatagtatgtatatatacagtatatatatatagtatgtatatatacagtatatatatagtatgtatatatacactatatagtatgtatatatacacaatatatatactgtatatatagtgtgtatatagtatactcatacacacaatatatactgtatatatacacacacactgagcatatattcatccacacatccagtcctctcagccatggctctaccctgaatttatacactatgtatgtgtatatatacggtatatacattgtgtatgtatatatacatactatatatgtaatctgatatatgtgtaactactgattatataattcataatatttaaattcccttatgcaattttttactctgctattatcctaaatttataatcattccataatgaagcaaataagcctatgcctcattcctggggtgtttagaccctgtttagatcctgacagatgcaatgtcttcaattaagttcttttacacactgaagggatagttcaggaggatcattaatactgataccatctaagcagaaaatagtcacagataattaactaaacttaatcgtactttagtatggataccttctttacatcgaggatcaattttaagttcactgaaatggatgtggtaaacatatcagagttacctcctgtggcattatatttgtagtaaatgtagtttttcaaaaccctttaaatacttgaacatatttttaagctcacaaaatactttgttattattgctttggagccaaattttccaattgcaaatatctaatgataattttttatatataactttactgcatacaagttggcaaaagaaaaaaacaacaacaaaattttaacttctttgtaagaaatcaattgtagataatgaatgatcgagctacttttctgaccagtcaagaagtgtgaacagatgctggaactgaatagcagttgctaagactttgcaggccgaccaccaccaggctctaagtgtcctatacaacaggtggagatataaggacttcttttaattgcaagacacatgatgaaaaataaaaggcacattctgtccacccttaaagttctttccctaattccctaaattaggttcttgtgaaatacctgtagttgttatgaaagtcatagaatttaatttataggtgtctcttaattaagttaggttagctagctgatgtttgtttcaaggatcatggaatcggccatgcagtaatttatatgcccaaagaaaaacctgattaaaatgcttaatatgatgaacagaccttgaataatcttcataattatagagtacacactacttacatttttgaagtggttccaaaaccatttgtccactgtgtgtatcttcaaggaataaacaattcactaaacctcctctctatggaaatgtatagacccttggcccatcacctcctcatccttgcagattttaatgcctggttcactgctccatgatccaataaccctcttgtagtattctttggagttttcaatatccatgtagaccattctttcaatgaacctatctctgaaatattggccctcctccattgataccatcctccagcatgtcttaatcactcagttccaagatcatctcctggaactcaacataatcattaactacaactactccataattgtgcttctcatttcctgcagctctctaaattcactgttaacaaaagttacatctatgtcttgttcactcatgtgctcacttcccttccacttagctttagtcccacattctatcattatgactcccttgcaatcacctttgatttctttgctcctctctctttcctaacacttgctcagaaaaacagcaatgctgattaagtgaaacttgtgcttcagcatctccctggggggaagaatggaagaatgtggctggggaaaaccacacacctatgctgattggtctcactttaaattcatagctcctaaccttcagtgggaccctggtgttgcaatcctacttcattccgctgctccatttcctcctctcccccaataccttcaatctacccatttcttcttcagccaattacatttcctagttgtttaaaatacctacttattttcttgttctcttttaaagtaacaatcatcattgctttcactttcttttgcctcattctttttgaacctatttcaaaaagactttcatccccaccatatcagtccctgtcaagtcatcagcaatctgcatgctgctaaatctagtggaaaattcccaatccttaccttcagcagcatttgatacaaatcattccgtctttcttgaaacattttcttgtagttttcttagtatttctctctctctcttgcttctcctcctactaaacctactgttccttctcatttagatgtctcctcgattttctcatttccaaacagtggagagccccaggtttcagtccttggacttatactgcttcctgtctacacctactccctaggagatctcattcaagttccatattccatctgtatgttgacttatctctctagctatatcctctattgagttttagaccttacacacaactgcctgctcccagtcagcacagtctaacaaacatctcaaactctttgtttctaataccaaactaccattaaaaataaatgtttctctctcagttttctccatgcaagtaaatgtcaactccattcatctattcactcaaaccaaaaaccttagcttcatctttcactcttccttttgaccttcacatccagtccaacctatcaggaatggctctaccctcaatttatacccagaatccagtcatttatcttcatctccattgtatccacttctaggccacctgttggatggactgctgcaataaccttccagttgatcttcctgctttcacccatgccctgtccccatggtctaattttagcacagcagccagagtgatacatttcaatgagatgttttcatccccatcccattcaatgtaaaagccaaaggttttgcaagtggaattttttttttttttagaaattgttttcgttttcagatgatgagaataatgcatgttcaatagaagtgtttctaaacgacaaaaaaaaaaaattgttattctccttcttgttccacacaatgaccattgcctttaaaaaaaaaaaaatcactgttcaggattggaattagctaggtaggtatgaaaaatagagaggatttaagttgtatttgcaatattaccatggtgctttacttacagcctctctcattgtggtaaagaaagactgctccttcatgttacagctggtttatatgtaattattttttttaaatcctgtaagaaaactcactcaactctcctgaaaaaccccaaagtgcagagacaaaatattccataaatatctttagaaactccctgatctagcatccagcccaacctcacaatcatctatttgctctccaccccattgtcaaaccaagccatgtggaatttaatatggctacctaacttctggatctttctctgataacaattctcatttttgtatctgttgataaagaatgcttctactgaatccttcgtccatatacccaaggaagggtaaatggaaaatatcgaagagatgaatttttttgaacttcttgtcagcattgttaattgaagatgtattttcctattgatttgatcatgtgttacttgattttgttctgattctcagtttaacacggtatttccatctgaagcttctgatgcatacttcatttattctaacgttaaacagaattttaaagctcaaaaacttcaatgttaattgactgaaaatgctaatctataaattcattttattgtagaaatcttataaggatatgttgtatagttctatgtcatttcccatgaatttaagatttagagattaaaaaatcagtaatttgtaaatggtaattttatcttgagcagaattctatgcctgtaaaccaagattctgtatcagtcagtaatagggctgaatatgtgacgatgtgtacacagggagggtgtactttacctttaagctggccaaatgtgcttttttatttttttaaataaaaaagagcctaaatagaaatcttatctgtaaatattcattggtcctaattatcttttatagagttgcttttaccttactcagttgtgatttcattattaaaacttcaagtcacagaccaactaagtgcttctttggtgtgtgtgtttgtttgtatcatggatatccagaacatttgtcattggatatgatcattataaaactcttgaacatgacttctctgaccgtggatctcaggagctgtacttgaagtttcaaatcagctggcagtcaaaatgtttaataattcctttccaccgagcaaagatttctttcaatttctattctaggagtttgtactttttctaatgtatcctgcacaactaggtccatcaagataaatttctgtgcttaatgtcatgaatagaacagaaaatatgttaaaaagtgatggctccaaaggcatagcattttaatctaaaacatctgtgatttttcttgttcacagaatgtctgcctccctcattaatctgtcaggttttaaaagatctgggaatgaatctgctttgtttaccactatgtcttcagtgtctcacctggggaaaagtttgtgatagatttttagggaataaattagtttttgttggatggatggatggatggatggatgaatactcttatactcatcctgtaaatataagtgacataaaaatcatcacaaatagatgtattgccaggtggtttttgataatcaactgtctcagtccatttgtgttgttataacaaaataccacagactaggtaatttataaacaatagaaatatatttatcatggttctggaggatgggaagtccaaaatcgaggcaccagcaggattggtgtctgatggggattgctcttcttccaagatggtgcctcattgctacatccttcagaggagaagaatgcagtctcctcacatggtgaaaaggatggcctggagaaagagagtgttccatgtattcttgaacccttttataaggatgttagtcccattcagggccctcatgctgtaatcacttcccaaaagtcacacttcttaatacagttgcattggggattaagtttcaacatgaattttggagaagccaccatcattcaaaccactgcaaaacagaaatcagtcttacctggaagtatgtggaatggctttattgaatatgggttctttcaacagatagagataagataaggtcattgaacaatatgattcttatcagagcaaacagaggcaacggtgactgagcatggagatatgtgagaaagtttaacaatagtttggataaaatgtagaaataaaaccaggaggcccccgtcatggagagtttttgaatgttaagtcagagattgggtgttttagtgggtagataaccaatagggaacacaacaaggagtacataaactacatcatattcacattgaaaactgagagaattgaacggcagccacaatgaagtacatgaagagaagtactaactaaaaatagatatttttcagagatgcttttaccatttacaaatgcaggtacatgcactctctgcctgttattcattttccaagagggctccaggcaatcaacctttatcttttttgggacttcaaaagaggacaatgttaaagctgcattagacataccccaactgtttgtttatgatggcttttactgtttatatgcaaacctaaatatgtaaatcttagaaaagaatgctaaaagaaagggtataaggcaaggaaaatctggcaaatttttaaattttaggtttcagttaaattaaaaaaatagtaacattatctttcaaacgtgaaaatttcagttgcaaagaatagtacaaataaatcaaagtaaatgtagatttagttggctcatattaaaagaaatactaatcagtaacagtacagcttgatttgtcattggatgaatgatgaactggggaaattgaggcaatcacaaatagtctagcttcagtttacctcctcatgaagacttctcagaatactcaaacctacaatgaatcctcagcactttgcctaaggcttgagccttataacctactcaataaatatttgctaaatgactttgcccttactaactttgcagccttttttttcagttagtaataaaactactttgtattgttatttgatatcttcatttttcatctagacagtgtaagatgaaggccctctctcacacttttctttcatctcatacttctcatttaatgattaaaattggcaatacaattagcgttacataaattgcattgaattagattgctactgtcttctaccctagaatggaggattcaatttatagttgacctttcttctgaagcttaattgttgtttattattcagtttgttctacggaagttaccactttcttttacataggatttagagtgtatttataagttggattctctgcttttggaacttccattattcacttaaaacagattcatgctttagaaagataaggagacaagaggaagaatccccctgtgttttatgtcctacttttgtaatacctgctcttctaaggttgtgattttgttgctgttgttttatttcagtagttttttgggaacaggtggtgtttggttacatggaaaagatatttaggggtaatttctgacatttatgtgcacctatcacctgagcagagtacagtacacccagtgtgtagttttttctctctcatccccctcccactctttcccgattctccaaagcccattataatattcttaagtctttgcatcctcatagcttagctcctgtttataagtgagaatatacaatgtttgatttttctattccagaattactttacttagaatgttggcctccatctccatccagatttctgtgaatgccattatttcattcatttgtatgtctgagtagtattccatggtgtgtgtttgtgtatatatatatatatatatacaccacattttgtttatccacttgttggtcaatggatatttagtcttccttatttttgcaattgcagattgtcattttttgatttttttaaattatggccattcttgcaggagtaaggtggtatattattgtggttttggtatgcatttccctgataattagtgatattgagcaagttttcatatatttgttggccatttgtatatcttcttttgagaattgtgtattcatgtccttagtccactttttgatgagattatttgtttttttcttgttgatttgagttccttgtaggttctgtcagatgcattgtttgtgaagcttttctcccactctgtgggttgtctatttactctgctgataatttcttttgctgtgcaaaagctttttagtttaattagatcccatttgtttatctttgtttttgttgcatttgcttttggttcttggtcatgatctttttgcctaagctatgtctagaagagttttttctgatgttatcttctagaatttttatcgtttcacatcttaaagtctttgatccatcttgagttgatttttgtataaagtgagagatgaggatccagtttcatttttctatatatggcttaccaatttttccagcaccatttgtttaataaggtatcctctccccactttatgtttttgtcagcttggtcaaagatcagttggctgtaaatatttggctttttttctgggttctctattctgttccattggtgtacatccttgtttttataccagtaccttgctgttttggtaactatagccttgtagtatagtttgaagttgggtaatgtgatgcttccatatttgttctttttgcttagtcttgctttggctatgtggggtcttttttggtttcatattaattttaggattgtttgacttagttgtatatgctagatgtcaaagcaggaaatagatatttggtgtcagaaacatgaatctatttattcttgtgttctcatcccattttccctctcaactcaccatgagccaaatacaattattttctaagtaaacattttgacaaatgcattatatatttagctagaagaagtttctgccttctatgaggtcacagcctaggaagaaagagatttgataatgacccagttaattggcttgattacaaaattttggcttttagttagcagaattcctatttaactggtttttctaaccatctcaggattaacccatctgttcagtgaagatacttagagaaacctgtattctaagaggttattcaaaagtattctcagaggtacatgtgcatatatcttttgccagtacaagctagcaatccaatgggaagatgtttacctgaaaaataaagaggaaaactaatcccctcagcaagtgtttatcaactgtctttgccaggcaccacccaccagtgctctacatgtgatgtgagcatgccctgaaggagatcatagtctagtgcagcaattaaacagtaaagaaataattacagtacattatgatgagtccaactaggacacagaggaggagggagcattatagggtgcagagaaacattcccagagaactcagagtaggtaagatacatgggttgaaggagccgggcacagtggctcacacctgtaaccgcagcactttgggaggccaaagtgggtggatcacgaggtcaggagatcgagaccatcctggctaacacagtgagacaccgtctctactgaaaatacaaaaaattagccgggcctagtctcagctactcgggaggctgaggcaggagaatggcgtgaacctgagaggcggagcttgcagtaagccgagatcacgcccctcctgcactccaggctgggcgacagagtgagactccatctcaaaaaaaaaaaaaaagatacatgggatgaagggaacagcatgggcaacagaaggttaggagaagcgcaggtcatatggtatgactggcttgttgaattcatgattaggttggtttgagcaattgaaaagtgattaatgtcaaccacttctcatttttcttttatttgataaatatttcttcttacatatctggtcacaaacctttaatgaattccatgtaaaacaatcaataaattttcttattctttccctcctgtgacaatagagatggtgtctctctatctcttttggaacctgtccctttaatagcttctgagaaactttaaactataaacttttccctgtatattgcactgctagcttcaaaccaaatcactgccatcagcctttaaacatacttgagtctgtcccatattaatcttgatttcacacatgtgcccctacaacctctgcttctctttacaataaagacttgtacaagagttgtctctagctccacactgccacttaatcctggaccgctccaatctggctttcacctccatcactcaaccaagacagccctccacaaaggtcactaatgaccgccatgtctcttaataaaatagacttttcagtcctctccttgtttttttctctgggatatgtttggcactgtaaatcagtttatctttcttgaaacaatttcttatgttggtttccatgacatcccactcttgtttttctctatctttttgagttctgcctgcccctgctaatttccttttctaggcttattctcctttacctagttggcaattagaagttcctgaaggctctgcactaagcactttctctttgttctttaacttcttccatggatttgatttctgagtactctaaaaactcccaaatttaattcccagtgaagacttgcctttcagtatatctgggtttgtttaacatgcatctcaaatgcatttcccatttcttatatcctgaaatctgacctgcgccccttgttttctgtgtaggaaaattcacaaatatctatcttgtgcattaggtcaagagaccatggaaaactctttaaattgttaaaacactttagaaccgagtttcttaacctcagccctattgacattttgagctacataatttcctgctgtgggggtctctgtgcattgtgagatgtttggtgagcattcctggcctatacccactagatggcatagcaccccctccagttgtgacaagcaaattgtgtccagacattgccaaatagctcttgggagggataaggaggccaaatcagcccttactgagaatcgcagctttagaaggaagataagagacaaagctgtgttttttaaaaaatagaaatcatgctgaagttttctaccaaggaaattattagttcagttgtatgcccaaagtgtatgacattaagtattatttatcaatatcactacttcccacattagctacatgttgtgagtctcattggttatctaaaatatgcttcacaaaatttgcccagcaaagatttgtccagtgagcaccaagaaaccccatttggaccttgctgatagttccagcatatttccacacaatttctctcctctcatcctcctaatctcccaaccacagtcacagtgttttttgaaatcatatgctcctcctgtcatccagtgtcacccagtgttctttctggaacatcctgcccatttcacttaaccccccttcatcctgcaaacacagcccagacatcacctccctacagaggcctttcctaaaccccaaagccctttaggttttcatgcactcttagagctgtgctgctttccttcactggcacttacctaagtttatgattaaatatgcattcgcatggttatttgaatatttatcacacccaatagcctttaacaaggatgtaacacataagctctaaaacactggtgcctggcagtgacatgtatgattcatttcaaaacagaaaggtagataatcaggcacaaggactgctacctggctcaccagcagcacaggacatttgaaatcagcattgcactaaaaaatgtccttgttatagtggccatccgcagagtgctgaatctttcccctgtgtcgtgacgcctcttttatatcataatttttaaatcttcaaccatcatcctctaaaatactattttttcagagttgttaagttccgtgggcgaataatttgcattcattttaagacaaatttgtttaggcgataaatgcattattatttttctctacctcacaatatgacatggattttcaattgaaaattctgcctgaaactgattggagttgggataaagttgtagacaatctatagtagttcatttggtcacagcgtgtttgctttacttttggatcttgagaagaaaggactgttatctgcagggcactctgggacaacttcttggtgataagagtgaagactcatatttgctttgtaaatcaataaaaaagagacctttcaggcaaaagtgttgatgactgaggaggacaagttgtgaattttatattggaatgtaatgttacctatgaaattttccacctattttaggattttcatattttcagatcaatcaaaatttgttgtgaacaaggtttctcctccgtgtcctacgaactacaaaaaaatgagtgcctgtgggtgttttcaaactgcctgtgggtagacagagctatgttactacctggaactctgtgaatgtctaaaagaaagtcaaaatatcaaaatcgaaaaggaacttattttctttgatatgtcttgttgtatgaccttggtaggaacaatgacaaaattttgacatgttcagatgtcttagaacaatgaaattagtatatattaaaatagcagtgctttgttgtccttttaaataatacatgcattttaaagtattcagaagctttttctactttgtataaataccttatcagtcctctaaaataatccaagcttaataggaaaaaaaatgaaggagctttgttgaggcttactgaatgtcacagagcctgcaaggttagaactgagcatagaaagtgaagaaatatgttcttgatgcctattcaactgggtttcctgttcaaggttatgcactctatttgctaatagttgtagtattctgtaccacaattgctgagattaatatcttgagaaaatattgtaccattccagttaataattatgttgatttctattcttcagtttaaagtagatatatgaaaataggacctagtgtgtgaccactcaaaaaccctattttcctcacgtttgtagtgtatttctaaaggcctctccaggattatttcaaaatcaaaattgaaatattgtctaccaagatattgaattaattatgtatctatttcattttactgtttgaacactcccttctaatttgtatatagagagatagaattgtctagcacttttccgaaggaaaaagaaatcaagaataatatttaaaggctcataatatcttccgtctacatgtattaattgtatatggactttaaacaaatacaattaaggatagtcttgttctgcatataattgatttgcctatgttgatgagatgctgacaaccaggtatgaaagctggttttgcttatctaaaagagtggactaaaagtaagttaagtggtttctttagtgttctgtagctttagttgtacatggagcacctgctcctcttggaagtcacagcactttaagtaagttcgccatggtctgctatgctgcgcagactaagctgtgcagactatgctgcccagactcctcttcctcctctttagactgtggcagtaacctaaaagacttggcctctgtttcaactctcatgccacacatcatcttttgtctttcctgtggttcaggtatttgtgtgtgagggttgaggtgggggtgcaccaaattcatacagatttcctcagtagctttattttctgaatttgaggcaacaggacagtgaaaaatggcgatcgttatattgattcatacaacacagagatctgaaggaagcattttgtacaaaccctgctctgggtaacacaggaaatgccaagattttgaaatgtaactttcttggtcttgaagaccaaattgtgctcagaaaaggcagagtccctataagttttgtcacaataaatgagtagagcccactgcaggttggaaatctacaaatcattgcagggtattattaagataataactgcacgagagccatcacagcagcagaggtaaggatctctgccaagattcaccttagaccggtgattctggaacttgagcaagcctagactcaccaggagggcttgattgctagagtaggagaattttccccgtcttacatataaccaggtgatactgaccacacttggagaatcactgccttaggcattaggatctgagactatatatccatggattgcagcaagaagcagacaaaaacatttcttcatacacaagaatgtttgtgacttagcaaggctgttattggagacctggccattttaggtagttttgtataatttgccttattccatccaatgttctaatttctaatgtttataggctgcaagcctagacgctactgttgtgaaacagttaaacacgttgggtgtggtgccgagctccttcctaggttatcaaatccaagctctgccatttattaattgtgtcattttgaggcaggtatttatattcttagggccatggtgtcttcatctgtagaataggaataatagcacctattgctagtattgctattaggattttcaaaataacacacataatgcattggagaaagtgcctggcaaattataagtatgtaataaaacttatctctctttttactccttatttcttattacagtggttttgtttttcatttcttttattttttggatagttaaaccttataaggatttaaaagtttcatgtgaccattcaaatatcccaatttatcatttaaacgtaaacaacaatggtgccagagtagtcatggggccctctccagcttcatcctacagaggagccccacctgggcaactgaaataagattataagctactagaagaataaagaggtcttatttcattatttaattaagccgctgaatagtttattcttcctaaagcaacatcacatataccaattaggttagatacccttattaactagccagggaaccttctctcttgaaaaacatcaacaagaagtttttgttgttatttttgtcattcttgtttggttcaagaaatataattaaataaatttattccagaaattttaaatttcagttaaaaatttttaatttgatgttatatcagagttatgaaaatcatggctaactataatatggcctgagaaaatccacttatttcaaaagggaataaacagactaaaaaacaataagaaaacaaaaagcagatgagtgtgaaaattacaagataaactcagaatacacctggtcaaagcaaacattacactgggcaaagttacataggcaagagaggctttattcaaaactattgtaacagaagagagaggctgtaactcagcctgagctcaactccactgaaacaaagggatgaagagtttttaagagctgggatgggagaatctgtgtaggccatttgtgcttgctaattggctttacccacagatgaagtaaattttctcctatcttcatgacaggaggtagttttacaacttagagcaaggctctttgaagttaggctcccacccacactcaggtgtagactgtatccctttaatgcttttatttcaaagtgatggctcctgggtgcttaaggaaaacattccagggttttaaaactgacaagaagctttaaaaaaaggtttacatctcaatcgggcaaagaaagagtttcaattacttgttttctaaagtaaatgctttaagaaagggaagttagggacctagagtcaggaggaagcctgtataaagtttagtccagctgagggaactgctaaggccatcttggtctcggtgaacacttggttttcacatagttttaatcacggaactagtatgtggcctggacacacttggaaagaagccaacaccagagggattgctgatatactgtgaatatctaattcctacatttatgataatgaggtggaatgaaataaagaggagacagtgtgaaattggaaagtatgtagtttgatgttacttgcaagtatactgtgaggcccaatttatgacactgggctgcatagagctttttctgaaagtccatctagctaaaccctgtcctttaaccatatgggccaaatgacttttgctttattttattttagggaattttctttatttgtaacattcctttcagctctttttagattctaatattccagaatgtcttttttccagtgtaggttcttggcatctttgtccaacatttcatagtaggtgtataaatttgtttttggtttctgaattctattccattgatctgtttgtccacttgaatgccagtaccaggccattttggttactatagctctgtagtataatttaaagtcaggtgattcctccaattttgttatcttgctcaggatagctctggctattctgggtatttttgtggttccatacaaatgttaagatatttttctatttctgtaaagaatgccattgatgttttgataagaattgcattgaatctgtagattgctttgggtagtatggacattttaacaatattgattcttccaatccataaaaattgaatactttccattttatggtgtcctattcaatttctttcgtgttttatacttttcattatagagatctttcatttccttaagattgatcattgttggcatatagaaatggtactaatttttaatgttgattttgtttcctgcaactttacataatttatcagttctaatagtttttttgtgtgcagtctttaggtttttccaaatataagatcatactatctgaaaacaaggataatttgacttcttccattccaatttgaatgccgtttatctctttcttttgtctgattgttttatctaggacttccattactacattaaataatagtggtgaaaatgagcaacttcgtcatgttacagatctcagaggaaaggctttcagtttttccccattcaatatgatgctagctgtgggtttgtcatatatggctttcattatgctgagatatgttccttctatccccagtttttgagagtttttatcataaaaggaatgctgaattgtatcagataatttttcagcatcagttgaaatgattatacggttttggccttcattctgttgatatgatgtatcacattgatttgcatatgttgaatcatccctgcatctcagggataaatcccccttagtcatggtgaattattttttttttggtttgctattattcaggatttttgcatcaatttttatgagtgatattggcctgtagttttatttttttcatgtgtctttgtctggttttggaatcagggtaatactggcatgatacagtgattttggaactatttctctcttcctctattttttagaatagtttgagtaggactgctactagttcttcattacatatttggtagaattcagcagtgaagccatcaagtcccgggctttttttactgggagactttttattatgcttcagtttcattacttgttactagtctgttcaggttttgaatttatttgtggttcaatctcagtaggttgtatgtgtctgggaatttgtccatttttttccctagatttttccaatttattgacatatagttgctcatagtagccactgataatcctttgaatttctgtggtattagttataatgtctcctttttcatcctgattttatttatttgcatcttctctctttttctgtagtctggctaaaagtttgccaattttgtttaacttttcaaaaaaccaactttttatttcattggtcttttgtattgttttcttcatttcaatcttatttatttctgctttgatttttaccattgattttctactactaatcttgtgtttggtttgttcctgcttttccagttctttaagatgcattgttaggttgtttatttgaagtttttcttattttttgatgtaggcacttatagctatgaactttcctcttagtactgcttttgtcatataccataggttttggtatgttgtgtttccatcatcatttgcttcagaaaaattccaattttcttaatttttttattgacccactggttattcaggagcatattgtttaaccatgcatttgtatagtttccaaaattgctcttgtcattaatttctagttttattccattgtggttagaaaagatgctggatattatttcaatttttttaatgttgtgagccttgttttgtgacctaacatatggtcaatccttgagaattattcatggtctgaaaaaaagaatgtacattctgtagccgttggatgaaatgttctgtaaatatttattagatccatttggtctatagtatatattaagtctgatgttcctttgttgattttctctctgaaagatctgtccaattctgaacgtggggtgttgaaatctccagctgttattgtactggggactacctctctctttagctctaataatatttgctttatatatctgggtgctccaatgttgggtgcatatatatttaaaattgttatatcctcttgctgaattgacccctttatcattatagaatgacctttgtttcttatagttttaatcttgaaatctatgttgtctggtataagaatcgtaactcctacttttgttttggtttccagtggcgtggaatatctttttccatcccttcattttcagtctacatgtgtctttataggtgaaatgtggcaacagatcattgggtcctcttttttcatccattcagccacttcttttcattggagagtttagtacatttatattcaatgttattattggtaagtaaagacttactcctgccattttgttctttcttttttgttgttgttttgtggtcttctcttccttgtttccttcctgtcttccttttagtgagggtgattttctctgattatataatttagtttcttgttttttattttctgtgtatctgttgtgtgtttttttacttctggttataatgagacttgcaaatactatcttatagcccattattttaagctgataacaacttaacatcatttgcataaacaagcaagcaaaaggaaaactaataaaagctctacaccctaatttcgtcccctggtttttaactatttgttgtttctatttatatcacactgtaccatatgtcttcaaaagtagttgtagttattatttttgattggtttatcatttagtctttctagttaagataaaagtagtttatacatcatggttaccatgttatattctatttttctgtgtacttactagtgagttttgtacctcttggtgatttcttattgctcattaacattcttttctttctgattgaagaactccctttagcatttcttgcaggacagatctggtattgatgaaatccctcagcttttgtttgtctgggaaaaatctttatttcttcttcacgttcgaaggatattttcaccagatataccattctagagtgaaggttttttcctttagcacttcaaatatgtcatacgactctcttctggcctgtaagttttccaataaaatgtctgctctcaaaggtattggagctccgttgcatgttatttgtttcttttctcttgctgcttttaggatcctttctttatccttgagcttttggagtttgattattaaaagccttgaagtagtcttctttaggttaaatctgcttgttgttcgataatcttcttgtacttggatattaatatctttctttaggcttggaaatttttcttttattgtgtctttgaataaaccctctacccctgtctatttctctaccttgtatttaaggccaataagtcttagatttgcccttttgaggctactttctagattctatatgcatgctttattctttttgttttcttttgtctcctccgtgtattttcaaacagcctgtttttaagctcattctttcttctgcttgatcaattcagctattaaaggactctgatgcattcttcagtatgtcagttgcatttttcagctccagaatttctgcttaactttttaattatctcaatcttgttgttaaatttatctgatagaattctgaattccttctctgtgttatcttgaatttctttgagtttcctcaaaacggctatttgtgaattatctgtctgaaaggtcacatatctctgtttctccagggttggttcctgattccttgtttagttcatttggtgaggtcatctttttctggattgtcttgatacctgtagatgttcatttgtgtctgggcattgaggaattaggtatttattgtagtttttgcagtattggcttgtttgtacccgtccttcttgggaaggctttccaggtatttgaaattacttgggtgctgtgatctaagctgttccttatttagggagcaccccagtaacactatggttcttgcagactcatacagattcatcttgatcgtcttaaagaagacctgggcgaattctctggattatcagatggacactcttgttctcttcccttactttcttccaaccaaatgtagtctctttctctctctctctctctctctctctctctctctctctccctccctccctccctccctccctccctccgtctctctctgttctgagccacgtggagctgggagtggaatgacgtaagcacccctatggcaaccaccactaggtggacctgaagccagcacagcactgggtcctacgcagcatctgttgtaatcactctctggctactgcctatgtttcctcaaggccctgggactcagcagggggcaaaaccatctaggactgtgtccttcacttcagggttgcaagttcccctaggccctgggtgggttcagatgtgctgtctgtgagccagggactagagtcaacaaacttaaatgtctactttgtcctcttttgtcctgcagctgagctggcactcaaaccacaagatacagtccttcccactcttctctcccctttccaaaggcaaaggagcctcagctcatggccactgccactacaggtcctcagtgaatacttccagcctaccaaaaatgttccattgaggtccaaggactcttaagtcagcttgtggtgaatgctgcctggtttgggactcatccttcagggaagtgggctcccctctgaccctggaaatgtttagaaatttcatccaggagccaagtgctggaattagggactccaagagcccattttgtgccctactctcctgtggctgagctggtacctaagatgcaagatgaaatcccctttgcttttccctctgcctttcttaagcagaagtctcaccccatagccatcatagctggaaaagtgctgagtctcacctgaagccagcaagtgtgaatctcacccaaggccctcagtgtagtaccaggtattgctgctggttatttgagcccaaggacacttcagttaccagggtgaataaatcctgtcaggactgggtcatttccttcgaatgagaaggttgctctctggcccagggtatgtctagaaatgttatcttgcaggtagggcctggaaagggggcctcatgactctgactgctgccctatcctgctatagaagagctgctatccaagaggcaaaacgaaatcttctccagtcttctgtctcctgtcctcaagcagagaaaaggggtctcttttggagcagttagttgtacagcctggaattaggggagaggtggtgcaagcactcctttagccaccctggatagcatctcaggaggttgtgtgccccaccctcacccccagtcagctgggtttgggcccagttcagcactaggacttaggagttgcggtcttcatggcctatactgcctttcaagattatttagggccgggcctcagggcactttagccagcagtagtgaggcttgtgggaactcaagcactgaccactgggatcagtgattcccctctggctaatgctggtttaaatggtccctccatgggtgggtgtcagcggagtttgatctggttttcctttctgctataacaggacaccactgagtccaatgactgaaattgctgcacgctgtctctctcctcagcacatggaaatgctctcctcacccatgctgccactgcctgcaggtggtggaggggtgtcgtcatggcaattagtggcaatagtcctgaataggcaagtaaggactatttttttttctccttctgagtgactctttcaataataggaagttaaaatccagcactgcgagtgttcatttggtttttggtccttaggaaagtgcttctctctgtagatagttgttaaatcggtgtcctagtagggggatgatcggtagaggcttcttgctctgccctctaatttgtaacatttttttagctctttttagattctagcattccagcatatggcaacattttaagcattaaatttctgtataggccttccagacatgggtaagtgtgtgtagagatatgtttgtgactttatgtttcctttaatatgcaatttcacatttaccaatcctaaaacattaaaaagagcataatccaaatacagtgttcaaataaacactgcagttatttgttagcaaagcaactggctgtgattctatttcaggaagattatctcctccaagacgtagaaatttgccagctacatttgtttgctactgattcctgagtttggtttgctttcattcttctttggatctcagtctcctatgcaccattcacattttctattcccagtaaaaaggtttttgtatggtcttggttttgttcctatcagtcacttaaaagaacagacacccaaaggcaagggcattaatcatctgtttgaaggtccctgggaaattattatttatatgttgatagtgaatctattttaccctttaaggggcaaaattgctagattaggaacatggttaggaaaacatagcagtcattaaccttatcgcttttccaacaaagaaaaactgtgtaacaactggccaaagcccgtggcaatttgagaacacaagagatcaacaaaatgaagcccaagatgagataaaacaagttgccagccttttggcataggtttaaaataattttctgtaaacacctatcctcaaaaatggaaatcagtgaaaatatttcataaaatggctagagaattctaaagcttacattatattctttagtattttatataagaaaaattttgtttgctttagaaatttcataacgtatttcttttagtctaattaaattttctttttttttttttttttactagcatcattccccttagtcactaagagtgaaattaaaaccactaaattttatttttttaggttgttggaattacaggttctctgaaggggttgctctgcatagattattgacaataaatatgttccaaaaaactccatgccaatgagatgagaggaattattgggcaagagccaaagaggaaccagggagatagcaagtgcaggaggaaagcacaggtatggaaagtgagtgaaagtaaaggatgatgtattagtccgttatcacactgctataaagaactacttgagactgggtaatttatgaagaggtttaattgactcacagttccacaggctgtacaggaagcatagctgggaggcctcaggaaacttataatcatggtggaagggtaaaagggaaacaagcacgtcttcacatggtggaaggagagagaaagagtgaagggggatgtgctacatgctttcaaacaaccagatctcttgagaactctatcaggggaacagcaagagaagaatccgcccccatgatccaatcacctcccaccacatccctcccccaactatgggattaaaattcaacatgagatttgggcaaggacacaaagtcaaaccatatcagatgactagccgaatgttaacctgatctgtcctctcagcagggacaggtgccctcctgctttatggatgatttaaagttattataacagatggtggtgcttcctttcatcttttactttggaattttagcattaatttaaaaaatatttcctatgaaacagtgagacaataatgctagaacattctagtggttcataaagagcctttacaggtaggattcacttggttagggcgccacattacagatttgatcccaaaattgtggatctagaaattttattttcacatggtattttatgtgggttagacatattagaataccctgcctcagtttccttgttggttgttgtggacaaaaataaatgtacttagcactgttttgaggataaaggtgttagaacactgcttgacacaaagtacttaacaaatgttagttgtcattcttagttttattaacattctcaacaggcatatgctgatttattagcttatgaaaaatacatttaagtgggtccagaattattttattctcctttcagaatactctgttcatgataccaaaataactgagaagctgcattagtctatctatgtttctttccttctttctctctttttcttctttctttctctttcttctttctttttggagacggggtcttgctctgtcactcaggctagagtgcagtggcatgaacatggctcagggtagccttgacttcgtgggctcaagtgatcatcctggctcagcctcctcattaattttaagatgattctactatggagaaaatttaaagagtgatcaaaggttctgagtggttgtaggagatgttttatttgggatctgaagactctgataaatcgcctaccaccctacacctgcataccatcacagaacagtccacaagatgtcagttgcacaaggatcagggcaagacacacttgctctttgtttctttcttttttttttttttttttaacctgtgagtctctgtatgtctctctcttgctgttgctctcactgtcggcctcctctctcctccccccacccctcactaacttttgagctatcatgttttgtttcctagattccaaggtggcactcttccttcctaacatcctttttaattccacttatgccattgcttatgttaaggtttcctgcaaatgaaatgaatcgaaatgaaataggatcaatttcttcttgcttttagctgggagagtccttaagtgtatcactgaaagtggttgctggtttgaaacaatatttttgggttatctggggccataagtaatgacatttgatttgtccacatcatcaataatggagttagtagtagactgaggttcaagaagttgaagacctgagacccatatccaagttttccactgtttacaaccacgactgcgagaggacctaactgttgtatcttccttacaattagaagagacacaacttttcccaagaacaccacctcaagagactgtttacattattgaattagactaagctttaacatacagtgagtattcagttaaattatttctcttcacatcagctggtagggacttatggtgagtacaaaatcagctatgggcaaagtttaaaatgttatattttctctggacattaattataatagaagatacatcttatgctttccacataaagaagtagcatgttaggttaaaagaattttagggtgtctgataagaaaatcaaggtcagtgtgactaaagaagagttaaagagaggactaggatggtttatggatgaagagatggcagaggctgcatttcacaaagccttgcagactatggtaatattttccattttattccaagtgcattagaatgccaagaaaaggcattaaagaaggaaagtagtacaatcagatttttattttttttaattactatgacttctatatgaagaagagattcagaagagacagattcagctgtgaactagataaggggcgcttatttcaaccatgatggagctagtagatgcacacaagtggacagatttcagaaagttttagagaatgcatgcgtaaatagcttccacctgcatgctcttgtgtacatgctctacatgtgaatatatagatctacttacatatacatatgtatgtttgtatatagatatgtatttgtttaggaacatacttagaaaagaagatagaaaaacacaccaaaatatttacagtgacttcaatatttaaggttatagtatttggggttatgtttacttgctggtttgttttgagatggagtctccctctgtcacccaggctggagtgcggtggcacaatcgtggctcactgcaacctccgcctcctgggttcaagcaattctcctgtctcagcctccccaagtagctaggactacaggcgcgcgccaccaagcccagctaattttttctgtaattttagtagagacgaggtttcaacatgttggccaggctggcctcaaactctggacctcacgtgatctgcctgccttgggctcccaaagtgctgggattacaggcatgagccactgcacccagcctatttggggtaatttttgctgccttctttacaatttttcttttcttaatattctacaatgaatatatgtaaataaatatatatagtatatatagtatatgtacacacttgtgttaatgaggcattatggaaattaaattataaatatggctagtatcaagaaagtcctaattcaagtttcattacaaaaattgtttcccactactcaaatatgataaagcacttttaacataaacaatttttataggcaaattattgtgttggaggccctctcaattggttcatgatcatgcatagctcctaaaatataagaaggtaacaatttataatacaatggatttcaatcgatgccctttgccattaaatcacactagaattcaatgacacaactgattaacaattaaattaatggtggtgaccttgcaaatgaaaagtgatatatagtatttatattttcctcatcttccctctgtttctgaaaatgtaaaaatattcttttaatgtttgtagtttttaatcttaaaaacacaatgttgaagaggaattatctggagagtgctagattagagtcaattaagatttccaaattaaatttttaaatttataactagagagatttttaaaatgttagcagtattttttccccagattatctatctgcataagattctagagaattctgagacattcttcttgctttagagttgggtgctacataaacattaatcagtgctaagtaaaaacaaaccaaatatgtgtgtgtgtgtatatatatatatatatatatgcacccccattgtttagtatcagtaaattttactagaaatactgaacaagtatatggcaagcaattgacaaaaatattggttcctgatctccttttaaatagtatctatgatgctaaataaaaagtgttctaataatagaggaaatattttcatattttaggtcatatacatatacacaacataatagggacggggagaggcatcatgaaataactcaaggtagtatactatctgaaaatttatacttatgaaaatttatgttataaaaataaagttaaattgcttttttaaaattgctttagggtttagctctctgtctacatagttggcaaccttgggtgacttattttattgtaatctattgttatgttaatttcccctattgctacttgtataatttttatatacataaggcctcaataaataaactctttgaataaaaaagaaccctaagcatctttttgcaaatagttctaaatcatgaaaacactaatattttataatgctctaagaagctaatgaaccagaaatatctttaaccaaaggcacttttcctttggttttcacaaagcagagaatcctaatggacaggcaagataaatcatttactgtgtaaaacactcatatacctattgaaagggtaaccacatcaaatgttctctggctatttaaattacctacaaaaagaaatcttagcaaagtgcaaaatgtgatagacatttgcagtctatctgtaactagcccaattccttcaaagagaaatgtgaacataaaatgcaaaagcatgactgaggagtcatttcatgcattccttgattcctcagaatggctacaagcaacgttctcatctagtgtggggcctcactatgcaaatctgccaaggttatccccgtgggcaacctacaaccaacgtgtctttgccttgggctcagtgagttgactataatggttatcctggcaagacggagctgatcctctctcagaagtagacgataagatattatccagctaaaagttaaaagtggaagacagcttacacttcaaggactggagaaatcaaattcagtaatgccatttctcagaggaagtctcagattaaggacatagacaataaagctttatataaggaaaatatttgtttaaggttgaaaaggctaagatataaacatccagtcagtttgatttaaggtggaaaaaaaagaatctaattcttagaatggagctagggatatcagtggaaactcttcttccctacacaagtgacttgacatgtttcttgtttttgattctaaagttgttttagaaattcagatgtgaaaatacaaacattctctgcttttttctcccttgtagctttgattcctcaatattcaatttgtcagccaatcacattaactctatgtccaattgatttcccatatgcctgctttattttctgtggttaccacttcgggacatccttctcacttcaatccccattcttctgtggtaggcaaaaatttgtaaatcccccaaccaagggtgtcctgtcctgatccccaaaacctgtatttatgacaagatatcactcccatgatcatgttatagtatatggcacaactgactttcagattatccaaatcagccgaatgtaatcacatcactctataaaagcaaagaacgtttttttcccactggtggaagaagagaaagtcatagagattagaaatatgagaagcactcaaatgccattcctgacttgaagttggagatatccatgtgagatgcaatatgaggagcctctaggagagaaagtggccctgtctggctcacattcagccaggaaacattatcctcatgctacagcaataaagaactgaatttttccagcaacctgaattaccttgcaagagagtttttccccagtgccttcaaatgagaacccaccctaaccaaccttgatttcagccttatgagaccctaagctgagaactcagccaagctcacatggactcctgacctatagaaactgtgacataataaatttgtgtggttttaagctgatgagtttgtggcaatttgttatacagcaatagcaaaagaagataccttcccacctagccatattcatcagatcagcctttataaatgactccattcatcttaacatttgactatgtaaaaatctacaagtcttctcaatgtttcagaccaaattcaaaacctttattttgactttaagatgccagtaaattaataagccaaagtttcttatcctaccaaaatttttactattcttgtataaagatgctcctctaatactttgttgcatttgttctcccatttgtcatgttataattttctatgtatttgtctgtcacctccattaaactggacattaattccttatattctcagtacctaggacatcacttggcatcagtagatctgtaatcccactcatggatgaaacaactccacattaaatccaggccagacccttactgttctttgaccaggccatgcagagctcctgcctctttgccttggctaatatgcttccctcagctggaatatctcatttcttccactatctaccaacgtgctgagggaagagtcaatataagacagtcaatatacgggtcctttgttgaggcaaaaaactactctggattaatgtctccttacatgattgcagaacacaactaaaaaatctgcatagaaacaagagcccactagtctggagccatagagtctccttgacactgaaaggatacagcccttcggggatatgtttgtcaatttcttaacaagtctatgaatttcttgagtaaaagaaccacattttctattttttggataccactaataatatctcgttggcatagaatatatgcttaaggaaccaaatttgcacttaagcttcacaaatttcagacaacatagcaactggtgtagttatcttactgctcactttgtcactatttctttaattcaaactccctccctgccttgacttaccaaactgaagctggatgggagaaacagtgggagtaataatacaactagggcccagagaaaactttctcaagatcacgtagctagaaacatactggacccaggattgaaacctgtggtttctgacgccacagctctgcccatcataactcccacaccttcttgcctatccccacccaactcccagtccctaacagtctaggataagaatcctttgtattcctacaaagaggttgctatgatttgaatgtttgtttcttccaaaaaaaaaaaaaaaactcacattgaaatttaattgccattgtaagaatattaaaaggtggaacctttaaaaagtgactgggtcattagagctccaccccgctgggtaggatatgtgctatgacacagggcaagtttggtgacctcttgccgtctcttgctcttccaccatctgcaaggggaagaggcaacaagaaggcccttgccagatgctggccccttgatcttgcacttctcagattccagagctgagagcctatacagttccatctattacaaattaccccgaatcaggtattctgttatagcagcagaaatggactaagatagtgtataattcatgggtagaaaaataatgaaatgacatgagtgttttgagataggctttcgactacaaatattagagacaaaccctaaaaaggattacatagaactatctttatatgaatacacatatcagacagatagacattcaaacttcctctgtccaagtcctatacatgccactccttagtattttcagattgcatcttagagaaatcattattttatatcaaaaagtagctggccttgacagagtataatcaggttcacagtttatggttctactgtgattaaaattagaactttgatgcttgttttatagatgagaaatgaccttcatataatgtacattgttagtaaatgatttctaaaaccacctagggcatttctttaaatctaattaaaagcacaatttcaaaacaagcagatcaaaatgtttcctataaatcagcctggtgtagtactaataaaaagtaataaggagaaaatattttaatatttacatatgaaaagaagttcatgctaaattttacaaaaggcagttgtacctgctaattggatgtgttactaaacataatttatgcaaagaattcaccttttggtgtaacctaatatatatatcagtcattacattacattgatattgctagattatggtggggatcaggtctccctagcttactgcctgatatgtaagtatgcaagaaatgttacagaatggagatagaaggtaaagaaagacaaacgtagagtaatgtggaaaggaaggggacagagtgaagggagaaaataaagaagacagacaaagaatataaaggaatgagaaactagaaaaaatagaatgggagggagggagaagaaagggagggagggggaaggaaaggaggaagggaagaagtagaaacagaaagggagaaaggaagaaaaaagagaaagggaaaaagagagaaagggaaagaaggaagatgtgagaaagtagaaaagggagagaaatggaaggcaggcatactccttgccctctttttccctttctcctgctggcaaagcctgctcctcagccagatgaaagatttgttgtcttaagcatgccatgttctgcaggtctcatagctgcctatttataccaacccttttcctcctggtaaacttctcctcattgttaaacattcaaacagtagtgcctcccctagtccaggtgcttcaggaagaatcagagacaccggccttcctgcttccctatgacttctgctgtctcagagagtcaagtgaagttaccattagatacttttctcattattgtgtacctgttgctgtagtgataggtggtctccccattacggtgtgatctccttgagtcaggaaatggtctcagcactttgtattcctagattcttgcacagggcttggttcacaggaattattcaataattctataaattatcacattcagttctcacaactaaccatgtgaattaggcgttatattctacatttcaaaagagaataaacctcaattcagattatttaagtgacttgtacagtaacactcgtgtaagtgagcctgaaaataattcttttgttttcactgatgagatctagaattgaaataataagttctaagaattaaagtacaacaaactcccatgacacaagtttatccaagtaacaaacctgcacttgtactccaaacttaaaagctaaaaaaaagaaaatgccaccaaaagttctttaatgtatttttaaatgataagtggaaataaggccaaattgtggctgtttcattgtgaatttttgagaattgtattcttcccacgtatctatatgagaaagggaaaatttgtgttaatttatgaaacagaaacctaagatgcgccatgttctcttatttgttatttataggaactggcttataaaactggggcaaaaataaaataaaaattctacaactgaaagcatttgcatttgttttagacatagagttttacatcaactaaagatttgtgaatttttggtgtgttctttcatatattaattcaataaatgtttcctgcccatatatgctaagtaagcactgactctctgtttaatcttactttagtttacacttgttaaaatattttcccatgccatacatttctagttcaaacatggaattaattttctttggtggctttttgttggttttccaatcttatattttgtttattttgcaataggacgtcgagtttaagtaaactatgtgttcagccaaggttatgcattcctcttgttttataaattgtcattattcatacaagactttgctcttttctactgtattatacagtattttgtgattttctttattttgtcttataattacagtttgggatatatattcagtatatcattttatatttgaccaaaatcacaaatctattaatattgctaagacagttttccaacagagctatgatttccgagtatttgccctataacttcaaggatacaataaaatttaacttaagggcttaaaatctaagcagaactggtgctgtttcatcaggcaatgcattgaatggtttataaactgaacatgaaaatgtctaaaagaaggcgtctcccagagcccattaaccttcaagacgccttagcctttctctttttttttttctgacatgagtaaagtgaacaggattttaataaaagtcctgcagcagatattcctgaaaggtcagggctcatgataaagctgccagcactgcaactttaagaaaagagatcccgacgacctttaataacactaggtctgccagtgctcattgtagaggatctgtattttaaaattccatttgagaaactgactcccccatttgacaggatcatggtctttaatcttacttttggtgtgtaagagctggcggtatgccccatggaaacttgcattttgtatgcttctgaggaccttgggaaataattttctctagtgatagaaatgcttccccgtcttcaactttgactttctgatcacccatttcattaatactaagtacaccatatctgaaagtagaaggaatttaatattgaagaagtagacttgattcaccaaagcttctatttcatttattttcattttcgttccttaatctctcttcagctttttatagattgaataactctgaaatcaggaattagtgatatacaacagtaatttccacatctatgttttcactagcagaacaaaggtacaattattactaaaaatatatttgttattataactccaatttaataaggggtaaacaaagactttaaaaacttcagtaagttgctcgagttaacataggtaataaataacaatgccagaatttactgttttcagatcactcagtttcaaaacctcatacaatttccattctctaagatgtacatctacatttctgtcttcatcatctcagtttaaattaaattaacaaataactctttggaagctagaataacattatgagtaaaaagtaaaatcttgatgtaaactattccagagaatagaaatagagggaaactttccccattctttttgtgaagtaatttcatcaatgaaaaatctggcaaagaatttaccaaaagaaagcaaaaacaaaaacaaaacaacaacaataacaacaactcagaccactctcaccagagtgccaatcgaaagtcttcaataaaataacactaaataaaattgaataccacattataaatgatatcacaccatcaagtgaagattcttctagcaagccaaggccgttcaacactaggaagtctaatagtataattcacatcataataatagagccaatgagtaaagcaatatcataatctccagagatgttgaaaaggcatcagacaaaattcaatactagtaatttaacaaaaacaaaaacattctgtaacataagaattgatgaattgatgactcctttgtaaacatgagagtgtacttgtatgtatgtatatgactatatttgtatatatagttttgtttatatcttcatcaaaagccatttatatctccatcaaaagcagtatttagccagcatcttccttaaaggacaaacactagagacctttccactagaacaagatggtgctacccactgtttttactgtgatttaatattatattggagatctatgacaaagaaagcaattagaggcctacaacttggggagacagagctagaactacctctgcttacagatgatattattagttacttgaaaactgaaaagtatcaatgaaacaactagtatatagaaagagagaatttaagaagatggcaagcataactttaacatacagaaatcactagcctacatgtaattacaaacagttttgaagatattatgaaggtgagcagaaaaccttttaaccttaattccaaataatagtttttcaattttttttctttcattggagaggtggggcaagtgtgatgtgtgcctagaacaatgagattttgtgactcagaagaaaggaaagaggaaacatctcagtagagaaccttgcatggggaagagggaaatttgttgctgtgaagcagtactttagaaaaattaatcacagaaaaaaatacaactagatactttagaaaaattaatcacaggaaaaaaaatacaatcaggatgcgatgagaacctgaaaaggtgaagcagcagtgttaatggaatggacgggataataggagacatttaaaaggatcaaccatattaatggctggaatcaaacatttgtagaaagaagtaaatcaattaaggcagggacagaatgttaaccaggaggtctgtataatcatttggtgataagtgtagaaacaccagtaaaaggagtgctatagaaattgtggtcaataactattccactaagagtttctactagttcacatctcttgatgaaaatcatttaaaagttacaaagtagtcaggccttcgatatgaattcaaaactaactggaccagtacttttcctttttttctgatattttcctttgttctcatatgtctattccaaaaagccaaatataaatgcctttcatttcactgtgtcatgctgagaaaggcaagatgaaaagggcgagaacaaagaaaaagaacagatgaaaaagtaatgttggaagttgtaaaggagttctctgggcttttttcccatcacttacaagttggaaggtgaaaattaaagctcaccagacatcaagaatgtcattttccttcgactcaatgtgcttccattttgggttctttgcagttgtaacgctcagccggaaattcttcttccgccatatcctacatcgctgatcacttggtcaaatgccacatcaccagaaaagcccatctcccactgttctgtatcccctgaaccttgctgtatttcccactgtagcgcttactgtatatttagttcataatttatctcctgtcgtgagactacaaagttcaagatatgagaggttttttttcctgtttttcttatattcccttcgctgttgcattctgagagcctgaaactgttatctgccatatgataggcatccacgagatattggttaaataaatgaatgaacaaattaatgaatgagcaagccctagaaacagtattctacaaagttcttacaattatattttattttgtaatcaagacaatttcaagaaagaaaaaacaattagagcattttccctttaaaaaatactaagcaatatctatgctacatagtttattttcaatgaatcaacaaaaaaaaaatctgatctttcttgaattcttgaagttgaccagttttttcaaaagggaggcagtgattagttttgggtggccacatctcctcctgcctgtttccagctctttctctttgtattagggtatttctccttttcattcagactcacatttgttaagcttcaaagcactccatggtttattatggatttttcactctaggaaagaggtcatcactttattaaacattaaataatggtgataatcaataataattgatatattgtctctattggtactatcagaaaaaacaaacataagcatttcaggttactatgtgcatcaagaattctaatgttttgaaaatctgcataatatatcaaatgtgctgtgatttatttatctacctgtttagtgttgaacagtaaattttattccattttttggtgttataaatagaaacgtggatctctcttggcacttgtccttatgtccaatttcatcccaaattcatgcaaaattaatcaaattgcaagctcttgatgcatagactcacaagcaaaagtctacttattgagatactgtgttgataacatgatataactttcatgttgcttctctctaacttatgaacttgttgtcctttcatcagtgaaaatgaaaatgaagaactatcacttaagaaagttctactacagatacaccagggctttgatatcagacttgacctgaagggctcctctagttatgagctgagggatgagaagcggacatgcaggaagatccccttggcatggcaacctttgcaaagcactgcctgatagtctccctcctgctgtgcccagtgtcaagagaatgagcttataatattttgtaaaatatgtagattgagaaatcggaatctcatttatcccagaaaacagatttcctagtatcaatatagcttaactttttcttgaaatgaaggtcattttacgaacataaatttttctccaaaatgaattcaaacagaattttaaaagtatggagctggcataaatattttgtgaactgaatataaacactttgacttcatttctcatatgtatttcacatgcatgaaatcaagagagaaagaaattccattggcattcagccaaggaaattgattttttttttaccactgtgccactatattatggtttattatctccagaatattactctaaatagtgctacccaacagaattttcagcagtgatggagatattctgtatctgcactgtccaatatggtagcctctagccacacatgattgttgaacacttaaaatatggctaatgcaactaactaaggaactacattttaattgtatttaattttagttaattttaattttggttttaatatttgcatttggttagtgggacagcccagccatcgggtaggtcattccatttctgcatttcttttatcctctctccacattctgcttgaaagctgagaaagctgccttgtacctccagttctatgatttcactctggatactgctagaaaagtagccctttacctatgacagaatggtggtttccagaatgtactaatccccaaacctatgaatatgtcacctgacatgacagcagagactttgcagatgtgactaaattaaggatcttgaggtttagagattatcttggaaatgtgggtgagctcaatatgatcacttttcagagggaggcagtaaggttagaaatgaagaggagatgaaaagactaccaggaccaaaacaggatagagaggaaagaagatgctacgttgctggcttgaatatagaggaaatgggccatgagccaaggaatgcagactgcctttcgaggttggaaaggcaaggaaacagtttctctccaacaagaacttccacatttgaaacttctggcctccagaattttaagacaataaaattgtgttgtggtaagccactaagtttgtggaaatttgttacagaaacagtcggaaactagcattctgtcctggaaaatcacttgttcccaggacactgatctgtgatgaaataggtaggtctgaaacaggaaaccaaacaccgcatgttctcattcataagtgggagttgaacgatgagaacacatggacacagggaggggaacatcacacaccagggcctgtcaggggatggtgggctaggggcggaatagcattaggagaaatacctaatgtagatgacaggttgatgggtgtagcaaaccaccatggcatgtgtatacctatgtaacaaacctgcactttctgcacgtgtatcccagaacttaaaaaaaaagaaagaagaggaaaaataggtctgcggtgctgctccacagagagcggccaggaccccatttcatctgccaaaagaaaatgtatacgcagactcgtattgctggagtccattatgccttttaagaactatgcctcttaaacagtacggtgcttgtgggtaaatcatccctgccatttttcctattcaaacatgttctggtatctactaacacaactgtattaggtgtgtaaaaggcatctcttccctgagtctaagcagaagtgctacctcgcccccctacctcccatcaaatctgtggctgcataaattgactttataaagaaatcctgctttgcttaaacagctttggaaagctgtttaatatatttggccgtaattggttttgttttaccatctggtttagacttccccctcagccaactttaattttgaagttaatcatttttaaattgggctttgaatgcacctaggtcagatttgccacatcagaggagagtttatgtttgcattattctcaaaaagattcttcagttttgctttgttttttgcagtttatttccctatgtgagtttcatttaaaggaaattggtgcctatactaatagctgagtattcacatgtgtggaagactttccttggcattaaccattagataccatctgatgcagctgtcagtgacattggatgtgcatggggctgtggaattgaatgttgaccatagtattctgcatctagttagggaagtcaagcagtaattttgatctttctacttagtcaattgtttggccgaatacattgacttatttgggagagtagaactttttttggtggagaagaagttgtgtcgtgatggtatattttgagttaacctcaatcatgacaaaccagaatgatttcctagatgcacagagaaggaaaatgttaaagactctcaattgctttttaatatataatatgcaatatggaaatctgtcacgacacttgaaaagaaaacatttataagtgaggcctgcttcacagtaatgacaaaaacaatagacactaacataaataaataaatacataacaaaatatttgccaataaactcaagtttagatttcagtaattaggtttggaaatgcatctttgctactgagacacaaacccctaaaaacaaacagttcattggttgtatgaaatgctgagaaaaaaaatggtttcaaaaaatgctaatgctgtaataatttgaagagaataaaagtaggatcaagatcctctaaccaggatcaaattattgcctatccatttttctgaagggcaatcagacgatttttatgtaagataataaatctgtagaagtgaactgtttgtaattaaacatggcacatcatttcatgaccatttataaagtcaagtgcttgttaacaaaaccgattttcattgttattactttctttaaaattattttcatgtgagatgaattcttttcttgaaagtagtccagctttgggggcattctgaaatttaattatcctgggcttgaaaaaaagctacgttttgacttaccatgttttttgtttgtttgtttctagtgaactgaagaataattgaataatgagtttatagtaacaattttataatatgcatatctatcatagaacaggaactacagtagaatcattggtgcagtcttgatttcttaacttaaaactaaaattagggattgagtgcctcattcgaaaatagcagcatttaagtgaatgtagagttaacttataagaatgtgaacaatacaatatctttccaatatttaatgttatcatttgtcatatataaaaataattaaaacatctctttcctctcccagttttactttcaaagtttcagcaatagtcgattccctgcatacacaatttaccatgctgctaaaagcctttatacctaattttgcccacactgctctcgtgacccagagttccttttcatattcttaaccctcatccaccctgcaaactcagctcaagcaccacatctaaagagattccagaaggacaagcctccccatcaccaccatagatagcatcatatatatagcaaccctgtatgccccacagtatcctgcccatgcgtctacgaaaacacttcctgcattgcacggaatttgccaaatttgcttagagtccccagtgcttcatacagtgcatgaaacataataggcagccaataaatacccttttcatttataaacaagaatgtaaagtactgcttacttctcactagtggtttcttcaatagaccttaaagataccttctctagaaagcatttcattttccagcccctattaacgttagccaatttacttatacagtcaatttcatgttttgatttgaatgtatgttctcaaatggagccctaaagatatcagtacatttaattccatataaaaacaaataaaacagtgtttagcaattgacgttgggacataaacagatgaaaaaggcagttgtcatataccatagtaaccagaacttccataaacgagttaagacctttaaacgagaatacatttgaaatgatttatttctataaagtcttgcttagttgagtattcacataaatagtgacaatattgtgtaatcaatgggattttttgtttgtttgtttgttggtttttttgagatggagtcttgctctgtcacccaggctggagtgcagtggcgcaatcttggctcactgcaagctccgcctcccgggttcacgtgggatactatattctaacaagtgtatcgagaagtaacagttatgaacacacttgttttgaatgtgctgtaaataacaaaatggtaaaactgttttatttgaattaacacattattaaatgggttatgttccatctttactaaaacaaagcatgagattatgatgaaagagtaagcgtgtaagtcaccagttctatctcccactacttgttgacatttatgagatgagatttgtgccctgggtcctctatcattttttaacagaaaaagaaacaagtgtgaagaaggctagaaggcaaggattaaggatattaatcttagaattgtatggcaatagcaagctgtgagacctttggaaagctgtttaatatatttggccataattaagtgcatctctgaaggaactattaaaaacagatgctttaaaaaaatgttacaaccttgaacttttttgattctttttgggcttgaacatctaaaatagatgaggagaagttccttaaactgttttcttcaactcagtcattaaaacacatttattgagcttctactatatctcacgtgcagacccaggtcttatagcaataaccctcccccagaaatttagaatctaattggagagagagtaaaatagagataaaacaaaaccctgtgtcatgtacctattaatccaatatctcttggccttctgaaggatcagaaaacttaactccctgccttctttcaaacatgttcaaatcctccaactccagtaacatagatctcttttcttcactttttggcaaaatcaacagcctttttgcaaaccgtatctgtcacaaatggcctctcacagagagatttctagctagctcaatttacaacaaacattgccttccaaacggaatagcaggttttccaggaaattaggtaaaatagcaaggaccataacaaaacagtagtaattgtttaaatagtttaccacaatatttattttggatcagctacaaaagtaatgtcagaaacttcatttcagtttcttcagtctacaaatactaaaaatctgcataaacacagtatacctatttggccccactactaaaaaaaaaaaaaaaaaaaaaagagctagagccagacattagagagaatgtgtctggccaaaagacatcccaattgtttaaagacaatacatatgtgtgtgcttgtttgtttattggtgaataagaattatttaagtatatattgtgtgctttccaaggatctctgattggcagctatgattctccactgtaacttatgacaattctgtggcattaaaaagtactagggcagggtgtggtggctcacacttgtaattccagcactttgagaggctgaggctggtggatcactaggtcaggagatcaagaccatccaggctaacatggtgaaaccctgtctctactaaaaatacaaaaaattagctgggcctggtgacgcatgcctgtattcccagctacacgggaggctgaggcaggagaattgcttgaacccgggaggtggaggttacagtgggccaagatcgcgccactgcactccagcctgggtgacagagtgagactccatctaaaaaaaaaaaaaaaaaaaaaaaaagtgcgtgtttgtgcccaagtcctgactgtgtcacaaatgtgctatgtgaccttgagcactcttaatatcatggaattgccacaatttttagtttcttcatctgtaaaataaaggcattaaataaggagttctgtaatttttctagctctaaattttaccactccatttcagtggtttgaattttctttgaacccaggagaagtgaacagatgtggattttacaatttaaaaatttaaagcaacagaaaagcatacacacatgcatcatgacaatttcatagcagtgtgattttaacaggctgttaccttaaggtctgaaacaaaaataaaaagatcttcaaccatattcataggagtgaatataacattagatgtctaagactgtgtaaacaatcttcatggccaagaggctcaattataatgattctctcctgatatgtatttcatttgatgtgatacatatacaccatgaaaaactatgcagccataaaaagagtaaaatcatgtcctttgcagcaacatggatgcagctggaaggtattatcctaagtgaattcatgcagaaacagaaaaatatcacgttctcatttataattggaatctaaacagtgggtatacgtggacacaaagatagaaagagtagacactggggactccaagagtgggaggaggggcagagagacaagaggacatggttgaaaaactacctacggaaaactttatttattatttgggtgatgggttcaatagaagctcaaacctcagcattacacaatatacccatgtaacaatcttcacatgcataacttgaatctaaaattttgcttaaaaaggaaaaaatgtatatttcatttgagatttcccatcatctacagctcttataaattgcagtgatgtcagtggtctttgctgaagattttatgcgcataaattgtgttctcatagggagatttgacttcatatcttggctactgacatagaaacattttttatattatgcgcataaattgtgttctcatagggagatttgacttcatatcttggctactgacatagaaacattttttatatgtctaaatggcaaattgctcaatttaagcataaatcaacaaatgtatcaccaatatttcagcagacgctaattctttttcccgtatcatttaaaaagttattagatccgctggcttgatggggtcaattccagtttttaaaatcttggtccacgtgtctatgtgtctttggacagttctaggcatccagtgccccaaagtcatgggagacttaattcagcaaatcatatgctaattgaatgtcttccctggtgcagttcttccctggttactatttttacctttcctttttaagagttggggcaaaccttatggtatcttctgaatacaagtcaatattcaatggacgttttaaataagttaattgtatctaatgtgtgtgtagctcaatgtaaacattgccatatttatatctactataggagccaagggccctctcaaagctcactgaaaaatcaacttgcaaaaagcatattggagaaaaagcatacaaatgtatttaatgcatatacatgggagcctgtagaataaaggccaaagatacagaggaaattgtccatttttaatgtctacgttcaaccaagtgtggacagccatctagaaacatgattgaaggaaaaaagggcctgatctaatgctaatagatttagtggggaaacccaacaaggcctaagttcttcttggcctctctctacagcattccttctttcagggtatggaaggaccctctctggaatggaggttttatgacctacagtcaaacaatatacaatatatcaattgtatattgataatttcttatggccagtttttacacagaatggtggagggaaaattagagtgatgtttttaggttttatggctggctttggggaaaaggggttctggtttctatgacccactttggggaagagggattctagtttttatgactaaccttgggggataataggatctagacacaggagagcaggaaaagtacagagaaaatcttttgcttctgagactgccactgaggccttcatttgggatattgttttctgatccccaacatctgagcatcctagaaaataaaaatttatgcagtggctcattcctgtaatcccagcactttgggaggccaaggtgggctgatcgcctgaggtcgggagtttgagaccagcctggccaacatggtgatacccccgtctctactaaaaatacaaaaattagctgggcatggtggcgggtgcctgtaatcccagctactggggaggctgaggcaggagaatcacttgaaccccaggaggcagaggttgcagtgagccaagatcatgccattgctctccagcctgggtgacaagagtgaaactccatctcaaaaataataataataataatttactaattacacacttctgccttgggagaatatcttttatttaagttaatgtatcttatataggcttttagaagccatttgtgtctccttatttttcagaatactgattgcagcatgtttgatactttttaagcaaaatcacactgaaaataagacatttcaactgttcttcattagtgaatatttgggagagcagaatgcaatgatgcttatctaaggggatgtttcagtttgatttcagggctgtaaaaaatggtgaagccattaaaagagacatcccacttcaaatgatatagttatatttgtaaattgtcctattttgttaaacttaaaacagttctatatttaagtaactgtaactacttgtaggcattcggaagaataaaccttaaaataatttattgctttcatggtgattttattgaaaacgtcacttcctttaaatcatttcatcaattattctcataagaaaatacaatgtcagtgaaataaacagaaaatcaaataccacatgaactcacttataagttagagctaaatgacgggtacacatggacactcagagtgaaataatagatactagagcctccaaaatgttgcggggaggaagtattgaaaggtcacctgttgcgtacaatgctcaccatttgggcgacggatacattaaaagctcagacttcaccatatatggatgtgagacatctgcacttatacccactaaatacaaataagtaaatgactgacacgatattatattatccaataacaattactcatactagtaatttctttaagaaagaacagctgtggctgggcattgtggctacacctgttacccaatactctgggaggccaaggtgggagaattgctttaggccagaagtttgacaccagcctgggaaacatagtaagaatgtgtctctaaaaaaaattttaaaaatcagccaggcatggtgatgcatgcctgtagtcctagcttctcaggaggctgaagagggaggattgcttgagcccaggtgtttgaggttacagtatgctatgatcacagcactgcactccagcctgagcaacagaactcacatctgtaatcccagaactgtgggaggccaaggcgggaggatttcttgaggccaggagttcaaggccagcctgggcaacatagagaccccatctctacaaaaaaaaaatttaaaaatataattagttgggtgtagtggcacgtgcctatagtttcagctatataagaggctgaggcaggattgcttgaccctaggagtgtaaggcttcagtgagctatgattgaaccactacagtccagtctgagaaagaccctgtctcaaaaaaaagaaaacaaaatagaatacttacaaatttatggtgttttcattcttgtatagctttggtattcttgtatacttttgatattacttgtatattgattaacttgtgaaaatatatctttgcttaactattgggtttctccaagtttggtcttgcttttctaagtgttgtatctatatataaagccttcagtaattttgcaggtaacgggacttatgttaaatattgtcttttcttcatctataaatgaaatagcattctgatagatgagattatgtaaatcctttagtcagacgattagacttactgcataattatattttagacatgagatcatatagtagcctcaaattgtatgacagatttgagagaaaagggataaataatctaaaactcacttgaaagtcagcagcctgagacattctctgtttctgtgtacaaatatgttagaaaaatggttctgaaacactttgacattcctcactacttaaagattatgtaagaaagtagcaggatggaaactgccttattattttcttttttcttcttcttcttcttcttttttttttttccccccagacagagtgtcactctttcacccaggctggaatgcagtgacacaatctgagctcactgcaacctccgcctcctgggttcaagccattcgcaagcctcagcttcccaagtgcgccatcacgccaggctgatttttgtatttttagtagagatggggtttcaccatgttggacagattggtcttgaactcccaggctcaagtgatccacccacctcagcctcccaaagtgctggggttacaggcatgagctgccgtgacagccaaaaactgccctattttcacagtgaatacacaaaagagctataaaattaaaacatgaagctcctttgcagtaatcattaatggagcacaaaaccctcaagccagcctatgaaatgccagttcaattccgtgtccgttctgtaattcaggaaaaactctacaaaagtatcttacaaaggaagtattctgctttactaaatctttcctttaatgaaatactgatctgaaaacccctaattgaagtaggatgaaattcattcaaaaaatatcaagcatgtgccaggcactgtatgccagtgaacaaagatgcatgccttcactgcattttagcagagggagtaaaacaaagaaacggcagggcagagcaccaggatgtcaggctgcaattttttttttttttttttttttttttctgtgagacaaagtctcgctctgccgcccaggctggagtgcagtggcgcgatctcggctcactgcaagctccgcctcccgggttcaagcgattctcctgcctcagcctcccgagtagctgggactacaggcgcccgccaccacgcctggctaattttttgtgtttttagtggagacggggtttcatcgtgttagccaggatgatctcgatctcctgacctcgtgatccgccctcctcggcctcccaaagtgctgggattacaggcgtgagccactgagcccggcccaggctgcaattttaaacagagcgattagagcaggcctcattgggatggcatttgtgcacaaagtcaaaagtgatgaaaaaattatccatgaagttttgtgggagaaaagcattctaggcagacactagcagtcacaaagatcccatggccagctacactggaagaatagcaaagatggccgttgtggacaaggcagagtgagcaggaggaattcaataggaattgaatgaggtggggtggagtgcatgtaatttagggctccatagaccattgtaagctttcttttactcaggtaggaagccatctaaacaagacttagacttttaaaggatcagcctggttgctatgagagtagaataggttgggtgagaagagacacagatgaggcaaaataaacaccagccgggaaaccacagaaataatccaagcatgctatgatagtgtcttggatgagaataatagcagtagagatggtagctatggtagtgtcttggattagggtaatagcagtagagatggtagctatgatcgtgtcttggattagggtaatagcagtagagatggtagctatgatagtgtcttggatgagagtaatagcagtagagatggtagctacaatagcgtcttggattatggtaatagcagtagagatggtagctatgatagcgtcttggattagggtaatagcagtagagatggtagctatgatagtgtcttggattagggtaacagcagtagagatggtagctatgatagtgtcttggattggggtaatagcagtagagatggtaagattttaggtaagattagatgaaggatgtgaggagtccaagatcatttctgcctgaaaagccagaagaatggagtggccattaagtgattgaggacgactgagaagaaaaatttcagaggcaaaaatatgctttatttatttattttgaggtgtctagtagatacctaactgcagatgaggtggggtggagggcaggtaatttagaggttaatataatctgatgtccttataatgagatgagatcaccaagatgagtactaagagaggaggcaagcagcccaaggtcgagctcgggggcacaccgatgttttatcaaaattcagggaaatgaagattgagccggcagcaaaagacagactgagaaggagcagccagtaaaggagaaatgtcaagcaagtgtagaaatttgcaagccaactgaagagtgcttcaaggttaaatgctggctgctgattagatttaacaatgtggaaatctttggtgagttttactaggagtagaggagtggagacaaagcctaatcacctgtcagatgacctaaccaagtgtccaaacttaacagcctgaaaaagccataactgtatgatgcaatatggagaccatagcatcaccttgcactcttgcatacaaagtttaacctgaaacttaaaaaatttagacctttcagtttacaggaagttcaaagggatattagaagttaaattaatgacactacaaaggaaaactctacaagacaacaggcctagtatttccagaaagtgagaatcttaaatgaatcctgtttgggggatgagggtagctatttacaaaagagacacatggaaaaatctgaaataagaacttgatgttaaattagggaagtattttaagtggggcagtggtattgagaatattatatagaatcatgttcttagcagatgtatgtttaagtattgtcgtgtctacgactttccttgaaatatttcatgtaaagcaaatatgccaaaatattttaaaaaaagaaaagtggttctgacagccatttccaactattcaaactaattgatattcacttactcagaacttcttcaaccattacttcttgagaacctactcaatgccagacagtattctaggcaagggataaagtgtgttgaggaaacagacatgttccctactctcatggaaattacaggtcagtgaataagactgacaatgaacccgagaggtatagaactaaaaagtttgataaattaaagagaacaacaaatggtaatgtagatgaaggtggtgactacctcagattgggaagacagaggagaaacgtttgggaaattgcatttaagggaagaaccaaaaaatacagatctttttgtaaagattgaggaaaagagtgtatttgaaaaaaagaagcatgtgtgcaaaggcagcctcacacttttctgctcagtgttcagttgacacctgcccttgttttgcttcttcgtgggttatgctatagaagaggagcatgaggcagcagtggagaagcaggtagcagatcatgcaaaaacatacaagagctcatttcttcctaaatgaaaggagaatccattgaagtttttctttttttccttttttttttttttttttttttttttgagactgagtctcactcagttgcccaggctggagtgcagtggcatgatctcggctcactgcaacctttgcctcccaggttcatgcgattctcctgcgtaagcctcctgtgtagctgggattacaggcatgccccaccacgcctggctaatttttgtatttttagtagagatggggtttcacaacattggccaggctggtctcaaactcctgacttcaagtgattcaccgacctccacctcccaaagttctgggattacaggcgtgagccaccacactcagcccaacaacgatttttaaagtagcgtgacatgtgaaagatcagtctgccattttattgagaatgaattaaagcaaggcaagatttggaaggggcagtctagtcaagaagctgcaaaatggggtgggtggggttaggaggttgaactggagtggcagagacacagaaaagtggacagattggagccagtttccaaacttctgtttacaaagctttgttaatgattgatgcagaagtgaaaggaatgtgaagaatgacttctggtttcatggtgccatgaactgtgatgagggtgagcagaggagtagcaaaattagagaataacatccaaagatatgtttgatcatattcacccagcaatgcctctgatacctctaagtgattatatcaagaagcaggtggagtgtccaagtttcaggctctcaaagtctcaactagagatacaagtttagagccttcttagagaaagctaagggctgagccctaaggatgccagaactcagagttgaggcagttaaggaggggccaggaagaaacagggatcaactcagggcaataatgtgagttcaaatacgttcatagactgagaaaacggaggttgtgaatgcctgtgagaaaaggagcttttgtggacagatgagagtggatttcaggttggagttgactgaagtgttaagagcttgcttcagtgaatctttcaaggagtttgtctatgaaagggattagggaaattaggaactggagagggttatggggccgaaagggagagttttgtcatttgttttaggtaacattaatgaccacatattgagagaagtaatgcagaagaaaagttgataattctggaaaagtgtaagttgaatgggttgacaaagccagaggagataggacacagagctcatgcccacagagacgctcctttcaaatagcggcagcaccgggagagtttcctctgttctggttgtgtaattgtgtcgagggtccaattaccttcctgaatttttttttaatgtaagtaatttgttttaattgacaagataatgaatacctttggtttaatttatttttaataatacgaaagggaatatggtcaaatataagttttccctgcacctcaggtcctctccaaggaaaccactgtaacagcatccagtgtcttcctttcagaaatattctattcacagataagaatatttatgcctatgtagatagatagatatggatataggtgattctacatttctgtggtatcagtcacattctgaagaggacagaactgatccacttaaattcgggtgcggtggttcacacctgtaatcccagcactttgggaggccaaggcgggcagatcacctgaggtcaggagtttgagaccagcctgacaaacatggagaaaccctgtctctactaaaaattcaaaatcagccgggcgtggtggcacatgcctgtaatcccagctactagggaggctgaggcaggagaattacttgaaccttggaggcggaggttgtggtgagccgagatcgcaccactgcactgcagcctgggagacaagtacgaaactccgtctctaaaaaaaaataaataaaaataaaaaataaaaaataaagttttgtttttacaaatggttgaattacaagggataaagggacctacacagataatgcaggaatccagggctggcagctatagagctcacaccaccctgggcccaaggatatgatggggttgcagagattagagagctcagatgtgtttgagaactgaaatgagccacagttttttaaaaagtgtgacattcttggccgggcacggtggctcacgcctgtaatcccaacactttgggaggccaaggtgggcagatcacctgaggtcaaggagttcaagaccagcctggccaacatggtgaaaccccgtctctacttaaaatataaaaattagttgggcatctgtaatcccagctactcaggaggctgaggcaggagaactgcttgaacccaggaggtggaggttgcagtgagctgagatcgcaccattgcactccagcctggggaacaagagtgagattttgtctgaaaaaaaaaacaagaaaaacaagtgacattcttgtgacaaccaaaaacactgaaaataaaaacaaatcattataatatagtgtagcacagagcagacaagagaagtgactttcttactgaaggctgactgaggcagtctcacaagaaagaaccaggaaaatgcataacctgacctaaatcttctccccactctaatctgctgatagggtaagctcaatcaaggagaagtttaggatctctcagtgtactctgccttatggagctgagggcagggaggggaaagctgaagagtgattcttggaggggaaaatggagatttctgaccttcatgcatcaccacaatcaattcactattcacacaacagctagaacaatcgtcatttaaaacaaatggaagcatattataaacgctgttctgtccctcttgctttcttcccctggcaatatatttttgagattgtgtcttatcagtacacatagatctgcgttgtctttttaatggctgtcaggggttacattgtacagactcccttaatttattactaagtttctaaccaataaatatttttccctagattttttggctgacacaaacaatgatgcaataaacatttttaaatatgatttggggaaagtacactagtgcgtgtataagataaattcttagacatgaaatgactaggtctcaatatatgcacatttgaaattaatagactttatcaaattgttctccagtgtgcactctgatcaaaagtgcatgagaaggcttttcccattaaatatcagagagatgttcaatgaatctcattgaaatttaatttgggctgctttgattatgaatgatgttgaacattttctatatgtttaaaagttatgtgtttttttttctgtgaactgccctgttcaaaccctttactcatatttcaattatattgtttcttattagttcctgagtattcttcataggataaagaaaatggtcctttgtctaccatattaaaatatgcttaccaatttgtctttgtatttggctatgtttggtcactcaagatttaaaaaaaaaatatgtagtcaaatttattaatggttcctggatttgtgtcttcattagaaaggccctctatattagttgtttataaaaagtattccaccataccttattatgttttattgccacatacgtttaaatctttcatctatctggaatttattttggcaaaggaagaaggaggtctcactctttttctcacatgatagctgattgtcttacatcatttactaagtaaagcactttctccactgacttaacactgttaacctaatttgtataagtctttgtatttatttctggatttttaattctattctattgatctatctatattttaatacaccaatattagtttatatttactgtgggtctagtaaatattttatctactatcgataatcttacctgttaagctttaatttcagaatataatatccccgcctctgtttatttttattttttatttttatttatttatttatttattttgagacggagtctcgctctgtcacccaggctggagtgcagtggcacgatctcggctcactgcaatctcctcctcctgggttcacaccattctcctgcctcagcctcccgagtagctgggactacaggcgcccgccaccatgcccagctacttttttgtatttttagtagagatggggtttcaccgtgttaaccaggatggtctcaatctgctgacctcatgatccgcccacctcagcctcccaaagtgctgggattacaggtgtgagccaccgcgcccacctctgtttattttttatatcaattttagatttcatcatgactttttaagtttcccgttagtagtgtttgtggttatattctcccaacatctaggtaccttggatgtctttctcgcttcctctctctatctctcatcttccttctacctacatctcactatatactctctctcctagttcatggctacccataaacttttcctagtctgcccctgcagtgtgtaatcaaagatacaccaggttggtcaggcgcggtggctcacgcctgtaatcccagcactttgggaggccaaggctggtggatcacttgaagtcaggagttcgagaccagcctggccaacatggcaaaaatctgttttctactaaaaatacaaaaattagccaggtgtggtggcaggcacctgtaatcccagctactcaggaggctgagacaggagaatcacttgaacctaggaggcggaggttgcggtgagctgagatcatcccactgctctccggcctgggtgacagagcgagactctgtcatttaaaaaaaaaaaaaaaaaaaagatacagcaggttgtggtgaaataaaatgtatctatggacgtgaagcagataactcaaacttgatacttaaaacaagtatgttacatattcctgtgcatttcagaaaatttactttggggcacaatatttcttgtatctttttgttatcgtcatcttttttcctccagtaaaagagatgagatggaaataaggctaaatatttttttggggagaaatatagtttacaattattctaaatttaacccattttgagaaaacaaattatgaatttaaatttaaaatttacttttttaagagtttctatcaaaacctatcaggtttgaaacttccttgttatataagaaaaagtataacctcaaactgaaaatgccactgattatcactggtttctacacacagaatatctgaggcatcttaattaatttacctccaagtaatcaattaataatgtaacccctttaatccttttgggtttcttgtggtctcattctactccaggtttttaagattttctacttggagcattaaaatagctgttgagtttattttgcctttagtttttccctttcctgtctatcctgcacctattactaccttaatattttaaatatgtagttatcaagtaagttcatttttgaagactttcagtgctttccatgcctagtaaaaaatgttctaaatgccaaagctagttaaaaccattcaattaggggtgaagagaatatatctccgtggtgcatctcttgatggctggctttattttgcctctggataaagttcaaaaatcccttgaacagtgaatggactgtatatcatcacacaatctcccagaaatattgtttcctgctatttaacttcttgataagaaaccataatcaaatggcagagtttacaccgtaggtactcaataaatataagtcgaatgaacaaacaaagctacattctccaagaaaatccctaatgtaataattaatacattttgcaatctgaacccaacctatggttgtacatttaacatctatcagttcagttttttcagctgcatataacgcaacacataaatgacttaaataatagcagccaccaaatgtattatgtcataataagaaggcaagatataggtccacatcaaagtagaggaactgcagtcctattttagttaggatatgtatatttgttgtttttttctttttctttctttctttttttttgggtggtgggggagggagtttcgctctgttgcccaggctggggttcaatgacatgatctcggctcactgcaacctctgcctcccgggttcaagtgattctcctgcctcaccctcccaagtagctgggactacaggcacccaccaccacagccagctaatttttgtatttttattagagacgaggtttcaccatgttggtcaggctggtcttgaactcctgacctcaggtgatccatctgcctcggcctcccaaagtgctgtgattacaggtgtgagccacagtgcctggcctatttgttgttataataaagacccaaaataacagtggcttaaaacatccagaattatatttctctgtcatgaaaacctttgggtaggtggcccggggctagtatgctacccaaagctcagattacttagatattttcctttcattcactgaatgaaagttctcactatcacaggttcatttctggaagaagattgggaaggacaaaaaaggagaaatagttcatatccttcccctttaggagcttcatccagacattgcacatggcacttccattgccttcaacttagccacagggccatgtaacttaaagaaagcctggaaaatattgtctgtaactggtggggttctatgtcaagacataaattctattgctatagaagaggactgtaaattttgcataacaatgtgcaacagcttaatgactttgttaggatgcctgactctttccttcttgatccttggagactgaaatagtatccccttctaaaaggcacaggccacgtgaaggaggctagatacttgagcaagagcagggtgacgacaggaagaaaggggaaagggctgtggcatgggcatccacaactgtctgctgtgatcctcattcctgtgtgcagactttcttctctagctaaactcactgatttattacttcacaaccacattctgtgcttaactaaacatgcaggcccttgtcttccctccacgtagaaggggattcctcctccttccaggctactcaagtctaaactttctttcaaagatttgttattccataaaacttccatacacgcataaaacaatggcctatgatcttcattctgtaccagtttttctaatatctggcatatgtatatagaactcatttgctaattatgtttgcatgaataaagacaatttctttagaatgaaactttctttattctttgtttctcagagtttgttttagagtgtcttatgtggaacaggcgactgactgatttgaaagaacttagggttgtttatttaggtttaatacagttcaacctggagacagatgaatagacagatggttttgcaggttcttttcctgtgggccagcaatctttcaaaagacattttatttacaaaacagtgagaaatatattgtaaaagtataactctaagtaaattagcaaaatgagataaagtgaactctagttcattataataaaaaagatttaaaaggcagaaaacccaagttaagttgcttatctcatcatagcaaaattaatgattaatagatgtagaccaaatatgcttgctttttttttaatgaaaagtttgggcataatgtcagaggtacagtaaatatcttagcatttaaacatttctataaataaatgcttgttgaaggagctccatcaatattacaatagtgtttctagttttaccactataatgttatgtaataacaacattttaaattagttactggaattgtgattatttttctaaataatttctatttgaataaaataaatagaaggcaggataaaataaatagaagacactccatagagaatatcctttcaactgaaatcaaaatctagttagtatagaaataaaagtactcaaatattgttgagatcaacatagaaggtaatgcagaagaaaatactatgattatggaaacagctctgagagtcacgagtatgaaaaacagtattcaaggaagcaagaattctaaatatatttcttgtcttaataagcaaaaataaaatttcatgctgagatgaagggaacaactcataaattaaggaggcaatttatactggaataataacttataaattgttttaaataatgggccaatcatttacaaaaataagctatcagtaacctagaagcagtcttttctaaagtttagaacaaggcatatttaatgtccaggtgtaaagttggcattagtctaaaagcaaattaaatatcctagcactgttatatgtatgtggtctaagcatggggaaagtcttagctgaccctgagattgagaatgctgaacttgattttatgaagaagtgaaactgcctttatagtcagtgatcactttctatgaattatatgaagtctacagtcaggtgcagaaatgatttaacttgctaaatgagattacaaagattattatatgtcactctgagtagatcagattaaaacatggcaggaggacctatggaaaagcagtcttaggagaaatgactgaacagatcgtgttagccctggctgcaggctgtcttctctccttgtgctcccttcctgggctgtttctcctcctactcagcaactgcattctcctttgagcccccgctgcagagaagtgcgatgcgctagagccttgctattccaaccgtggttctctgcccgaccacatgagcatcacctgggaccttgttaggatctcagaatcccagactccaatcctgaccgcaagaatcagaatctttaagattttcaagagattcctatgcacacaaaggtttgagaaacactacttttgagtgccaaggattcggtttatacagaacagcagttattctgatacacacggcactgttcattgcgcttggtaccaccagaacatatttccatgtggatttctggagtcatggtgctatgactatggttttcatttcaggttttacaagaccaaatatggttttaaaggtaacacaaagacattttattttaaaatgtctattttaactttaagcactgtagataaaaagccttcaacgtgcgttgatgattaccaaggcatacagttatgctgtcaggctaacattttttagatttgaaataaaagttcttccactatccctgcttaattaaacaatgtccataaactaccaagtaagctactacaaacaaacaaatctggtaccatttgcagcttcttctatttgtgattcccaaaattcccaatgctttgcaattaaaatcaagttcagaaataaaagagatgctatgggtaaaataaaagtgcaactgtcatccacagccctggattgaattgcaacatccatctaaccagccactctgtccatgttgatttattttgctttaagtaattgcagcccatttgaccttccaaaatatagctttcatttgtcttatgtattggagtctaaatgaattttatttgaataaaatgcatttgattctaaagcattttgaaagctggaactaagtatgagttcgatggagaaggcagggctgtctggagcccgagttaattggatgcatcacttcttctggagtcacttgatcacaacaaattgacacctgccaacttctcccctgtaccttcctgatcccggtcaagtcattctcaagtagaagcagtcgagtcatttttattcatttttgatgtgaaccaaactttcaagctaggacttgccatgaaacaaattacacattccttgtggctactaaaaaaattagtttattagcgcaagagtctggatttgagaataaaatcatagatacaaataatctatatttctcacagtaaaagagatatttcttctgaaattacttgtttcttggtggtgtaacattctagcattgcattcatccattctttcagtcaatgtgtcaataggcagttactgagcatgcacctagttatgtaaagaattataagataaaaacccctaattgtaggaatctcagttcagaagagacaggtgctcaacaaaccattgctaagcaatgtaataatggtgtattggacataggttactagttctgtggaaatacagaagaaataataggaaaggggtagctaggttaattagtattttgttttgcttggtaactggtcctaacttttaaaatatatatatatggcgatagggtttgcaattatatttgaacaagttggttaggaaataaaacattttccaccattaagaattagaatacctataatcatcacagggagaatgtcaattttcaaaataagaatcaggcccgtgtggtggctcacgcctgtaatcccagcactttgggagtccgaggcaggtggatcacgaggtcaggagatcgagaccatgctggctaacacagtgaaaccccgtccctacaaaaaatacaaaaaaatattagccgggcgtggtggcgggtgcctgtggtcccagctgctcgggaggctgaggcaggagaatggcgtgaacccaggaggcagagcttgcagtgagccgagatcgcgccactgcactccagcctgggcgactgagcgagattccgtctcaataaataaataaataaataaataaataaataaataaataatcggccgggggctgtggctcatgcctgtaatcccagcactctgggaggctgaggtgggtgaatcacttgaggtccggagttcggcaccagcctgaccaacatggtgaaaccctgtctctaataaaaatacacaaattagctggatgtcgtggtacacacctgtaatcccagctacttgggtggctgaggcaggggaatcatttgaacccaggaggcggaggttgcagtgagccgagatggtgccactgcactccagcctgggtgactctgtctcaaaaataaatcagtaaataaattaataaataataaaaataagaattataagaaagaaaaatattaaaattgtatctaaataaaaaatacttttaaagaaatccttaatactgaatttttgaagtacagttggacctctgtatttgtgaatccatcagtggatccaaccaatggcaaatagaaaaaaattaaaaataatacgatgataaatctaagtaatctagagatgatttaaattatgtgggaggctgtgcataggttatatgcaaatactacaccattttataacagggacttgaaaatgcgtggatttgggtatctatggggtgggtggggattggtgtggaacaatcccctcacagatagagagggatgacttgtattcattaatctcacttgatggatatatcctttttgcatgcgtgtaagaacacagtaatcttttctatcatcgagatgattttctactctgcccattatttacaccacatttagattccagcctggttttcctctgctacttagtacccttctgcactacttcccccgaattaattgatataatgagctgatgtaaattactttcaatattaggctgagctaatattaacccgcaataatttagaaagtaaatataccatacaacaccatatacgtactgaattccaaaattaagtatcaaggatgttttagtttcatgtaattttgaagtgtctagcccattgcttccttccatcatatgcagaaccacctgctctggatgtaaacaccttctgctgtgtgtgttcccacgcctcagggcctgtacagaatagtggctataggaaaggaccctcacaaccctgcacctcccactgctttcactcttccacctccttatcagtgcttttctcgcctattctgctaggaatgattttcaacattttaatcataaacatacaactcttcttttcaggcccgggtgaaatgttctgaactttatgaagcctttgtttatcatccacttgtaactcctctagtatccaaatttctatagcatttcgtgtatcttttatgactcatcaaattcttctgggtttgcatttttcatgaatcagatccccaccccacctccactcaaatttggagatgaaacatctttgtagccttgataacactgagcccaaattttataaaaaagtaagtgtctattaaatttagggtgaattttccatccctcatgataattcaacaagatgcttttgtttatattgtatttttccccaatgttcttcctctcattttcttctcttgtagtcctgtccattcattgagtctcaacctaaaagcttttaattgtgcccaaaatgtacatgattcctcatgtgaaatcccgtagtactttatttgtccctgaattatgctgtttttcatttcttccttgcactgtagttttcatacatactgtatctacttctatatgaactatgagctcttctgcaaggctgtgaatacagtcgtagtcatcttctattttccgtagtgctgtgcatatagcaggtgctcaatcaatgtttgtttcaggagtaaaagtttgtaaaaagttgtggaagaacagcaagctactcagagccaggggctccatgccaaactgagccaagcccagctacaggtggttttaggcatggctagtggtaaattgagaacaggagttggagaatgctatttctgaggccagctctatcagattttgtagcagggagctgctagggcattatgataaaggggtggctctttatctgtcctttgccagtgacccatgattatagattctgctattttaatctgggaaagttttcctgtttttgagagttccctactaaagtctagatgtcctttgtgaatactggtacatcacaatgaatacctttgttatctgtgagcatcttcagcaggattataacaaaaatcaggttgtggggtagatggagacaggaattgatgggagggatgagtggatggaaccaggagaaagggtttgtgccattgaaacaggggtgtttcaggacaaatttcagcctcacaatttctgaggtacagtaaagctgtgccctggaggctgtgtttcagaaatctaaagcttccgtttattggcccactatttcctgcctattagttgtctgttaatacttcatgaacattatcctcaaaccttaaaattatttgtaagatagaattatcctatttttcaaaggtgaaaactaaggttcagaaaggttcagttaagtagctacaattagtcatcttaataaaaagatatagatttgaacacaaaacctgtatctttccttctgtattatgcttgctgcctctttcagcaggctgctttagttatccagtgggaaataggtgtttgggagacttagaaatcttttctttctaagttagtatattttcattgctgttatcatgacgttatttcaaaaactcaaattgctatgaaaaacttgatgatacccctctttacgtcagtttttggcttgacaaagaatagaataaaacaagaaataagacagcttatcttcgatctttcaccaggagggaacttagctgctgtctttgttttggggtaaaagaaaaataaaatgaatctgtgatattcaagtaaatccctcagttgtttgttagtgtctactgtttactcaaaaatgggaagctccaggtcggtgatacatcatctttgttgcgcttggcaccttctttcatgaatcatattaatctgcttaaactaacaaggattaattgccttggtaaggcaacctggcattgaaatgatatattgcccagacagcttggaatttggccactcataaatctcatttgtttgttggtttatttctgtttgtctctctctctgacagatgtgtgcccaatcactgtgagcatggtggaaagtgctcgcaaacatgggacagcttcaaatgcacttgtgatgagacaggatacagtggggccacctgccacaactgtgagtgccaatttatctcactttaatcttgtaattgcatgagaatctcaagtcttgagctgtgctttgaagctcagcaacctgaataatccacataatacatcactcgaatctgaaaaaccaagattccaattgtcatttctccaaaaaaaaaaaaataaaatacactattctacttgttaaaatatgttctctggtggcaaaggactcaaaaagaaggaccagcatttcctctgttccataaacacatagttgagattggaagtccaaacttggattcgcctctctgtgtctaacccacatctgttgggtcgattgtttgggaaatcgtgttagtgtgatgtctctgactggaccctcatttattaattaatccgagagggagacacagggtaattggaacatttagtttctggatgatggctgcctcatgctttagcccaactatttgactacctttttttagatcaaagaaatgagtccgaaatggaatatctaaaagccaatagataaaatacataagaaggtaataaaatgaagacataagagggtaaaaatattttaaaatggcaaaaataaaaagtaacatgcaaaaatgactaggaaaacacatatgtgccttggtttatataaatagctttattccaaaaggttaaataaaaaataaatttctgtacttaaaaaatttaatgctaactcttataattataatattaattttccaataatgcatcgccatttgcagaacgcttttgaaaacaaagcacttttgaaaacatatttggcatgaatcacataattacaagaagagagtcaactgttggttagtgtgtgcatacgtatgtgcctgtgtgtgtgtgtgtgtgtgtgtgtgtagggaaggaagagcaagagaaaaagagagattcaaccttctctcaatatgcccaaacactgaaactctaatatctaaatcctccgattatacaaacagatttcactttacttttaggaaatggtgacaagcaaactatctcagagtagagccctgtgtacagtaaaaatgtcatacagctctctaagcctttccattgtgttatttgtagtaatgtgcaagaagaaatcgtgttttgaatatattgtaaaatgttgacttacaaagttgcacacatttatttgtttaggtagatattcaaaaacaagaggcaaaggaaatcttgacaaaactaacaatagaaagatgtcaagaaggtcaaaattgatactagattcattatctgtgtttacatatatgaaagtattttaatgaataaagaacaaaaatgattgatactgaaattaattcaaagagttataactaaaattgttccttaccaatcacatcaaaatattaacctccagtatgtgacatttattaaatataacgtgatgctagaattacattgatgaaactcagtgccttcactccactagcataatttttatcgtgtgttataaataccatatttaattacacgggatcttgttcctgaaatacgataatgctaaccaatggtcaagagcaagaaatcggtggtggttgcaaggattttctatctcagtgatggcttttacattgaactgaaaagcaacttattctttttttataactgtttccatccttaaaatacacagcaaaaaggcaaaaaaaaaaattaaaatgtatgctactggttgagtagctgaggtttgttttgttttttaagggtaatgactccaaggattagaaatgtcctaagtgtgtttaggtttggtgctagtggccagctccaaaggtaaaagacaaaaattgtcttttgttctgctgctccttcctacttgttccttgctccattttgttggatctttaaaagcagaatcattctttttaataataaaagcctgatcttttgttgtcttctccaaatgaagccaaaattttgaatatccaacgtgtgcataaatagaggtgaaaagaccatactacataattcaagagagggttggctggtgactttttctttcgaaaaatatacattgtagcttattgaaggccatttgcctcctaataacctgaaagacttgatacagtcttacttatccaaatggattagttaaaaatttcacacagcacaaatgtaagaagatacaatgtatgccattcagtttgacacagaatgaacaattttacatttttgcgaaatcaatgaccacattcaaagcaagaagaacgaagtgcgaaggccccagtttctgatgtgtctgacgctagctataaaaccatcaggccgtgtgcctttgtggtcaatcatttgacttttcttgcactttgttcgactgaagtctcttggtattctacaagccagtgagctgagatttgcagttgcttattctgtattctgtgggtttgaactgtgtaagtaacataaaatattttgcttcattatttcctgcagaagaccaagcattcatcttgaaaagaaatcatgctaattattttaaatagtatttttttttaaaaaaagcagctaactaagagctaaagtttaatataatagaacatttgttagagtttcaaacattacaggctacaatattttagcacaccttctacactagcccgggcttggtcaggatgagacagcagtgctatgagtgacctgtgatcatccaggctagaagctctagttcaagatggaacagagaggcctttttgcttggtcactctgccttgtgttgactttgactttaccattttcttacttgtaccctaggccatttaaattatttgagcttcagttttctcctgtaggaatagataattaacagtgctcacctcttcaagccattgtgagattaaatgaaatgatgtacggaagatgctgagaaaaactttggcttatgtggtactcaataaatttttgtcatttcatcactttcagagcaattgtccttttcctttgaacttctataccaataattgcccaaatcacacaatgtgtctcttaatttaatgtcaccatacattgtttgctatcacttttatggcagatttggactgcagtgaatgactggtttccatagtatttttctccagaagaattgaagagtatgcctcctaaacctatgtctcctgttttcatttgttagtttgtgtgtacatggggactttgtttttacgtaaattatatgtagggcttagaggactgtcatttgtgaactgctcccctgaggagccaggatgtctccctttgggatgagtagacaactcaatcccacagacaaagccaaagatcacagaagatagtcagatcacaggaaagggaaagccagtttttgtcgtttaagaacaaaagaggcaagtttgttacaaaatgcaaatacattaaattgttgaagttttaaacttgaaaaaattttctcatacaggcattccactctccataaatcctttaagatctgaatagtagcatatctgaacaccaaaccatgacaaagggactaaaatgatcatgttgaacagtttgtgtttattgtattgacttatccctgcttcagtctcccaaaagcactgtaagaatgtatcttttgcttggagatggagtcttgctctgtcacccaggcttgagtgcagtggcatgatctcggttcactgcaacctccacctcccaggttcaagcgattctgctgcctcagcctcccaagtagctgggactacaggcacgtgccaccatgcccagctaattttttgtattttcagtataaatggggattcactgcgttagccaggatggtctggatctcctgacctcatgatctgcccgccttggcctcccaaagtgctgggattacaggcatgagccaccatgcctggccaaacattcttatatatactactagttccttgtgtggaactgctctaaaaattccttagaatatcctcaataatatgaaaacttttggctaatttaatgaatgcaagaggttaaaggatagtattttagtgttcgacaaaaataagcaatgttagccttggaaatttattaaatgtcagatgtgcattctgacagaaaatatttttgcagatctttttattaaaggagagattttcatgttgcccaaatatatagacgtaatgtttccaggggaaacaggaggaataaactagatgacctatataattctcttttaattttaaaatcacgagatttaaaaattctgaaatactagtaaggaacaggtcctgacattgccaaataaagcaaaagtaaaattttttctagccaatgttagagaaaaatttaaatgtaaacggtaacaattgtacattccgtatgctggagcatttcctctgggttcataaatgtgtaaactgtaaattgtgttgcaccttattacagcacacgtgagaggcgcagtggatttcaacagcccataccatgttgttgataatccatttcacctataattgatataattcaaagaataattttcaaaataaattgaattctatttgctgtagtcatactaacatagagcataaagacctagatttattggcacgaagaaacttggtgtctctgtccatttggagtttctacaacttaggcatcaatgataacttggagtttgagcattgctacaaaaacaagcagcattgggtagaattgcgttggatatggtattagtctgttctcacactgctataaagtaataccagagactggataatttagaaagaaaaggggtttgactcacagttccatgtagccggggaggcctcaggaaacttaccatcatggtggaaggcgaaggggaagcaaggcccttcttgacatggtggcaggagagagaattgcaagcgaagggggaagaaccccttataaaaccatcatctcgtgagaactcacccgctgtcatgagaatagcatggaggaacttcgcccatgatccaatcacctccctcccttggcatgtgggaattacaggtccctccctcaacacgtggggattacagttcaaggtgagatttgggtggggacacagagccaaaccatagcaggtatctaaaataaaatttagatatttagccttagggaattggaatccatcctttggggcaagttcacctggcttgccaggtcctacgtaatatggccatgtctttaacctgatttcctcccctacatctcctcccattctccccttcaatgcactggcctcctttcagtttttgatgcatgccctgcactctcatacccttgcccctcctataccacgaccccccaccacaggacatttgcacatctacctctctgctttgtctagtacatttctactcctccctcagatttcagctcagcagtcatctcagaaaagctttccatggccctgtagttagatcaaatcctcttattctaaaacacacatatgtcttttagcactagcaatggttatgattttgcacttattattcataatgatttaataatatctttctcctccactggtctctgcatctctggcaggaggtggtgccacatttcatccaccagtttaaatctgaggctcgcccagcacagactatgcacgcagtgaatatgcactgcctccaagcattcttgaatgtcaaagagtatccagagcaacagtgttttctttaaattttattcaatgccctctttacagtaaatttatgaagatagtgaagctataaggagagagtacacttacagggcaaaaagaaaaatagaatcaagtccaataacaaaatatgggtaaatggaaggcagggtactaaaaataataccaaaaactaccacaagacattaaacattattctaagaaattatatggaggaatttaggatattagcaaaaaaaatctacatatttcaaattatctttaaggaaaatattgtgccatgttaagatgccccattcattactgaaatttgtgagaactatgacattatagtaacaatagcaaaggaagttgcaacaaagataatatcttagatcagcactctccaacgtttttggcaccaggggccaggttcataggagacagtttttctacagaccagggtgggggaagtgggtaaggggatggttccagatgaaactgttccacctcagatcaccaggcattagttgaattctcataaggagtgcacaacctcgatccctcacatgcacagttcacaataggtttcaggatcctatgagaatctattgctgccgctgatctgacagaagacggagctcaggcgggaatgcctgcctcctgctgtgaggcccagttactaacgggttggggaccccttacatcatagagtgtggtcaattactatactggctaactataggagttattctaaaatagatacagatatgtttaaatattgactagtacatgacaagaagtttattttaaactctataaaatttgaataacatgaacataaaaatcttttgatttatcatgtaatattatatgtgtatccttgctacagggaagttatggagaggggaaaacactcagggtttgaaattagatgtcctgatgtcaaaccatcagatccttaggctatgtggccaaacttacttccccatcagttggacatgtctaagttccagaaaaatgactgtctccatactttataaattctctgtttcctcaaacacgcttgctgcattaagtgtggatttcactcatacttatagaaggtgaagtcagcttttccagtccatgccacaggttactgacagcaataaaataggaatgattcagatttaatcactttcctccccatctctccgcccccgctcctctgtgctatcttggttttgtgtttttagacacgtcatttaatgtctctaaacttaagtttccttttgaaaattcaatgagatattgtttattaaagtactttttaatgtaccccagaacttaaagtataataaaaaaaagtgctttttaaattcagaaaatgtcctacttttaaagaacttatgccactaagtttcgaaaaacagctagtcaaattttactttgagtgtaagtcgcatctactgatccgtatactcttcattcggtacacaggccatattttcatatcagtgattctcaatgaaaagaccataggatatctcagtatttcaataaatgctctttgaaaagataaaggtttttattagcaagtataatagccacactagctgatttatatgcatggagtacatctactctttctaatcgagatatggtattatctagtcaggttgtgcttctgtgttatcaagtgagcaactaccaaattccttcaatttactttccatcccattcccacaccatgatctgtgtcagatgctcagtgtgtccctgttattaaggagtgactatgggatccaactgcaggaccacaggacactaaggacccatagtgctaccatcacttattcattcatcaatatattgagagctgactccattccatacatggaatagatactggagtgtgaagtagagagggcaggaatactaggatgtagccccctccaaaaatgtgtatagtttcattaaaaataaaagttcttatcaccttatttccacatctctggttcaccaggattgtgatctaggaataaattctatgtattcttacctcttagaatctagcttggcatttttcacgcttacaaaatatggatacatgtagacacataggggaaaaaaatgatttaatactttgtcacaaattatttgttttaagcaattattttaacttttcagattgtatattcagaggatttgtttgctttatttctgggtttgtttttctaaccatatggacagggagaaatcagggtgaggtgatgcaacttcagcatggtgcttggtagagaatatggttttcaatagaatatatgcaagtcaaatgttaataagcccttgctcagctgtatgtattctctagaggaaaagctcgcattctcaccaggactaaagcattgggagctaagggaaataatggcaagtgatgtcacttcctgaaatcactttttgcacaaggaaacaatcatcccagcagctcctttactctcatattcatctggcacctacacagaaaataagatggaaagagctgtgaaagtactacctgggtagaaatgttggaaggggatttaaaggccattctatcttttggccacaaccaaataaattacactggattaaaatagtacaggtcatttggagaaacacagcccaaggacctctacatttctaaggcagaccaaattttgaattaatcccttcttgcttcggaatgatgaccaagattaaatatagaaagaaaggatttaatttcaattttgcaaagactctttcaatagtttcaaaaatatgtctttctctttgagtcttggcaaaaaaaaaaaaaaaaaagttgatctgcaaatgcatattgaaaagcagtgtgctgtaaagacatgctgtgatcctatgaacttctccgaagctataaaatgccagtgctaggtcttgagggaactggcattattcattaaactccctgtagtttgaatcccagtgtatgttttatccaaggttcagagtgaagagaaaaaggaatagaaaacacccattttaacacttttgtcaggttgaattaaggaaaaaaatgatatagggaaagagtctactttaatttgaagataaggaacggagcttcaggaaggttaatatctgctcagaaaacaggaaagagaattagagtaaaaaataatatgtgtctctcctttgatactttttaacttctctgaaaccaaactgtgtttggtttccattttgacattagttaataagtttctatgacaagtctttagcttttgaaacttggtgtacaggattatctttaaatcacagtttcaactcattcaacaatattatgcatctcttttgtatgtggcacactatgtgaatacaaaagcatagacgagagccattttccttatgaagtagacaaggtagttttaaaggaaagcaggataagtaataaaagcattaatacattataagaaggtaacatgtatttatgtgtccaactagtatcaaggcaagtgtgtatgatatgagagaaaaacaatatgaaccaagatatttgggaagacgttcaagcaggaacggaactctgagctaagttcctttcagagttctgtagagaaacagaactaattgttaaatattcaaaaaattttgaattgattgtttaaccttggtaaaccttggtagcttgaagcagaactttggtgtaaaccttggtagcttgaaccagaccacagtggaagaatttatgctagggaaattgacaaaccctgtaaagcaagatacttttaatagagctggtttactagcacaccactgccctgtttcattattaataaaacaagaataatagtatgtgcctgccaatattattgtgaagggttcagatgatttgtaaaatgtctaacatgttgtctactatgtagtcaattctcaacagatgacagccatggttataaatgtaatactgtgaagagactggtcttgttaaaggagcagcagggtgcagatttgaatcatgggtgaagctggcccagaagacagtggtttttcagcaccgctgtaacaaagcataacttcagatgctattcttcataagtcatttttttaaatcgtgaaacaacttatatccattagaacaggagtccccaatccccacaataccagtttgtggccttttaggaactgggccacatagcagaaggtgagcagtggtggagtgaagcttcacctctatttacagccactccccattgctcacatttccacctgagctccacttcctgtcagatcacgggcagcatcagattctcagaggagcacgaatgctattgtgaactgtgcatgcgagggatgtaggttgcatgttccttatgagaatctaatgcctgatgatctgccactgtttcccatcacccccatatgggaccacctagttgcaggaaaacaagctcagggctcccactgattttacattatggtgagttgtatgattatttcattattcatcacaatgtcataataatagaaataaattgcaaaataaatgtatgtacttgaatcatcctgaaaccatcccctacctcctgatccatggaaaaactgtcttccatgaaaccagtctctggtgccaaaaaggttggagaatgctgctttagaagaaagaaaggtcactgaatgatatttaagttttcccataacaggttatgggctctcagttatttctgaagtaaggagaactggtaaggctgctgaaaatgcttacagtgcatttttgaaaaccatttggatgatttgatatcacttctttaactattaacatttctttactgaaagtgatacagacgcttttattttactaaattacttctcaattatttagcttatagtatgatcttaggtaacaaagctaattttatattctcttgtgattattaacctaaatctggtataatgagatgcttcctcccctcaggagcggtccagctgtgactcagctgcatcaaatttatgtcttctgaaattaagacacctggatttgtttgctaaactctatttaaaaactactcagtgaggattctcttgattttgcaccattcacaggaagaaattctgaaagttgaattattggttcccgtattttttattttttatttttttttataaaatcatgataaacagaactcttacttcatccattttgttgttgctgttgccgcattttgctttttcttcctcctttcctctccctcttggcaaaagaatgctacaaaaatataaagattgttgtaatctggggcgaaattatccatccacctaaataatctcctcctgttatctttgatgaatatgtctaacaccattaataagcaatagtttcttataaaaaatgcagccgtttccaagaaaattttgatgcttgacttttggggtattctctcatctgacttctttcaaatgtttgtgaaatcgctgatttggaaatctttagacttagccaataaaagtgaaataatgtaaatggatatggatttgaataaagaatatggttttatttttaagtaaaatgagaaaaacattcaagggctcgtagtcccttagtttcatcacccagtttcatcccaaagctgccatagaagctcctgtctgaaaaatatgcctactctactcttgaaagcccattcttggcatcacggatgccaccaccaaatgccagacaatgttggcaactacagaattgctgtcatttctcattagcaggcatcaaaatgtcctaatactctctgccactatctgggcctgttgagatattaattaaacatgtctttcttgccaagtcatgtgatcaactttcactaggctaggtagagccaagtgagcccatccaactacactggataaagaaatacctctaagaatttgtctgtgaagaggaaaatgcctcccatttgtattactgcaaaggaattcagagctctagaaaagcctgtgtgtgttttctaccatatggctatctgttgctgagttatcccacttagagaatattcaagcatttgatggaaacatatccctactcagaaaatgagctcctctagagtttgaatgacatagatagagatttcctgagataataaaacctgcattggggcaggccagactgattgtcctacaggttcctaaattacctgaagctaggtggacagcacaaactttgttaatttattgtccaaaagcactatttttcttttgtatagttctttaaattaagctgacttaattaagctctgtgtaagagcaaaataacattttctggacttccacaagggagagattctcaataataaggattcctgccttcccacagcatagcagttccaggagagaagtactgggattgcatgcgtattagatgcccttgagtaaggcaagtaggaaactccagacagcagtacttgctgcttggttgttagtataggtgtctactcctgtgtgttacagcacctgatgggaaagcccaagctatgataaaaaaaaaaaaaaaaaaaatctcctctcttctcagctgaccatgtggctgattagccacaaggccagtcatcccaaagggtgctgaagagaagtgggctgggaggggaagcccagtgatggatgatgaaagtgcagtcattgcaaaacaagtccttctcttattgttgctagatccactgcttatgacctattttccgcttttaccagataaaatgtaccatcaactctgtcttgaaacttttgctttcctgcagtgtgattgccacagttccactgaacagaggtcattttcgctaagcttcctttctacagtctaaactaggtttttgagctaacacgtattttagaagtaaaaataatactacagaatgatgcatagggcaaaaatagtatagaggagaaatttattgagaagcatttggattgctattagtaatcaagaaaaatgtttattaataagtaacatttctcctcttcctttatacatatagatgagatattgaaagaagttgaacatagcagaagcatgttagtctaaagcccaagtaatctctttgctatttaaaaattctaaaggatttgaattaggatttcagttcacattcaaagtggtagttttttttcccatttgtcatcaccctatgcttctcatgcactacctaccttaagatgaaataaatgaatatcaggtagtaaattctaccacatgtggttattatccaaggaatgggctcacattgacacttgattaacatcagtttcacatgtggtaataaaaaaaaaattaatctgtgcaaactgtaattgtcatgctgggatcatttagattccagcagtctctctgttgagcagtttaagaaaactgtgttttcattgtactttttaaatgaggaagcccagtggaaaaatcatatttgaatcttgagaaatcttttgctttctaaaagtgcagtaaatgaatataactttgatggttgggaagatgagcttgttatccacagacttaaaaaattaagaataaatatacaagttttttggaggggtaatttagtagatattttaaaatacttaccagccaggcatggtggctctcgcctgtaatcccagcactttgggaggccgaggtgggtagatcatgaggtcaggagatcaagaccatcctgtctaacacatggtgaaaccccgtctctactaaaaataaaaaaaatagctgggcgtggtggcaggcgcctgtagtcccagctactcgggaggctgaggcaagagaatggcctgaacccgggaggcagagcttgcagtgagccaagatagtgccaccgcactccagcctgggcaacagtgcaaaactctgtctcaaaaaaaaaataccgatataatgatgtattaaggttagcaactatgcctaaaaaatgagtcctctgaaatgctaccttcttacacaggtctgcaaccaccccaatttcccaaattttaccctagttctctcccccaagcatgtggctacctactagttttaaccaaagaaggaaggctttaagcaggagggagaaagaatatggagacgttaggagagtgggtggggagaaaaggaggagagagctgcactcttcatctgtatataagatcatgttacttgcaaacagagacaagttacctctgaatggcaaggctgagaacactagtgtttctagctctgtgctttctacagtgtgatttgtggacaaatagagggctttatatgcattgcaagtgaccctgaagataatataaatgcagcttagaagaagtagaaatgtatctatttttaaagtaatcttacttcttaccttagatttaaatatatacttaaggtcaaaaagtatttttaaaatcaaaagaacagtatttttttccatgtaaaaccagagcaagatttttttttaaaaaaactggtagtaagcagaagtgatttcattaatgcctctttggaaacagtttatggataaaattagcaatatgatctatcactgacatttactcttttatcctttatgcagaagggcttttcatttataacaatgagagagattataaatcagttattaaaaccttatcaaagacaaaggcatagacatttttacattaaaattatgaatgcaaaaacagaccagcctggtctcttacaaaccatgaacagtataaacacattgacagttcttatactagatagatcctaaataaaaatgaaatcaaataatactcattcctggaggtatacctcatataagtccctttatgtcatcagcaaccctattgtattgacataagctctctatccactgttcttcttaatgccaccgaccaggtgcttttcatctttgaacacaaatgcctatcccactgcttagtgcttggtaagtattaaatacaatttggggcaactaaactgtaactgtgtctgaatgcacaaacacacacacatacccccaaatatatacacatacctctcaaatgactgtaaagataggttcatcagactcggaacatacaaagcccttgctacataagagaagctttctctgtgggatacagcatcttaaattcttttcaattctcaataagagagaagaactttattttcatttggtaatgttcctgatatatagtacatgatattctttatgccaagttttgttctatcaaaaaatatctgacacttccaaactcattttatgagtccagcattaccctgatactgaatccagactaggagactacaattaaaattacaagtcagtatccctgatgagcatacatgcaaaaatcttcaagaaaatagcagcaaaccaagttctacagcatattccaagaattatacaccaagatcaactgggatttatccctggatgcaaggatggtttgatatatctaaattagcaaatgtgattacaccgtataaacaaaatgaaggataagaatcatatgatcatttcaacagacacagaagaagcatttgacaaaattcaacatcctttcataataaaaactctcagcaaactagatacagaaggaacatacctcaattcaataaaggctgtatgtgaggagcccacagctatcatcatcctcaatggtgaaaaactgaacgctttccctcaaggatcaggaaaaagacaaggatccccactcctgtcacttctattcaacaatgcactgaaagtcgtaagcagagcaattgggtaagaagaagaaaaaaacacatccaaatccaaaaggaagaagttagattttctctgtttgcagatgacatgctcttatagagagatgtccctgacttcaggtggtttgacttacaactttttcaattttatagtggtgtgaagccaatgcaatttggtgtacttcaaattttagatcttttcctgaactagcaatatgtggttcatgagataattcacactgtattaaaaaatagactttctattagatgattttgcccaactatagggtaatgtaagtgttctgagcacatttaagtttggctaggttaagctatgatgtttgctatgttagatgtattagatacattttttacttttggtattttcaacttatcagtttatcagtatgtgaccccatggtaaatccaggagcatctacatatagaaaaccctacagactccaccaaaaaactattagaattaacaagcaaattcagtaaagtggcagtatacaaaatcatacaaaaatcagttttgtttctatacactaccaatgaactatctgaaagaaaaattgaaatcttcccacttgtaatagtatcaaaaagcataaattacttaggcatatatttaaccaaagaggtgagtgaaggatccatacattgataccatgaacatggatgaaaaaaagtgaagacgacacaaatagatggaaagataacccatgttctcagattggaagagtttaacagttagtcccactaaaatatccttatcaatgcaagctatacaatcaaggaatctctatcaaatttccaatcagatgttttatagaaatagaaaaaaaaatcctaaaattcatgtggaatcacaaaagaccccaaatggacaaagcaatagcaaaagaaagctggaggaatcacatactaagtgtgagggaaatgcatatcaaagtcatttgtgacaacatggctaaacctagacagcataatgctaagtgaaataagccagacagagaaaaacaaatgctgtatctatcacttatatagggaacctaaaaaaaaatgaaatgtcaaactcacagaaacagggagtaaaataatagtaaatgcagaagctgagggtagggacaatggagaaatgttgatcaaaaggtacaaactttcaattacaagatgaataagttctggggagctaatatacaacatggtgactacagttaattatactgtattgtatacttgaaatttgctaaaagagtagatctgaagtgttctcacacaaaaaagaatatctgagttgatgggtgtgttaattaacccgattgtggtaatcatttcacaatgtgtgtgtgtgtgtgtgtgtgtgtatatatatatatatataaaacaaatcatcatgttgtacattttaaatatatacaattttatttgtcatgtgtacctccatgagactgaaattaaaaaaagaaagtagcaggaaaagtaggcttcaatatcaacacaatggatttttggacattttgaggcaaggactctattatacacatcagaagagtgtagaaaagcaatagttgagcgagaagtaccctctgtgcttttcctgacagatgattccaaggcataggatgctaagggtgtttgatttctagggctgccattaataaataaccacattcttgctggtcaaaacaacagaaatttattctctcacagatttgcagtttagaagtccataatcaaggtgctggcaagcccacgctccccttgaaatttctaggaaagacttttctttgcctttcactggcttctattgattgccagtaatttttggcataccttgacttgtacatgcctcaatctattctctgcctccttcttcacacagccacgttccctgggtgtttctgtctctgtccctgtgtcagaatctttctctcctttctcttgtaaagacaccagccattggattgagtgtccacattgatccagtacaaattaatcttgacaaattacatctgcaaagactgtattcccaaatacgatcccatcatgagtttgggtggaagtgagcttttgcaggactctctacaccccgctttgccacacctgctcctgtccagcacggagctccctgtgtcccctgtgctttcccagctccgttatgccatcccctaacctgcaccccagattactcttctccccacttttaccacactcaaaatttactttctgtaggctccagtcacattctctttttattttgtgaaatcttgtttgctcactaaaacttaaacggatttctcttttgtaaaaaaaaaaaaatatttttgacagcaattagttctgtgtaatgtctctggtatttatacactcagttaattttttttccaagtgttttacccacagttttttctcccagaaaataaattgtgtaggcctaagttaactattctgtctctctttttgcaaaacctaatagtctttgttgattaaatttttcattttgaacacactctgtgggtttaaagaaccctgaggagaagggagaggagagtatgttaggtattgaattttcattcttcaaaattgcatgtaaggaagatattttatttttcagatgaaaaagctgaggttcaaagttcatggcagagccacaatttcaaaccatttcctgttgattttgtgaaatctgtgcttgtccatactccctcccttctgccatggcatttccaactctcagagcaccaattccaaacagcctggagactgggaagtggttctgagaagttggttttctattggcagctctagtagagaagccctgtcctgtagctcctgacatgagtccccagtgcatcagcctgagagcagctgctgtgggagtaagttcagggtacctctgagaaaagagggggccctcactgacctagaggcatgtatgaaaacctagggctcccaaggggtcttggcaatcatttattctagctacctcattttatggagacagtatataatcattaaaaatgttttagtccgggcacagtggctcacttcggtaatcccagcactttgggaggccgaggcgggaggatcacttgagcccaggacttcaagaccagcctcgccaacatggtgaaacctcatctctactaaaaatacaaaaattagctgggcgtggtgttacgtgcctgtaatcccaaatactcgggaggctaaggcaggagaatcacttgaacccgggaggcagaggttgcagtgacccgagattgcaccacggcttggggtcctgggcgacagaatgagattctgtcttaaaaaaaaaaaaacaaaaaacctctgagaaagaccatatttaaattacattaaattttggagttataatcacattaatataaattatatcgagattgtattttttgtttaaaaatataatttaaaaactatattcatatatatatatatatgaatcagaaagactcatttttccaggcattttgggttagggaaaatctgtcctttgcttccccgaccattttgaatgtgattaaatatgcacacacacatgcacacacacacgcatgcacacactgatgcaaactttagcaagtgacatgagggtgtcttttcacaggataacttttttcatttgattcctcattcataaaacactagtatgatatacatccccacatagattttccccgtttctataaaggatgaagattcaaatgctgcaaagctcactccgggcccctggctcagaaacagttctctcagcactctcctgacattattaatggccctgatgtacaaacccagaataaaatagaattaaaatccaaagttaatttcaagctccattagaaattaaaggtgttgggaaagaaatcaatatttgcccagtgcaaaatgactaaattcaaagcaattaattctattattttgtaacttctaaaaactataaaagaccttcaaacaataaaatgttgccatgcgcacacacatatacaatgtgtgactaaaaataatgagaatgatatccagcagcgacatgcaaaaatctcttttattattttatagccacactatgtagtgtacacactaaagtgtgtcttaaaatagagccaattattccataaaattcgtggctatttccagcaattatcagcacttagttgtaaatctgggagaatttaagggacagaaacaatgcaaaagagcgaggagattaatttaaatggaagaaatgtatctgttttcttaattttgctttctctttttccagcttctttttatgtaatgctatcgatcaccaaacaaatggccttaaacgctgtagttcccaacaggatgaagtatttcacaacctgtagagctgtaggttataatacacataaaactggcactcggtaaaagctttttcctgtcagaatcattgccatttcttccctgtagtgccttttggagaaagtctgagttaacaaatggatcttttccaggtgcagaaagatcagagtcaaatgggtttggatcagatcttgtaacgagaatgtgtcactctttccctccccttgtcaagaaggagtctcttaagaaccggctcaagcatcacttatcattacagcagactggggtgaacagttgtaaaagataatgatagaccaaaccagttcttagctaaggagatgtcatgagccttctgatgaaacctttctctctttgtgatagagatagtcaaaatgattaaggactactagcaacagaggaaggcatggccaggcactaggaccattctaagacccatcaatatgaggaaatggagccatcgttggccaaaggctcgggtccttcaagtttctaaaattttttgtttgtttgttctgtttgttttttgttcgagatggagttttgctcttgttgctcaggttacagtgcaatggcgcgatctcggctcactgcaacctccgcctcctgggttcaagcaattctcctgcttcagcctcctgagtagctgggattacaggcatgcaccaccatgcccggctaattttatatttttagtagagacaaggtttctccatgttggtcaggctggtgtcaaaatcccgacctcaggcaatccacctgcctcggcctcccaaaatgctgggattacaggcgtgagccaccacgcctggcccaagtttctagattttgacacgtccttccagtggctgctaatcaacccctggccctttgaaaagttgtatctttttaaattgatttctttcaaaattgtactaaatgtagttagttgcccggaaggtgtgacttgtttaacctaatgaatcaaagctgggctttagcagttgagccacctgggccactaacatctacccactgtctggttttccacactagctataacaaaaacacacttgttagaccaaattgattttctgctctctttacgtctccaaattactcagctgtttcttccttcctgtgatattttaaaaggtctggggttctagccccaactctgtcacttactgtgggtgtgagctgaggctagtgatttggcctccctgatcctcactcccctctcctgtcaaatgaaaatgattgtatttaccttgtaagttgttttcttaaaagaaaaaaataaaacaatttaaaatgcatgtgaagtggatgttcatgatcagacctattgtagactctccaaagtagcagctgtggacattaccatggatctccattttcctgggtttcccaggactgcacactctctccccgctctgcttccttcagacctactctccagagagcttctggtacctaatattagtgtttgtaggtgaccataagtcaagttagcaaatatgacatataggaaagtagataagaatgcaggggtatgaaaataaggtaaaaatggggagtaacatgtgtttaaaaattgttaatctttctcaacaacatttcttatggactcagctaagtaacccaaggaggttgtctctcttcacccgctcctccccacaccagtccacccttcaacccttcaacgtggctaccatcttctctatatcactggatcgactcttgtcagttacttctatattggcaaattgatgttaacttatataaatgggacatctatattttatagaagttgctttctctttctttctttttttttttttttttttttttttggagtctcgctctgtcacccaggctggagtgcagtagggcaatctcggctcactgcaagctccgcctcccaggttcacaccattctcctgcctcagcctcccgagtagctgggactacaggtgtctgccaccacgcgcggctaattttttgtattttttagtagagacggagtttcaccatgttagccaggatggttgatctcctgacctcgtgatcggcctgcctcgtcctcccaaagtgctgagattacaggcgtgagccaccgcgcctggccactttctctttcttatagtggtttttctttgttttctgtaactcagcagctcttcatttgggttcagtgtagttcaagcctctgcttctcagtatacttcctgggctttttctttagccttgtcctccagtagtggtgctctccagctgtgtcctcaggctttccttctcaacatatgcacttacccttactgtccctaaccatggcatcaattttcatttacatagtgattccttcatccatattgccactctagaacattttgctgggcccattaaatgtcctggtggacagtgaccagcacatagtagaaatgtaataaattattattgaatgaatgatgtctctagatcctagccattatatccctgcatcaagcttggcatattgaaaatcaacttattctttctgccccctgtcccccattccaaccagacttccttttcctcctgcatttcctataaaggaaaaacggtcctttagcaacccagccactgaagccagtaatctagccacatctaattggtcaccaagttcagcatcttccatctctggaatgccatttgtatcccatcttcctcttcaggtcatacttcaacacagatactccccatttctgaataacagcaaaaaccttgcaactcttgatttaagggccttcagtttatccttcacacatctgcaaaagtgagaatttgatgccatgacttatcaggtcttatcaggttaaatccggatattctttggctgtgtccccacccaaatctcatattgaattgtagctcccataatccctgcatgtcatgggagggacctgatgggagataattaaatcataggggcagattttcccgtgctgttctcagcatagggaatacgtctcatgagatctgatgattttttaaagggcagttcccctgcacactctctcttgcctgacactatgtaagacatgcctatgactccttcgccttctgccatgattgtgaggcctccgcagccatgtggaactgtgagtccattaaacctctttttctttataaattactcagtctcggatatttcttcatagcagtatgaaaatggacgaatacaaaaccctttaataaatctccaaagttgtaaatataaaatttgaataaactaatctcacaaaatatgcataatctagttcctgtctttgtatagtttaacctttacccagttcccactcagctgcaggcattctgagcatgctataatgctttgtacacgtctttgtatggaatgcaaactccctcttttacttaattatcattggcatgttcttcattactcagctcaagtctctttgattgcaggaaacattgtatcatcccaaatctgatttagggcccccactctctgttctcccacagcatgctgtgcagaccgtgtcatagaaagagcaatacagagttgtgggatatttgctttttgatgtcaaaaaatatcttattaacttctcataccaaaaaacaggacaggactgatgcaatagttattcaacaaatgcttgtcatataatgaatggaaattccatatatccagcctgacactcccgaaattacttactggtctgacttttttgcttgaaggaaagcagctggacttgggttaaactttcactcttctctttctctgtctcttcccttcattgtgctttttctttctaacctgtatcaaatgagagagaacctgatattagtcacatatttggaaattttttggtatcactgagatttggtccctctcactgtcttagcagttacactttaagctggcttacatatagttgtaaaaagaaagactaggttccccagttaaagaaacttcagggacagaaaagctctcttctgcttgtttccttgcttgtaaagttagtctttgatataaagtttaatccttttatgctgcctggaatgtgctcagaggttttctctgcagattgtttcatctggcagttaattcctgggtacttctgggaattgaaggaaagaggtttttgagttttagttactgaacttcgataccaccagtcaatccaacagttctatgtctgtatggttttttgctttgtttcctctaaatcggtgattcttaaattgtattttatttgatgggcacatgagtaagtcaatacaagtacagactcctgggcaccatcccttctgattcataaggtctataatagagtcatggaatctgaatttcactgggcttatgagaagattccagagcagaggattcgtgccagtgtgactagggaatctgttttctctcttagcctttctatctgatcagaagatgaaacctgtctggggttctgcgtattctaattctttctcttctttgacttcaagttccccagactctgagggctaaaacccagtatttagtggccttttacagagcaaattggctggccattccaccttatccttgccatgtaagccaccagccatgcagactttccattacctcatgatcaagagtttcagtctcttcaccctcaccaggacagaggacatagtcaaggagatccctgcagaatacactgacaaaggacttcagaaataaagggagtcccagttatgaggatagcagacaaggaaatatggtagagcttatgttctgaatcaatcatttcagattctttggtttttacattgaacatgtatttgtgattactacaaatggttccaaaaaaaaaaaattcccaaaaagtaaaagtacaaccaatgccatacaaaatagattaaaaaaatctccaaaagtttaatggttcataagtacactcataaattttgaattattattaattcataattcccaagtagtatgataactagtatgcactttacaaaaggcttggtaggttaatatatgacaaatattgcttggaaattttattttattacaacactcaatttctaaattttagatttcataagtaagtgctcctgtgatgggcctacaaccatatatatatatatatatataatgcttcctcatatatatatacatgaggaagctttagttactgaacttggataccaccagtcaatccaacagttctatgtctatatggttttttgctttgtttcctctaaatcagtgattcttaaattatattttatttgatgatctcatgagtaagtcaatacaagtacagactcctgggcaccatcccttctgattcataaggtctgattcatatatatatgtgaggaagcattatttcccactgttctgaagcagccaagtaagaattaagctattgtgtcggtgcatacagacaactgcagtcctttgcagtttttcgcccctctggctacctttattatgtcagtgacaaaaggtgatacatttagtacatcgtgaataccgacctttcacactctttgagcccctctagcactttttctttttgttctgatcttcatacactatttaagagtgttatcagcaccaagaattcatagagtaatgattccactatttaattcttcatttctttaaacaagtttttttcttcctcaagccgattttcttttttaatgaaaaagctaattatcctttaaaacaacattttttttttttgcattttgcaataaagctaggaagtaatttagtaactttctaatagtaagttaatgagttttatcccagatctagtatcgtggggcatattttttatgtgtacataatgtttctaaactaagcccagttaatattttcttttacatttatcagcaagaaagagagaaaggagactaaaaacagacccatagctccccaaagtgcttaacaggagtatttaatggcatccaatcatacttagtcgctgtgtagatagaaagctctttgcaacaaaacgacaaagatcagacaaaccactatagtagccaccagagaactttgtatttcttatgtccattctgggctgattgtccctaaataagagctaacctattttctctgactttacatgagcaaagaaaatgccttcaaagtgctttctatagcaggaggtacaggtgccaacgtaaacctagataaaagctgtttgtatatttatttgtttgcttgtttttatcacactcagtggcctcgtgatgcatgtaattaccttgaccaaagcataatagtagacagcattaccttggaagagtcttagtaagatacaaactggacacatttttgagagaagaaataataggagttgggtgaaaacatatacagcatgggatcccacctaatgcactttatatcctaaaatagggagctctccacactctcaccatcgccgtgcccacacatctcatacgtgcatgcactcatgtattactaattctgtggtgtcacagtgtccacactcccatttgcagacttgtccttttgagacagttttttggaaccagggagcacttttcttgatagagagaattctaaatttttttgcacaatcaaaatcttcagtactaaatattcacattagcaacataagaaaagtgtccatataaagactaattgtccatacaacagttcctaatgttacattttagttagatgatctacagtttaggtcacagatactcagacctattccagaatctagccatattcaactttcatacatcattttttctcataactaaagatcaaagtagtaggaaaattttcatgatattgcaaagagatttttaaaaatacattagcttaaagttatttatcattaggaacctaagttttattcttatttaaagaaccataaatagaatttaaatcaacatctatcaagatctgtctatcatatcaccttccagaagtcaacactgtaaaactcaaatatgcgtggcttttggacaacaattccatttttagaattgtatagcaagcaaataataagacagagttacaaagatttatgtatgcttttcatctcagcatagttttgaatgatgaaaaatgtgaaaatattttaacatcaatagttgtatggtaaaataaatgatctgatgacatgctaagaaacaattagagttagcaagcagagctatgttgtttgacagagaaaacataagaaacctactctatactaaacagaaaataaaactaaaatgaaaatacctggttgaaaatataaagaaagaaaaaaacataaagtgatatatcaattttaacagtgatattttccaagtaataagagtaggtcatttgaatattttttcatatttttaataaattgtttcagttgaaatcaaatgaaaatctattatttgtataataaatgatacatgtattttcatttaaaaatatttggtaaagagaaactaaagaggaataaaagaccagatgtttagttttactgtattttaaatctgtactcatatttgaaatacctatttgtttgtctaaatgcccgaatggattataatcttcttaaggcaagaggccgtggattgcccttttttttttccattgtacccctacaaaatagtagttgcatgataatgtattatgaataaatgtgtaggtggccttggtaaagccactttctctctttgaggctcatttttctcatctagaaaataaatacagggttctctactcacctcgctggggattgctgtaatgctaaaaggaggcaacacatgttgattataaagccttccatgtatgtgaaggaacattatttttaaccacagtaattacactcatagaaatcagtgaagcaagtgttggattcccatccccaggcttggctcaaggccaaatacaaaatcatgaagcaagccaaaaatacaggctgcacaagctgctcatctgtgcctgccttcctcactttagagacatagcctgccctcaggttccctgcaccttcctgctctatctctacctctcatgtaaaagtgtattcccattaaaatggaaccagagacgcatgcttcaatctgcacccgggggatatgcgttttcaccagagataagaaattatcagacaagaacaggatcagacctggatttttctgttttggaagacacacctgaaatcacacacccctccttcccctcatctgaaggccaaccaccaccacatggtcctttcaccagaggtagagagcactttgacactcagatctctgctggaaatgaaaacaccataaatctactcaagcaaatttcacccctctgtaagaaaaataacacatattattaaaagttatccttgtgttacatgaaaaaattagaaaaaaatacaatgacagtaggctttgctactatatccccataatcacagtcataatgtattaggtactaagaacaatacagaacaaccatattggtttattcagctgtttaattagatcacagttttttggatagatgaaggtataaaatatatatagatatggatattataaatcaatagatgtagatagatttttacatctattttaattttttttctgtttataaataagtaaaatcatgtattttatatatttaaatgtgtatgcattttaaataggtttcaatatttaaatattaccatctactttaaaagtctattatatatttgtttcttgtttttcaagctttttaacataagagcctgaaaactattctaatgaggacaaagtaacagaataaacctaggcacatgcccaagggaatgaagtttaatggactgtttagaaaagcatgaggttaattaggttaagattcttagaaagtgagatttgaactaaaaaaaaaaaataataaggtgttttgctgttggaaatgagaagatcataaaattcactaagaacttatccacagtgagtatagagaagagaatgggccatcctacccattgctgaggccaaaacccatcctggctgcctctctacactcacaacccacgtctaccccatcaactagttctgctctcaatgactctatcaccgccattctggttcaaacaccatcgtcctctgtctgtttttgcagtagcttcctgccttagtcgacctactttcacccaggccctattcactctcatcacagcagccagtgtgattctgttaaaatatgcattctggtcatgtccaacctcatgttaaaaacaacagcctccaaggccctgaactatacctcgatgatcttggcttctactgcccttccccttgtttgctcactcagttgctcacacattttaatcatactggatgtgttgctgtcccatgaacacatcgggcaagcattagattctcagggcatggcgtgtgctgttcttccaacttacctactgcatggcaagatccatcaactccatccagtcattgcccagatgtcatcttctcttgaagacccaccttaacaaccatatttaaaatagtaacctcacttctgttttccttatctcccttatctgctttatttttcttcatagttcattatattctttttttgtttgtttgttttgagacaagtctcgctctgtcgcccaggctggagtgcagtggtgtgatctcggctcactgcaacctccacctcctgggttcaagcgatcctcctgcctcagcctcccaagtagctgggactacaggcttgtgataccatgcccagctaatttttgtatttttagtggagatggggttttaccatgttggccaggatggtctcgatctcttgacctcgtgatctgcccacctcggcctcccaaagtgctgggattacaggcgtgaaccactgtatgcagcccattatattctaatatactgcatcttttgcttatttgtgtgctatatcacctgtctcccgcaattagaatgttaattacatgagttcagggacttttacctgtctattatgtttataattgtctccccatctaaaatagtgtccagaacattagtaggtacacaataaatattttttggattaactacattcatttatttgtgctgggaacagcaacaaaactagtctgaagagaaggggctgaaattagacctacaaaagcctgattcagtagatttttcagttggaaaatattgagtgcttacattaagatagttatggtatgatatactgatactgaaatgaaaggtaaaaaccaaagtaaaatttaagtatagatcttaaaatgaatagccccaaaccatttcttactggaaaatttaagtctgactctattgctgctattatagcagagataagagacttacaaaatctagatgaattaacaaaagattaaaatcatttaaaatgttaggagaaaacttaataaaactcttataatgtgattgccaaaaaatgcacaaatatttccaggaagtgttaaaagttgtctattgctaattatatatttgtacttttttttacagctactcatgtgtagaacaaaaaaatagacaaaattactcaggctcaatgattcactatgtacagtttacaaattaattagcttctcttaattttttcaattaaaaaagtgttaaagcattagtttattgcttatttccgtgttaaaatgctggttaattgcaaaacattattaggggccaatattaaaattccacttacaagtgtcagagaagcaaaacacatttaaagttcatttgcaaatccagcttacctaaatctacttgggataaagcaatactgctgaagtacgtaaccacattctgatgatgtatgtgcaatagtttttcccattagcttactaatgtatgtgtatgagacagagagagagagaatgtgtgtgtgtgtgtgtgtgtgtgtgttactaggattagctctagtttttaacatcataacagaatatgaagcacgatgcacaaaaattcatttataatttataaacactgagcttttaatttcaggtgtttcttctttctagttctctatgtcaatcatatagctagatacaacccagaagcaactctcattcagaaaaccacaaaatgtaattaatttctttcttttcttttttttttttttttttgcgtgtgtgtgtgtgtgacataatctcgctctgtgcccaggatgcagtgcagtggcgcaatctcggctcactgcgaccactgcctcccggattcaagcgattcccctgcctcagcctcctgaatagctgggattgcaggcacccaccaccacacccagctaatttttttttttttgtatttttagtagagaccaggtttcaccatgttgggcaggctggtctccaactcctgacctcaagtgatcttccctccatgacctcccaaggtactaggattacaggcgtcagccaccatgccccaccaagatgtaatgaattcgattaagatttggaatcagtcttgctgagatattcaagaggaaaattgtgaaatgggatctgatgctattcacaaagagttcttcttaatgcttcagaggcagctctgactgttagggttagggtcttatatggcaagtacgaatactcctactcttaaatcttcaatacagcaggcagggagaacttccttgttgaatttttcaccatgtgctaaaaggatggggtgaacttggaaagaaacatccgaacgtcaacttcattacaaacagcaaattgagcagctgtgggagagaaagttcaattgggacataaaagatccattcactgatttcagaaaagctatttctgaaaatgcacaataagtatatagcactggagtagcaaaataagtgtaagtcaactatagaaagctatgataaacaagaggaacaataaacaggacctaagattcattcgcacatatgtaaataagactacagcacaaagtaagggatactctgtcagcattatttggcattggttgttgtttttgttcaaatgtttaatccatgtcccagaaacttaagatttcaagtccttaaaagggacttttaaaaagtctcaagtaacaatgaatggaattaacagttttttagccagtcattttagtgtcttaaaaatagaaaaatatttttatgaagataaaaagaataagaaccatccattgcgtcaccatctagaaataagcactgttgtttttctttttgtttcctttttcttttgagacagaaactcaatctattgtcccaggttggagtgcagtggcgtgatcatggctcactgcaacctctgcctcctgggctcgagtgatcctcccacctcaccgtgtctgttttgtttaagagtatatagttatcaatccttaaagccgaatttcattcttggtagttactgttaaaattaagcatgaacaattgaaagattttacaaagtatatctatcatatacctgcggtgtatcatccttggagaagaaatgaacatacactgaacatagaaacaactaaactttctagataaatggaactaagagactaacttctgtttcaaatgatgacgaatttcagaaagagaaaaaattaagtagaaaaaaaaggagaatgtgagagactggggagagaaaaaataaatgagagaaggtggtagaccactaggatgaagaagcagaagatgaaggagacaggcaagatgctgacctcttagctcagtcaaggtctggactttgggggcctgtcctagcatcatctcttgcagtctagcacatgtacatacagatgctatgagaacatatgtctgtcaaaggccagtgtttttctagatcagaaacattttgtagctcttccggtggacagagttggatcatgtgttctctcaagtatttttatagatttcagaaacactgaaataatcagcactgaacgaatgtagccaggcttgtttctaaccctggattctgtgctttgattttgctatcacgcccctcactgtcaaccaccctgaaaagagaccttataaaaaattatggctgggcgtggtggctcacgcctgtaatcccagcactttgggagggcaaggcgggcggatcacctgaggtcaggagttctagaccagcctggccaacatagtgaaaccccgtctctactaaaaatacaaaaattagcagggagtggtggcgggcgcctgtagttccagatactcgggaggctgaggcaggagaatcgcttgaacccgggaggcggaggttgcagtgagccgagatagcgccactgcactccagcctggcgacagactctgtctcaaaaaaaaaaaaaaaaaaaaaaattatgctgcagtttcctagggctgctctaacaaattatcacaaatgttgtagctgaaaacaacacaaatatgttatcttacagtttgggaggtcagaagtctgaaacgggtctcactaggttaaaatcaacaggaacgcattcctctgggaggctctgagacaatctggtccattctttttcagcttctggaggcctcccgcattcctgggcttagggcactggccgtcatcttcaaagccagcgatgactgatgtaatctttctcacatcgcattgctctggcactgactaccctgcctttctctttcacttgttaagatccttgtgtttctattgggcccatctaaaaaatctaaaataatctcctacctcaagatccttaacctaatcacatctgcaaaatcccttttgtcatataaagtaatttatccacaggtttaagggatagggcagcaacatcttgggaagtcattattctgcctacctcaaacctcaaattgtattctgtgattatttttcaaaggaataaacttggccaggcacagtggctcatgcctgtaatgccagcactttgggaggccaaggtgggcggattgcttgaggtcaggagttggagaccagcctggccaacggggtgcaaccccatctcaactaaacaaaaatataaaaattagctggacatggtggtgtgcctgtcatcccagctactggggaggatgaggcaggagagttgctggaacccaggagacagaggttgcagtgagccacagtcgtaccactgcactccaacctgggcaacagagtgagactccatctcaaacaaaaaagaataaattcataaaatcaaatatttttttactgtgtgatagaagcagaaattagaaagcattatgaccacccacgaatcataaaatctttagtaggaccagtaggttaacatttttcctgttggagggagcgtttctttgatatataaactttcaaggagtcattgaaagctttggaaggcttctttccaaaaataatcttttagaaaaagtctttccaaagaatccagtcgttgtattttgggcaaaatattagaagtatgagaagccagagtgtgaaaactgagttaatattcttatgaacacgaatacttggcagccaatattgaggctgaaaatgcatttagaatgttaatgtatttccatagtatttcagatcaaagatactgaagggaacttaactgcaaattaaaaatagagaatctacaggaataagttacatttcttatagcttcctgtgcaatatcaaatcaagtagagcaagaggtggttcctactttacataatttttctcagaaggatgattttgtttactaccattgccctgtaagtattatgctttcaaggaagctctaacaactggttatcgctgaggttagtgtctctcatggtactcgcttcatgctctgtccattaggtaaatgacatgcaaagatggcttcctctaagtttctgagacacaggtactcatatttaacttccgtggaggaggaacacaggagtgaaatagaaaggtctgcatttggtgtctgtcttcccatccattcctaagagaagatgacataggcctactgcttatcaagagcatttgaccctaatgagtgtcgttatagaaaagttagaacctttctataagactttgtattttactttccagaaaattccaattcactaaactgtccatttcttctcctactagtgtgttattttcagggtgttttcttcctattatagtctcagaaggcccatgctcagcttccgtagaccctgtcctctgtcagtcagtcacttcatttacccctaggttttgactcttcacagatttctggatatctccctccaaagggatagctcttctgttgctaatgactagcatgagggttggtaagtagtgacagtaaaattaacattccttgaccacatgaatgtgagcaacgctttggatcagacacctgatctctgccacaccttccagattaagtcaaaaatgcctatcttggtattcagggtccacccaatctgcctttcctggctaattttccatgtctctcctatgttaaccctgcattccaaccaaatggtctgtttcccattcctggaatccctaggataaattccattaatttgcctgcttcggtgtagttgttcatgccattctccttcctctattgatcatagttccactataattttgttgtaattatcgggaaccaaagaagcatgaccctttcttctcatacaaggtttggatcaatttagaaataagatgcctagtagaaaaaagctggccatcaaaatgtctgctttattacaataaaagcttatttgaaagcagtgcttagatctacctacagtctaggcatactgctaatattactgtctatgcaaaaactgaaatcccattccgtggaagtctcccctggcaaaggaagagcctgccccaaggtgtttcccatgtggaagatgcgagaatattgctcctaggcagcctgaaatggagaatataagctgctctgatcaggtattgtttcttcttctaaattcacaaaatagacgagtcattctctgcctgtcttcactcgccaggatcagtgattttgaaggtgggggtcagggtgggagtagaggaatatagagagaggcccaaagtcaccttggctaaagtccctctgtgtggaaacatgagaccaggcgcttttatgaggctttcttgaatatgcttatctgtgaaacataatgttttcccctttgtgctcccaggtttgtaggttatatccctcatgcagaactgagagagtggttcagctaccaaataccatctgttagtctgttccagctactgtaaccaaatgccataaactgcatggcttataaataacagaaccttatttctgacagttctagaagctgggaagtccaagatcaaggtgctggcagattctgatgagggtcccctactttctggttcatagatggcactctctcacaagtgtgctcatgtagcagaaggggcacaaggagtatctctgaggcctcttttatgagggcactaattccacctgtgagggctctgccctcatggcctaatcacctcccacagttccccacctcttaccaccagcttaggggattaggatttcaacatatgaacttggaggacacacgaatattctgaccatagcatatacttactggttttttatttctgattttaattggtgcttaaaggaatatctaggtattcctaataactattatccaaaccttccaccaatattttcaataaatgcctggggaacagaaaatgaatgaattaaagtatctaccaataatattttagaaaaaaaacctaaaatttgcaccttcctttttattcacaatatgattttcatatgtaatatttagaattattaccaaaagttgtagcagagcctataaattaaaaaaaaatttcaagggagcatattagaattaagcagtaaaatggtagaaacaaatggcttggtgggataaggagcagtaaacatttttttgcatattctccagttttacaaatttgccatcttcacattttgggggaaaaaagtttgaaagaatgcctttttaaatccattgagaaacatggatagctgatgctgtgcccatactcaaacttcaaaattttctggcccagcaaaaaaaaaacaaaaaaacaaaaaaaaaaaaacctactaaaaaataatagtttattgaagacaagaaaaaaatattactctgccttattcatatgcctgggaatacaatatatttgaaatgtattatttctaaatgaataacaaacttgtaaaccaacacaatcaaatgaattcattttcatactagttatgtgttacagagcaacaaattactccagattgtagtagcctaaagcaagaaactcattatttcacagtgtctgtgggtcaagatttcaggcacagcttagctgagtgcctgtggcctgggtctctcacagtcaagatgcaatcaagatgctgatgtcagtgagggccgcactgatcataaggcccaagagggtaaagatccacttccaaaatcattcaaatgctgctggcaagtctcagctctttgctagtcatcgactgggcacatctgttctttctcatggagcctcgtcatggggctgaccacatggcatcccggttcaccaagagggagagttctgacacagagagaggagacagcgagagagagaatgaatgcacaaaacagaagccacagtcttgtaatagtctaatcatggaaatgacatttcatcacttcaccgtattgtattctttggaagcaagtcactaggtccagcgagtctcagagggaggggattatacaaaggcatgaataccaggagttggggatcctttgggatcaccgtagaagctttcctacatatccttctttcctaccttgtctggataagttctgtctgttcctggagacagctgaagaatttcctcttccaggaagctccctccacacagctgagcctcctcctctctgcttctgcagcagcttgggccccctgtatcagggcatcctgaactgcacaggtgccttgtgagcacctgtctccttgcgtgtctccctcttcgggctcttattcctcaacagccaggttcctgtcttactcaattcccatgcctagttcacagcacagaccgtgtgctatgtacagatgtctcgtatggagctataaattataattgaacataacagaatttcattcacgttacctgcagaaaataaatactgcggtgaatctcactcacttgcccctaatactcctctgcaatatttaagcacggaggtcaaacagtttcctccgtttgggaacttgatatttaatgaaacattttatgagtccgttgacattgcttacctcagctgcagttccacagatgacttcggaatgtgtgaaatagatctcttattcttcactgataaaacttcgggtcagactctcacacaactgcacacatggtagctttgctccactcacaccttgtctacagcctagatgtttgcaaatagtgctttggtttttctttaaaatatccttttgctattactatatatgcccactgctttgttcagttgaaaaatagcgtggctagccgggcatggtggtgcctgcctgtaatcccagctactcgggtggctgaggcaggacaattgcttgaacccgggaggcggaggttgcggtgagccgagatcacaccattgcactccagcctgggcaacaagagtgaaactccatctcaacaacaacaacaaaaaagcgtggctctgttatgccctggcactgtgctaggtccccaacattcacagaagactaaaatataatttctaatgtgggagacaaaggtttataagccaaagagacacaactcatcagctggattttgcactgtgacaagaactgacttagaggagcgtggctgtcttctaattcagggactctggagggatgtgtaactaaggttcaggtcagcacacccaatgcaacatgcatactctgtgcagaaagtaaattgaaaactctgcttgagggtctcagtggacctcaaagcagccctgacattttcttgtaagttagtgcagcataggagttccaattctgcgttcatcctccacagtgagtccccaggagagggaccagagaatggagtaaaaacaaagggaagggagagaaaccacagctctagtggtcacaatgacaccaggaccagtagaagcctgagtcatacaataatttctactggttcagtttctactgaataatttccaccattaaaaatgactccaagcacttacacatgggtgaaacctagaaagtgaaacaattgcttgttatatcttgttagcaggcaaagaaaggatggtgaaatcagctgttggtgaaattctgacagcagggaaagtcgggggctggcatttctggcaggcatgagagccacaaacgggtgacagaatatctcaagagacaatctagccttattcttaatttttgcttaacatatttgttttgacataacattctcatacatctttaagttgagaatcagaaacatgtctttgttataataatattgttgatgtcaaagaaacacagagcatatgctgtcttaggaattctaaatggcaaatgacatgtgtgtctgtataacaaagacaaggagagatagagacaaatataaggagagaaatgcaaaccaactctcaaagtccttaaatcatattataagtgggcaaagacaaggaaagacagaaatagagacaaatataaggaaagcaatgcaaaccaacactccaagcccttaaatcatattctaagtggataaaatgtcacatgtgaaagaagtgagataccagatacttgtgggaactaaaaatggttgggcgtgtccagagcatataaagaatgggcagcagatatagttggatgggtaggcagaagctagtgataaaatattggatatcttaaaccaagtccttgaactttattctggaagattgtgatttaatggatttaatggggctgtacgtcttaacataagaagggaagattatgttaagaagccatacatagggaaaaaataaattctctcggatcaagttacttcagtaaacatatttactaactgtattaatattatgactctttcatattccgatatgttgtttcctaaatttattttccaacagaaactttttcttggggagcatgggtttcaggatctcaaggagccagtagtccaattgttttagaaaatattgttaggctgggtgcagtggctcacatctgtaatcccagcacttcggaaggttgaggcaggcagatcacttgaggtcaggagtttgacaccagcctgtccaacatggtgaaaccccatctgtactaaaatacaaaaattagccaggtgtggtggtgtgtgcctgtaatcccagctactcgagaggctgaggcaggagcattgcttgaacatgggaggaggaggttgaagtgagccgagatcaccccactgcactccagcctgggagacagagtgagactccatctcaaaaaaaaaaaaaaaaaggaaaagaaaatattgttgtggaaaaacattgcaggaatgcttgaatctttggcatttttaaaaaatctaattcacagtgtgactttgggacaaataagttcatttgtttgggctttctcttgtggactaaggaggtagaagaaaattaagcagtttctgggatcccttctggcagtatattctcctagtctatggaaaatatgctataatcagcctgtctggaatatagatatcaagctcgaggtaaagttttactcgtgaggattaaatcagtgagaagtagcatatttaagaaaaaaatatacaatcaacttgagcactctaataatggtttagtgctcattgcttgaaggaataatttttgacaaggtcctgattttaaaggctaatgttcattttttgcctcgaccataagtaagagctagaacctgtagtatataggtcaacagattctaaaatatatttcagtatgtgctcaccaaatcaattagattttttaagtgaaaatgaaaacctctttgagttcagtcctaggctagctggtaaagatggaggaatcatgtgctcatgactagtcctcttccaccggtatgtcaagtattaagagaaagaagaaagacgtttccaaataacttgggatttggggactttggcttaatttgtacttgtatttgtttccttagactataagccacggattaagtttttctgtcattaaggcaccattaactattagaacaggttaacattaaccaatagaacaggtatacctttgatttccatgaattatggaagacaggcatttctttttttttttttttttttttttttttgatggagtctttctctgtcacctgggctggagtgcagtggtgtgatctcggctcactgcaagctccatctcctgggttcacaccattcttctgcctcagcctcccaagtagctgggactacaggtgcccaccaccatgtatggctaattttcttgtatttttagtagagacagggtttcactgtgttagccaggatggtctcgatctcctgaccttgtgatccgcccacctcggcctcccacagtgctgggattacaggcgtgagcaactgtgcccggccaagacaggtatttcttttcatattttataaattagaaaaccaaggtttagaaatcttagagagcatacccaaggtcctaaaaagtgaaaagctgcaaaattggaaatgcagcttaagtcctctcagtatgcgcagcgttatacctcattttctaaaagatagcatttctcaagaaaatgtatacatactgtatgaaagtccctgtaaataatgcaaatgcttgttgaatttttaaaatgtattctgaaactcttgtcaaaataatagttagtttttaccaagtagcatcagtagccacattacatagcagaatttaaattataatggcttgaatcttcttactctttggcacaggtgagaccaggcaggcacactagggaggggcagatgtgagccgtgtaactatctcattcccttaggaagccctttttacaaaagcaaagttggcttctgtcatagttttgattcttctcaagtcagattctgagattaagacccaggctggcctgagactaggagaaggattatttgggaggttatcctggaaagcccaagtgaaggagtggagataataagacaggagagggaggaaagcaaacaaacaaaaaaagtgcattgatagggagaaactgctgctattaattgagctcaatcccactggagagtctctgagaaaccttttggtacgtggggatgctgggacgttattcactgactcctgtcctgtgttggttcagggtggactctaaggatattgactttcacacacttccaggttgcacctatatgtggccaagcaggctccctttgagcccaaggaagtccatgaagagacataagtttctgaggtgggaagctgtttactctaaatagtcaaactcaattgtggctgaactcagaagaatatttaggggagaaaaatacatgaagttctatttcctcattcacagggatcgtggcataaggcagactgcatgggttagggtagtttgggctgccagtaagtgtaacattctctgtgcgaaggccacattggttggttttctaaggatgcaggtgtgtctcatggcacaggaggccagagaagggctcagaaaggctgcagagcatgaacagaaccttactcattctgtctctcacttggtctccctcagtgtgctagctttccctctctcctttacacacaacactcacagacacacatgcacacacatacatgtacacacatgcattcacgcatgtgtgctcacacacagactagctttttctgtttttcttgtacatcttacatgttcctggtttaatcataagacaaatggcctctctcttctggtaacaattttatattcctggtcaagggagctaggttggcccacacatgagagggaacagtggaagtaggatgtgtaatgcccagaagaacaggcatcggaggagagcccaggagttgattctatatgtaaatctgttataataccaatccgaacaagctagtattctatcaaatagccaaatgcagaggtaagcaggaagtaagtaatatcttttgtgattttttaaaatgacacacagtagatgagctcagaacatatacagtacagtagccactgggcaaccattagataaacaagaaaagagccagaccatggggatgaaaccatctttaatcatggcaagtggaataatgtgtaaaaaagttatgctaatcataaaatggaaacgatacatgtccattttagaatcaaatggcacagaaaatatgtgagcatatcagcaccatctatctacattatacccttgagagcttgtagattctgagtttaacagcaccatatcatgaaaaatgacactggacaatttggattgtttttataccatgggtctcagtgagaaagtcagctttctctttcccaatgcaaataaagattagcaaatatatttaatatttatacctgttctggtgattcattttggcttttgaaagtgaactccaccataaaaagataaaaaccaatcttccttttctcattccttccattattcattcatttattgatattactatattataggcactgtgccactctctctgtagaagcgcctgacagtagaaacaagggcttcatcctcctggctatgatcatgaggctacaacataacactgtggctttttgagaattatttcacagcctatttccagagcaaagtaacaatgctgttttttttttggtttctattttcttgtttgtttgtttgtttatgaagtcaaactattatggtgatgttaccaacttctttcaaagcagaggccagggaatcaaggacgttgaggcttaataaaataaaagcaaagtatgtttgtatatttttcatgtgttaggactacaggtttccagaaaataaacctttagtgcataggcaattttatcattagagatttcaaaggggatatgcatttatcgctatcaacagagccggataaaaagatttttttctgactatttccataatgttccattatgtttttaaacatgaaaaatttattccaaaggccaggaaatcacaggactccaccaggtgtgataaggtcccaatctaataaaagtttaactatctctctggctattagtgtttatttattcaagaaaggtccagaatgttattttgaatattcagtgtattatcaataatcgtggggattgtgatgacagtagtggcaatgacaaaaataacatctgtattagtctgttttcacactgctgataaggacatacctgagactgctaagaaaaagaagtttaattggacttatagttccacatgtgtgaggaggcctcagaatcatggtggaaggcaaaaggcactttttttttttttttttgagacagagtcttgctttgctgcccaggctggagtgcagtggcacgatctcagctcaccacaacctccacctcctgggttcaagtgattcatcagccttccaagtagctgggactataggcgtgtgcctccgtgcctggctaatttttgtatttttagtggagatggggtttcactgtgttggccaggctggtctcgaacttctgaccttgtgatctgcctgcctcaggctcccaaagtgctgggattacaggggtgagccaccgcacccagctgaaaggcatttcttacatggcagtggcaagaaaaaatgaagaagaagcaaaagcagaaacccctaatagacccattagatctcatgagacttattgactaccacaaaaatagcacaggaaagactggcaccctggattcagttacctccccctcagtccctcctacaacacatgggaattctgggagatacaattcaagttgagatttgggtgaggacacagtcaaaccatatcattccgccactgactcctccaaatctcatgtcctcacatttcaaaaccaatcatgccttcccaatagtcccccaaagtcttaactcatttcgacattaactcaaaagtccacagtccaaagtctcatctgagacaaggcaagtcctttccacctatgagcctgtaaaatcaaaagcaagctagttgctttctagatacaataggattacaggttttggacaaatacagcggttccaaaggggagaaattggccgaaacaaaggagctacagggaccatgcaagtctgaaatccagtggggcagtcaaattttaaagctccaaaatgatctcctttgaccccagatctgacatccaggtcacgctgatgcaaggggtgggttcccatggtcttgggcaactcctcccctatggctttacagggtacagcctccttcccagatgtttcatgggctggagttgagtgtctgtggcttttccaagttcaaggtgcaagctgtcagtggatctaacattttggggtctggaggatggtggccctcttcttacagctccactaggcagtgccccagttaggactctgtgtggggactccaaccccacatttcccttcctcactgccctagcagaggttctccatgagggccccatccctgcagcaaatttctgccttagcatctaggcgcttccatacatcctctgaaatctaggcagaggttcccaaacctcaattcctgacttctgtgtacctgcaggctcaacaccacatggaatctaccaaggcttagggcttacaccctctgaaaccacagcccaagctgtacattggcccctttcagccatggctggagaggctggtacacaggacaccaagtccctaggctgcacgtagcacggggaacctgggcctggcccatgaaaccactttttcctcatgggcctccaggcctgtgatgggaggggctgctgtgaaggtctttgacatgacctggagacattttccccatggtcttggggataacattaggctccttgctggttatgcaaatttctgcagccggcttgaatttctccccagaaaatgggtttttcttttcttttttttttttttttccgagacaaagtctcactctgtcacccaggctggaatgcagtggtgtgatctcagctcactgcaagcttcaactcctgggttcacgccattctcctgcctcagcctcccgagtagctgggactacaggtgcctgccaccatgtccgactaatttttttgtatttttagtagagacagggtttcaccatgttagccaggatggtctcgatctcctgaccttgtgatctgcccgcctcggcctcccaaagtgctgggattacaggcatgagccaccatgcccggccaggtttttcttttctatcacatagtcaggctgcaaattttccaaacctttatactctgcttcctttctaaaactgaatgcctttaacagtacctaagttacctcttgaatgttttgctgcttagaaatttattccgccagatgccgtaaatcaactctctcaagttcaaagttccacacatctctagggcaggggcaaaatgccaccagtctctttgctaaacataacaaaacttacctttgatcctgttcccaataatttcctcatctccatctgagaccacctcagcctggattttattgttcatgtcactatcagcattttggacaaagccattcaacaagtctctaggaggttccaaactttcccacattttctgatcttctcagccctccaaactgttccagcctctgcctgttacccagttccaaagttgcttcacacattttcgggtatcttttcagcagcgccccactctactgctaccaatttactgtattagtctgttttcatgctgctgatgaagacatacctgacactgggaagaaaaaggaagtttaattggacttacagtttcacatgactgaggaggcctcagaatcatggtggaaggtgaaagacacttcttacgtggcagcagcaagagaaaatgaggaagaagtaaaagcagaaacccctgataaacccatcagatctcatgagacttatttactatcacaagaatagagtgggaaagaccagcccccatgattcaattacctccccctgagttcctcccacaacatgtgggaattctgggagatacaactcaagttgagatttgggcagggacacagccaaaccatatcaatatcttacttttgtattaaataatatgattcctgaagtagttactcatatactgccccatttatttctcataagaactctgggagaaaaaatctatcacctctgttttactgatgagtaaatgtagactgaaagaattcagatgatgtgtaagagaacacatagattataatgacaaagctatagctggaattcagtttctgtttggggatgttgttttgttttattttgatcttagaaaaaactaaaagttatcataaaagactttattctaactgcaaattcaaagataatgtttattcatgcctaggacaaaatttctattaacaatcaaatattacagaaggttgtgaatttttgatgacctgattatgtttacataagtctctaccttttctaaacctcataaatatgaaacctttgggtgaactcttcccagaactgatttccataaacttactgaaaatgagtaggaagaaagagctcaagggacaagtacttattgtgtatactctttagtgatacagaaataaaagaaaagttaaatacctatatttataaaattgaatcttttaaagtcagctgacaggtcaaaatgcaggtaacatttttaagcttcatgcttaaaaaaataagctttatttaaaaaaaaaaaaatacttacttggagccaggcacaatggctcatatgtgtaatcccagctactcaggaggctgaggcaagaggatcacttgagcccaggagatcccatctcaaaaaaaaaaaaagcaccttactttttacttcattgcctcagtgatagcagaccaacagggcattggtaagaatagttttaactatactcacaatcatatactggcttcagttgtactagcaacagttaaaattgaagacacattaagcatgtaataaatgtgaactatcaataagtgaaaccattagaactagtattaaaccgtttcattcttaacatcctttacagataaagaatcagagactgagagagcttaataataccactattcagttagcaagctattctgtggtttaaagagatcagtattgcctttaactttctggcttttagaatttacgcaattctctatcaacatggaggctcaacctgattttggggcattgtgtaagccagtagttttcaacctggagtgattttgacccccaggtgacatttggcaatgcctagagacatttgtgattgtcccatttggttggggttgctatggtatctaatgggagaggccagtaacgctggtgaacatcctacaaagcactgcagagcccctggcaaagaattttccagcccaaaacgtcagtggtgctgaggttgagaaaccttgatatagccctctaagactgaatattaatgaaaatgtttatttaaatcagtttgtatggtcccagtgccacttagaattatatttcttaacaagttagagctcaatttcctctgcccaggcctccttaggatacagaagaataagccagtagtacccttacacggaacaggatagggcaatcatatgattctgaatgccaaggggactttcagattgatggtttcgtaaagtgactgacaccttggacggttcccaagaaaattactaaaacttgagtcttttgcaggtatgcaaaacccatgaatttcataaaaaataaatctttatttcaaagatgggacttttaaagtttaaagtggccttcgggtggagaaagaactaggaatcaaaatttcaatgggcaataaaaacaagtgataatttcctttgattctcacaatcaagatgaagcaggattgtgataagagcttagcatttctatccactcgttgaaatttatcaaatgcctctccctgacttctcgcccttacactgaagtagatatccaaagacttcagatatatacactatggacaagtatttcccctcacttgcagaaattcaagtggcaccagcagtttggagacagaagtctcagtgggcgcaaggaagctggggtctggggcctgactcttccctgccattttggtgccccttcccgcctacccacgccctaccccaatgtgtggcattatccagggggttattaaatattgaaatacagcttgacaaacatctgataacaataggtggccaaggccgggcgcggtggttcatgcctataatcccagcactttgagaggccgaggcggatggatcacctgaggtcaggagtttgagaccagcctggacaacatggtgaaaccccgtctctactaaaaatacaaaattatctgggcctgatggcgggcccctgtaatcccagctactcaggaggctgaggcaggagaattgcttgaacccaggaggcggagcttgcagtgagtcaagatcgcgccactgcactgcagcctgagcgaaagagtgagactctgtctcagaaaaataaaaataaataaataaataaataaaaaggtggccaccagctgtgtcaaaatcaactagttaaaaggtggaaattaaatatgacagtggaaaaagatttctagttggagaatgaaaacttcctaaaatctaagatggctgccattaaatgatattcagattcttcccgggttcttgcttttggatgaataaatggctttttcttcctccaaagttctaatctgatgaatgtgtaatggagataaatgttttggaaatatctccatttgcctggctcctcggtgtctctgtgtaggactttctccccactcaggccaagcttccatctgtgagtggaagatggggaggaggcgaggaccgcgaaggtcacaataagaatgcaaatacagcagtaaaaacagtttaatattcaccctctgtcagcaaaaataggctttcctagtctgcagcaatgtactggaacagacgtaaaagacaggcgttgccaggaaatagggatttactaaattcctttatattcccatttaatatatcaagaggcagtcctggtatccttgatcatatagcatttcccaacaaggaggttagaaccagacaggaagaggagagaaatccacacatactcaccccagtaggggaagaaacaaatctctgaagctctgagcacttacatgactcaccgtggcaggaactaagctacccaagacaacttttaaaattattgcatccacagagtttaccaaatgagtctgaaatttaacatgtttcttttcccagcattttaaaatcaattcctcctttgaaactcctctccaattactcttcatctgtataaattcaaatatattttcattcatttactcattcaacaaatatttattgagcatctatcacgcacagggtgctgcgaatgtgccagtgagtaggtacagataaagtccctgccctcttgaaacttactttttagttggagagaaaaagaaaagtaaatatcatttctggctgtgataaatttcatgaagaaaaacaaacaagaacttcctggtcctcgtgctcactcccttccaacagttttgggggacaccaaagggacagagaggagtcaagccccagaccccagctgccttgtgcccactgggacttctgtctccaaaatgctggtgccacttgagtttttgcgagtgaggggaaatatctgtccatggtgtatgtgtccgaaatctttggacatctacttcagtgggagggagaggagtcctggagagggctcagtacatttcaaggtggtgagagcagtgctaacacgcagcgttctctgacttcctaatgtacctccctctctgccatcagactaaaatttttcaatagctgcttgatgcaatcactttctttttcaagacccgcaactgctcatactgcctgatgctacctcccaggccttgaacatagcttcaaataatgtgtttaacctatgcctggccgtaaagcctcccctctcaccacgccacctcttctaaagtcacataaaaatcccagttctctgtccacacatctaagaatggacactcctctgtcttctcttccctatctttctaaatctgacccttttattaagattcaaccagtttcctgcctgctctattccattcaacacccagaccacagtgatacctcctttgtctaatctttcacaatacactttagcacgttacagattcccaaatgtggaaagaaccatgctggtcttttagtctagcattaaatacaatgtgagtaacacagttataacctttctaataggtagtctcagactttcacactctttcctaatgtttttcaaataagtacatttttaaaaatgcaaatacacagtggtaaattaaattattttgattattaagcattcataatcataaagctatgaataaatctgtatgcttggaactcttatataatcgtaaaagaaaacaaacttaaaaattatattcaaactgaataacaaaattcattcattccaaatgatcaacattaatttaatgtgacatgtaatattttgctaaagtaaagtacctattctcaatgtaaatgtggtattggctactatcaaatgcaatatgtaatagtggggccttacttacctacaaaggccatctctgtcattttttcttaaagaaccttaaaaaaaaaaagttgtagcttcttactaaagaaatctccaatgctaacacaatataagcgtgacttaattacagggtgataatctagatcatgtggacttttcagcccattaaaaattaaaatgaaaaatctaaccattttcaaagaaacgcacatcttttatcatatgccttcatataacaagggtccagaaatccatgttataaaggtttgtactgattcaggtgtttatattttgactctgaaaatggatctatgtaaaatgtgctgacaaaaagggctatttttaagttttgtgcatttttccttatagtacctaaaaatgcatgtagcacatgctggatgttaactaaagattccttgaatatattatctctatttattttatttcttctgatgtgaatttgaaaaaacatttatttacagaccactaaaaatctcccaggaagctgagttagtggtgactgtttgattctaaccttctgaacaaatgttttcatgaactccatgaagctttttaataaacttactcctcacagtgatgcaagtcaaatttaagacagaagaaactaaacgttcatcggtataagaaaatctaagtcaaggtggccaaaaaatcaagcaatcttttaagaatgttgaatcaaatgtggttgttggtgaatgaaaatttcttctattgcagacaattatttgaagggtacatctttttaatactatttccaactgtctcctagagtgatagtagccctgttaaacaattagtaaaacaaacaacaacaaaaaacacattaggccaagtgcagtgactcacgcctgtaattccaactctttggaaggccaaggaggaaggatcacttgaagccaggagttcaagaccagtctgggaaacatagtgagacccccttctacaaaaaaataaaaacttagcccatgaggtggcacgcatctatagtcccaactactcgggaggctgaggcaggaggatcgcttgagcccaggaggtcaaggctgcaatgagctgtgatcatgccactgtactccagcctgggaaacagagtgagattatatatataaaaaaaaatccctcctatctttgaaattttcatagagccacctgtagtttggatgtttcccagggaacacaataaaaacaaattcaataatcctcaactaaaaggcctgatatcatgtttatgccagttttttttcctgagtattttaactttttttctctacttagtttcatcaattaaaggcttattgttaagggagaaaagcattaggacccctagtaagatgctccagggagtgtgttttcagctcaatgtaagaaaaaaatttttgaaccgtcagtactctttgaaactctgtttattccaagatagtgaggtgtctcttaatataacagcttatacaggggctgaatgatgccagctttgggcttaatgttgtttttaggttatctagacagttctgattttagaatgttcataagttaggtctgaattaataagccaataggttcttatttcaaaagaatatatatatacacacatatatatacatatatcaaaaatgtgagctaaattcccatttatctttagtattctccatatctctttcatttccagagtaatggtccttgggaagataatagctagcataatgagacctggtacttacacagcactcaataagtacaagactctctaaatgttcattcctcacaaaactctatgagatacattatagtgctattccccttctacagataatggaactgggacactaaaggttaagtgatgtgctgatacttccaaagctcataaacagaagagtcatccagagccaaactattttggcttcaaagtccaggcacttagacagtgacgctatccactcactagtaccttctggagaagccactaggatagtctgagaatattactggactactaaacaaattgagattcttgaaagctgaattgtgttgtgtttttaccccatcatcacaaacctttacatttgttcagaccaggaaaataaatgtcagatgccaatgtagtgacactatcaactcccaggtgtaatcaagtagagactgagatccctacaccaagtcaaaaacttttatttctttgcatactatggaccatggtgtcaggaataatcacaacccaaagaatcagggaatacagaattttagagctggaagcatttttaggaattgttcattctttctttgttattacagaaatgaggatactgacttctactgagaggatcgtatttcaagaccatgtgatggctttataactgctctttctgactctactgttaactctctcatgtccaggctcataccagccaaaggaaattcgtaataaaatttgatcctctctataattgctattcctgattccactgttaactctctcatgtctaggctgataccagacaaaggaaattagtaataaaatttgatcatctcattctgcttctttacactccttcaaatgttctgcattactttgagacttaatcaaagtccttcagttaaagcatcagttctttgaagacctggtccctgattgtctgcagtctcatcagctcctacttgctcctcttgaaatctggactccagtcactctgagtgtcactccagaccccccagaacatcacactcttacctccatcctttacacatctctttccttctactttcacagcacttcccctggactcttctgtctgcctccacttcatttttcagaatgcagcttaatacctccaaagaaagtcacctctaacccagaggtcacatttgttctgtttagttattcaaactcccaatttaaacaagtctgcctatattgtttcctaacctatgacagatataaagagtaagttatatttctgtgcattaggatacaagaagagcaattagaatttgcacaatgcaacatgacatctccagtaacaatatattgcaaggattcactacttataaaaagggaaacaaggagggcagatcacaaggtcaggagatcgagagcatcctggccaacatggtgaaactccatctctactaaaaatgtaaaaataagctgggcatggtggcacgtgcctgtaatcccagctacttggcaggctgaggcaaaagaatcgcttgaaccggggagttggaggtcgcaatgagccgagatggtgccactgcaatccagcctggtgacagagcaagactctgtctcaaaaaaaaaagaaacaagttaatgaaacaaaattttctgagatcatttggtaaaggtgtcagattggtgcagcgtaatccagtgattgatgtaggtaattttgaaacctgagtcagcaagaaatagcaattatatttaatgtaatatgatgaaggaggcagaaaactgcaataacttagaatgatttccactaaagatacttaaaataaaatgagttttagtgcttatagcaaggaaaactccatttatgtttaacatctacttcttttaaaaatgtatacgatatagggggaagatggtaacagttagaacacccaaattctggtctggtaattgacactaaattagtgagtgactttgagtgagtaagccatatgatatctttgactcttagtataatgcagtggctaggaacaggggctataggctcaaatctcattctattccattactttcaagctccatagccttctgttactttaattgctctaagcctcactttcctcctttgaaaatggaaagaataataccttcctcataggattactgtgacaaacagaaggcacaacacttacaaaacactcagcatagaatatgacacataggaagagctcaaacagctgttgttgttgttgtcgtaatataagtagttacagtgagggagatagatcacatgctctccgaggtcttctcaaattctaaaattctgtggttctatgaacaactcgctcccaaatgatgtcagataaatgagatctcactgtatactgggcaataaaatcaatgtggtcaattttaaatcgtaccctgtaaggtaaggttgagcaggtcatgaattattcaaaactttggttacactcaatatatttctatttgatcatggaatgcatagaactatttaaaagagcatttttaaccttctcatattatgtttaatgattaaaatgagtttgatctttccgtgttcactaagggaaaagaaatggagcaatgctggatagtttatatatgtgccccacttaatcattagcgatttaggtgaaatcatcgagcaactttttgggtaataaaaaatgcaagcaggatatacagttttggcccagataacagacatgcctataaatgagagccagtggcacatcatctccttatgaagctttttcagaatttcaggtagttcaggtccatatgtgctttgaaattctaagggtgagaagatgactatcacgtgtttttccaattatatcttaattttcaaaataggcttattgcagcattgatgtctaattagagttgccggacacagtggctacagtccaatgctataataatctaattaactaaactctccacttatcatgtaagtgcctcctcacctaccacacacttcaccatttaaagtgatatccttttcctttcttcttttttaaatgaagaatttgttcagggagacatttggattgttcagtggtaaaaaaaaaaaagctccaaaaaaaaagcaaataagaaagtaagagtttgtactggacagcagaagtgacatcacctgggcaggcagagcacctgttgaaatccaagacttcatttacggactagctgtgtgactttggcaaattactaaatctccctgagacttagcatctttatttgcaagctgggaataatcggaggaagttaactgagaagctattgggacttaagcttcagggccttttatttgtgtagggcatatatgttcacatagtcatatgcttatgttaagtttacaatgttaagataccttaactgtgactagctaagagctctgtctctttcagtatgactttcttccatcacatggtgaagatctttggagaaaccttgaacaggtttggtgtcatgctaagggaaagttgagatccataaatttgtgtttagtgacaatatttatgtgctctgaagttatttctctatattgtcacatattgctaggcatctagtgtaggaataattttcaagtgcactcccagtgcccatgttcagacctacatatgtatttgtatttaaatatttcaatcttttcttaaagagagattccaaaatgacattaaattcaagctccagaaaacctagattttcctttggggataatgatatgctgagaccagctcagctggggagaccctaacccagcagtgctagaggaattaaagacacacacacagaaatatagaggtgtgaagtgggaaatcaggggtctcacagccttcagagctgagagccccgaacagggatttacccacatatttattaacagcaaaccagtcattagcattgtttctatagatattaaattaactaaaagtatccctcatgggaaacaaagggatgggttgaattaaaggaataggatgggctagttaactgcagcaggaacttatccttaaggcacagatagctcatgctattgtttgtgacttaagaatgcctttaagcggttttctgccctgggcgggctaagtgttccttgccttcattctggtaaacccacaaccttccagcatgggtgttagggccattatgaacatgttacagtgctgcagagattttatttatggccagttttggggccagtttatggccagattttgaggggcctgctcccaaaaatgacacctaccttatactatttctatgaagattaatgtgaaagttttttcctactttcctttgtttgttctgttttgcattctcattcttattctgaacaactctataataaggacatgaagattatctaattcagagtttttatgttttattcccaagcacttctaccccctcaaataaaaccataggcgtgatcttgatgcatgtaataagccagtaattgacagaatttatatgaagcttaaccctcactgtttgggtatatccatctctcatttctgtaaatctccaaagaaccatggcgagcctcaggattccatacgctccatttgaaaacccatgatttaactcaattccctctttttataatggaaactaatttcagagaggctaagtaacctcttgtcttcccattctatgttcaattcaccatatcttttctgtaggtttatgatagcaaacaattgttattatttattagttttaaacacaaagctacctgttttaaacaaaacaatttataaatattcttcatgtcatggaatatttattctagaggaattaaatctttaaatataagtgtttccaaactggaagaaaatacagaagactacatgtacaaatgaggctttgaggtaacctattaccaaagccatcagagatctgtaaaaatctgaaacttttgtgtgtaaatgtacaacatataatgttgttctccacatactaaattggcaaattatgtttgcaacagttatggcacatacaaactgctcttagaaatataaattatgcaaagaatgatgactcagaagcccacagaagagcacatttcaatggccccagacttccaaaaaaaaatttcaggctcctggtaatgagagaaatgcaaattaagtagcaatgaagctctcacttcacatccatcagagtggcaaaaaattaaaagtgataataactactgttggtggggatgagttaaaagggtactttcatttatttctggcaaaaatgaaaattgttataggctttcagaaaacaattttgaaatatctattccaataaaaaaaaaatgcaagtcctctttccagggccacagcatgactttcatgggccctagaaacttgtgcctgtgttgtcttctttctctattaatattatatatatatgtgataagatttggctgtgtgcccacccaaatctcatcttgaattgtaactcccataattcccatgtgttgtgggagggacctggtgggagacaattgaatcatgggggcagttcccccatactgttctcgtggtagtgaataagtctcacgagatctgatggttttataaggggtgtccggttttgcttggctctcattctctcttgcctgccaccatgtaagatgtctctttgctcttcctttatctttccccatgattgtgagcctccctagccatgtggaactgtgagtccattaaacctctttcctttataaattactcagtctcgagtttgtctttattagcagcatgagaatgaactgataatacacacacacacatacacgtactcatagacatatatatgtatgtatacatatacagacagaaaatatattttatgattgtgttggtgtaaagaggaatataagtcaaactgaatttattattactggatttactttttcttaaatttttaagataaaaatattccctgaatccctaacatcttgtgggccctgggcacgatgccttttgtgctcaacaatacaagccctaactcctcactcagaaatttgtctactgaaaccagaactttagtgatgtttactttcagcattttggtagtagcaaaaactagacacaaagtgaaaaccttcagtgggcaataattgagtaaatttggttagtatgataccattttagaaaaaaaatgtaagccaacacaactgtgtgtatgtgagttgtctgtgttagttatctattgcaatctaacaagcctccctaaaaattaagtgcttaaaacaacaatcactttatttacccatgattcgaataggttatcagtctgagataggctcttctgaataattctttgctagtcttccatagggtaattcatgcagctgtagtcaaatgacagcttgcctggggctgggcagtctgtgatgtccatgtccttccacacaagtctgatggttagtctgttcctcagctgggccatatgctgccagcaagccagcccagctttcttcacataggtttgaaaagcaacttttaaaacctaaggttgcatcactgatatgatttgactgtgtccccacccaaatctcaccttaaattgtagctcccataattcccacgtgttgtagagggacccagtgggaaataattgaatcatgggagacaatttcccctatactattctcgtggtagtgaataagtctccaagatctgatggttttataaggggtttcccctttcacttgggtctcattctctcttgcctgccgccatgtaagatgtgactttcaccttccgccatgattgtgaagcctccccagccatgtggaacagtgagtcaattaaacctccttcttttataaattacccagtctcaggtatatctttattaacatcatgagaacagactaatcaaatcacatttgctaatgtctctttaatcaaaacaagccatatgatcagacccagaatcatggtgggagggccctgacaagagcacagatgagaggaggtatgattcattaaagaacactactgtaaaattctgtcaatgtgtgcaattgcatatttatgtacacattatcatgttggtatggtaaagatcagcaggaaaaaaagaaaatggaactattaataattttattcagatagagtgaagttacttactgtttaataacagtttatattacttatatattaattcattaaaagctgtttatcaagtgcctactctatgctagatgagtgctgagtatagaacaatcttctggaaaagtgaacatcaagggacatgcccacaactaagaccgtttacttagttattgtaacaccatcttttgaggattaaaaaaagtagatatgtacttgtgcatcataatttcttagcctaggacaaatgctttattacagttaaatactcaatatgatttgtgtgaccccttggagcttgggtgaagccagtgtacagggaaaggagaaaagccaatacaacagtgcattgtcaagttgactgtggtcagttgagtcaggttttcagtcccagggcagctccctgaggaaacctctgaaacacatcgcagatctttctgcccaggagtacacatggatgaaactgattctcatcccctttgttcgagtgactccaagggcattgactttaccagatttttggcatatgcatgcatgaggccacatcaatttctgagactaaccctgctctgcagtatcaatgaaaccctcagggcaagaagcaagaggaacagggcagatgctgtatctgtgattagctaatcaaaacctaggagacattggttaccacagcagtggctgcagtaagaggtggggccaaaaggatataaattagtatacaagaagtgtctgatacagcccaccccttgcagaactgagacttgctcatgtcttctctcaagtctaatctgtcataaagtcatcttcaatctctgcaaagtttcaatacaaaagattggcagaataagtgataatccctgtattacagctgaatccaaggcaataattgatattatttatcctttccttcaactcatcctaagccagtatttcagctggttgcttgactgatgcagtgacccagactttcatctcctggagatctaggtccttagttaccttgctcttcaccagccactaatgctgcggttgcttaatcaccattaacactgagcacagaagcagcaacaggtattacattcaatcccctgggctccagacattcttctccctgcctgctagggggcagcagcgctgtctcctcagctcattcagataagctacctttgccagaacagtagtaactcctttctttgcttgatggtccactggcatgaggagctttgtttttgtttttatttttgtttttttgttttgtctttatttcttctaaacacacacacacacacacacaacaacaacgggatacatgtgcagaacatgcaggtttgttacataggtctacgtgtgccatggtggtttgctgtacctattgacctatcctctaagttccctccctgcaccccacacaccccaacaggccctggtgtgtgttgttcccctctccgtgtccatgtgttctcaatattcaactctcacttatgagtgagaacatgcggtgttgggttttcttttcctgtgttagtttgctaaggatgatggcttccagcttcatctatgtccctgaaaaggacataatctcattcctttttatggctgtgtagtattccatggtgtatagtgccacattttctttatccagtctatcactgatgggcattttggttggttctatgtctttgctattgtaaatagtgctgcagtaaacatgtgtgcatgtgtctttataatagaatgatttataatactttgggtatgtacccagtaatgggactgctgagtcaaatggtgtttctggttctagatccttgaggaattgccacactgtcttccacaagggttgaactaattttcattcctaccaacagtgtgaaagtgttcctatttctccacagcctcaccagcatctattgttttctgactttttaataatcgccattctgactggtgtgagatggtgtctcattgtggtttagatttgcatttctctgacgatcagtgaatttgagctttttttcatatgtttgttgggagcctaaatgtcttcttttgaaaagtgtctgttcatattatttgcccactttttgatggggttgtttgattttttcttataaatatgtttaagttccttgtaaattctggatattagacctttgtcagatgggtagattccaaaaattttctcccattctgtaggttgcctgttcactctgatgatagttccttttgctgtgcagacgctcttcagtttaattagatcccatttgtcaactttggcttttgttgcaattgcttttgacatttttgtcatgaagtctctgcccatgcctatgtcctgaatggtattgcataggttttcttctagggtttttatgattttgggttttaaatttaagtctttagtccatcttgagataattctgtataaggtgtaaggaaggggtccagtttcagttttctgcatatggctagccaattttcccaggaccatttactgaataggagatcgtttccccattgcttgtttttgtcgcatttgtcaaagagcagatgcttgtagatgtatggtgttatttctgaggtctctgttctgttccattggtctatatgtctgtttcggtaccagtacatgctcttttggttactgtagccttgtagtatagtttgaagtcagatagcatgatgcctccacctttgttctttttacttaggattgtcttggctatttggggtcttctttgattccatatgaaattttaaacatttataattctgtgaagaatgtcaatggtagtttgatgggaatagtattgaatctataaattactttgggcagtatggccattttcatgataatgattcttcctctccgtgaggatgaaatgtttttccatttgttgatgtcctgtcttattttcttgagcaatggtttgtagttctccttgaagaggtccttcacgtcccttgtaagttgtattcctaggtttttattctctttgtagtaattgtgagtgggagttcattcatgatttggctctctgcttacctattgttggtgtaaaggaattcttgtgatttttgcacattgattttgtatcctgagattttgctgaagttgcttatcagttcaagatgttttggggctgagatgatggggttttctaaatataaaatcatgtcatctgcaaacagagacaactggacttctaacctgcggagctttaagtgaccaggtcacagccattctttgaagtaaaggggaacccatatacttgacagatatggtaagaccaatgcctcccatggcaaatcctgctgaggtctataaaaagtagtcaccacagcagttctggtataagggatgagtcaagggatttgaagcagtgggctcgatgtgtctgatatagtaatatgtaatctacatagaggagttaattatccacaccatgtcttcttttcttcccccatttcttatcacatacaccctggaatcagagctatttatttaaataacacacgcattatatttgaattatttggttgcacatgctgtataaagcaatacattatttttattagaatgtcaatgatcatataattgtttgataaaaatttttcttttatggaaattttctctgaggggggaatatcacaattttcatagaaggatttagaagttgcactatataatgagaaatgagtactgcagatccttagcaaatatgactttattcttccacttttaacaacataaatgccttggaaaaaatcactcaatttgatcatgattgaaattcccggtggaaaaatatatttgggatttgttaattatttttcagtggggttctcttttttgagagagctgagtgatatggtttgactgtgtccccacccaaatctcaccttaaattgtaataatccccatatgtcaagggcagggccaggtggaaatgattgaatcatggggtggtttccaccatgctgttcttgtggtagtgaataagtctcatgagatctgattgttttataaataggagttcccctgcacaatctctcttgcctgccaccatgtaagatatgcctttgctcttccttcatcttccaccatgattgtgaggcctccccagctatgtggaactgggagtccattaaactatttcctttataaattacccagtctcatatgtctttattagcagcatgagaatggactaaatacactgagcatgagtggaagaaagtctcaaactgaagtgaagaaaaagggaaggggctgatgtggggagaggagcagtccctcagcagcaatgtcaagttcatttgctttgcctctggccactgaggaaagacaatgccaggcaactgtagagctgggccagcaccttctgaaacgatcttgttccccaaataaccacaacagatattatatagcaggtaaactaacaagtaaaggcagaagtgaaaaaaattgttctgtgaaaatatatgtactatatgtacatatagatatagtatatacgtttgtgtgtgtacttaaaccacaatgctgtaagaaatcataaatttatctgaaaatactgggtaaggagatagtatccataaaaaatactattcccatagaatttaaatattcagtgagctttcactgactaacttgcatacaccaggcactgtgctatcaggtatggatgtagcaaaaattatgatatggttcttatgtgcattaaggtaaacattatccagaaatatgtaggctttcttgttttcttaaattagaagacaaacagtataggtttctcctgttagctcaggtatatcattatcaggttcaactattctagcaggtggtaataaattgtttttcttctcatgctgtctgctgtaaataggatcaataaagtcagaataaagatcacaaaaactttcattacagtgcgaatagtttaatgcagcagtttctatgtgcctagattttggcagatgctttaagattctggaatatttgaaaatattattacttctctggtccttgattgtgtaaggaatgctgaagttattgactccttaatctctactgaaggggcttactttgaagactagcaatttcattatttgattctgattctgagatgactttaacagaatctcaagcaatgtaagccacatttagcaatcatagcaatagtctgatatttttgaaacctgtcctattataaaacaagcctacatttatataatcctcatatctcaaaagaagttggagaaagccactgcctgggaagttccttatcctgaacctaaatcagatgctaatatcttgttgctgcattggttttaacagtagactctcaaggatgctaatatcttgttgctgtttcggtttgaaaaaagactctcaacttgtattcatcgatgggtgttctctatttcttaacaggattatctatatttgaatcttcttttaactctgactgaagagctctgaaatcaccaataatgtcttcattactacatcaatacttaaataatggacaagaaattataaaggcttagcaaagacattcagattattatggccttttgaaatatgcaccataaactattaacttagagtgcttggccaaagtaaaacttgaatatcccatcaaattcctcatttttatgagaaaatttatactcagaaaatttaagtggcaaataatccaagtcatatggactgtaagttacagaaccaagtcacaaaaaggagttctgattcttgatctaaaagtcttcccactgtgtccttctatggccttcagttttgggcggtgtattttgtttgttttttatttgagttatatgcgagtttaaacacaattctttctgctatgggaaacggcctgtttcattttcaaattttgaagctcacattttttaatggtttattttttcattaaatttaaaaggctttatttaacaattaaaaatcagtcctattgcctcattcattgaattccataaattacagtaaaacattttaaagctgtaaattagtatacaaacgtagctatctttttattatttgaatcatagaatgactttaaatgactaaagtttgcatttagaattaacactttttaatttaaaaatctgatttttcatttaactgtgatttgtttagctaaaaacaaatggagaatttgaatttctttactccattttactttcctcaacacacacacacacacacacacacacacacacacacagagatataaataagaaaaatctacacttccaagagtcatttccttagtgaatcacatccctcacttttctccacactgtccttcaacaatgagaataaaatacgccttcttcctccataatatcagtagaaacaattcagcacaatgtttaaacaagtgttaggaccctgtagccagaattcctgtgttcaaatcctggctctgcctttttctaggtgagcaatcctagacaagttaactattaaataattgctttgagcagatggcagtgacagagcccttgaagaatagctctctctccaggccagcagaagaaaaatgacagtgcaagacacaggataggacagtcaagaggcaaaaagaaatacaagctaagggcacagaaatgaagagaagaatgtttccatgaggagtcagccaacaatgacaatgtctactaaactcctagagaatgagaacgtagtgaaagcccagggtaggtatcagtgacattcttgaaggtgagacagcagtgataacattctgacttgaggggctaaggtgtaagtggtgaagaagcaggagttcccctagattggacagggaaacgggactagcatgtagcacgtgtctacctgcccttgaatctaagatcgcagagaccagtgcagatgaatagagaagatgcagccaatggaaaaaagagaggaggtaaatggagaaaaccattaaatgatctcaggacaagcatggaatcacatggttctggggaggaagtgtaaggaaagtccttctcttgtcttccttgcaacctcctattcatcctataagacttagcataaaaccacttcacaaataaagtatttccaaactgtcctaaatcaacttatccagtttatttttctaaagtctctgagtactttgttttataatcttttataacatctaacaaattatatatattatttagttaacatgcctgccccatgtattacatagcaaattccccagagctaggatttatgacttttttacttttttcttcctagggcaaggtatagtgttagatactactaccacattagtaggtgttcctaaaataattagcaataagaaaggggctgaggtggtggtttgcgcctgtaatcccagcactttgggagggccaaggtcaggtgtaagagaccagtctggccaacatggtgaaaccctgtctctactaaaagcacaaaaattagccaggcatgctggcgcgtgcctgtaatcccagctaccaaggcaggagaatcgcttgaacccgggaggtggaggtttcagtgagccgagatcgcgtcattgcactccagcctaggcgacgagcaaaactctatctcaaaagaaaagaaaaaaaaggaaatgagagagagaaggttagagatgggaatggagactcaggagatgcagcaacataagcaacctctataggatctgagcaagatgaactggatgctaagcttcttcgtccagacccattaaattgaggaagcgtgtttgtagcatgcctgttggattttgtaggctttctctccttcttagagttttctataacctaatagtaaccctgaataaaatacaagtagagttgtttaggtttagtcatgtaatacaggaaaatttgatatattgtggagtgcaggtcaaagaataccaagaatggatattgaagtctccaggaaatatggcaatcacagtgatacaggggcaaagagtcctggttttgtgactggcattgcaatagtatggattatttttttttttctttgaaacagtgccttgaagccaatttatagagggatttgggaaggatcaaacaaaagaaaaaatgggctgggtatggggaagggagagagtagaaatgaaataataaatgtagatatactctggctttcagaaactttttgaaggacttatcaagtaaaagaactacaagctattgtaatttcaacaagaaattgaaactttgtcttttttaaaaaaatcctaatttcctccctccccttgaggcttggacaggtaaataaacccattagggggctataatgaataacatctcatacagaaattatatgcagggaaagatcatgacacaatattagcatacagaatatctgtttttaaatccacattctctctaccatcttcatttgctgtgtgctgataatgagacaatggttcctaagggaaataatgtagtttactcagggtattcattcaagctctaaaaaaaaaaaatccaaacagacagagaacatatgaggttaatattcaagtgttaatgaggacttaggtattgtgaagcttatattgtactaattaaaaataattgcatggtcctagaattagagagctttcactgaggagggtctcaaggtcattgccgcctctctggatttccaacttggctgtgcacaaacctcagtggttaccttaacaggaataattaggttctgggcaaacacattcctgcaaccaaattcactagagtctgttgagataaaaaagtcagtttcatggtttctaatgagaattacctctttccaatatagaaacttatttttgaaagcaagattaggatcagaaggtggtttcatggttaaaaagggagcagaataaggagggccccagagaccatcctacactgaacaataccaacccagataagccccatataaactatatcgccgctatgcctacgttttacatgaaaaggcttctttatccattcaagggtagaaattcccagaaaaccaatccctcattttagcatcttataacctggtccctacagcaagtatgtacaagtatatagtaagcatgtgatcgcctccagtataaaagagcagaaaggtgagggcattcataagcgattgatggatacgcaaaatgttatattacagcatttcttatcaaaattagatttaaaattatttcatgctttttcccagtttcatatcaaatcattaaaagtgaatatttttccctcttctgtacagtcaggaagactgcttatgatgttccaaagataacctttatgtatgtgctcagctttgacttatgagtaagtttctcacatgggttaatacccggccacttctagtgatcctcatgcttttcaaggtcacaacaggaaggatgtatatttcaagtttaattgtttctctcaaagcacgaggagtagacaggtgtggagagagtcttcctcagctcatcagcgtcatggaactctagctcttctcctagggaatagggcctccttcatgtttctccccctaccctatccattctttaatcgatgctttatttcccagcaattcatgcctgttacttgtctttactcttaaaccttttgcttttctctttctgccagcattttggcaatcctgtataggcctgcggccacgtctgcatgtaagcagagagcagaatttctgctttaacagaatttctctgtcacatcgtctgcttgggccatggtgtttcgtattctactggtagacataaccttcaaggctatgtggacctttaaagtcagtatgaaaatttgacttcattcttccgtctttctttattattctgcttaatataccttgtgttcatccacaacactggaagcacattagttgcttaataaaagttattctttaaatagagtcatcatttttatatagttgtgatattatttccatacattatttatataaaatcatattattttatatagtttttatatatctgtgataaaaataatgctccccaccagaggttcatgtcctaattcatggaaccagtgaatatgtaactttatatggcaaagggactttgtgcttgttaagagccttgatttgaggagattatcctggattatctgggtggctttgtgtaatgacagagctccttaaaatagtcagagaaagagactatgaaagcagagagttgcagtgatgcagcaggagggaaattccacctaattcctagctttgaagatgggggactgagatgatgagcccaggaatgtgtgtggcctctataatctggaaaaggcaagtatatagatttcccccctagaatttgcaggagaaacacagtgctaccaacactttgaatttagcccagtgaaccccatttcaaacttctaaccagaactgtatcattattattaacagaatcatcatctccagaactgtaagataaattggtgttgttttaagtcactaagtgtctgtcatttgttagagcagcaagaggaaactcatacaatagtacttcatcattttccatgataggtaatacacagacaacattcattcattgtttaatgaaaatgaataagacatttagtggctgggcacagtggctcacacctgtaatcccagcactttgggaggctgaggcaggcgggggtcgggaggctgaggcaggcgggggtcaggattttgagaccagcttggccaacatggtgaaaccccatctctactgaaaatacaaaaattagccagacatgttggcaggcacctgtaatcccagctgcttgggaagctaacgcaagaggatcgcttgaacccgggaggcaaagattgcagtgagccgagattgcaccactgcactccagcctgggcaacagagccagactccatctcaaaagaaaaaaaaaagacatttaggacttgtcactgtctaaatttttgcatgctatgaaattcaatctgatatgttcagtagtaatatttctgaatagctgatattatgaatatatagcatgagaacttttacttgggacttggagttgcaacagagaaaaattactttacaaataaatcaatagacttgatgagtctatttattttgccatcaacccaattacctttctgttcttcagcagtctactggcaaaactcaattatcgacaatggttcagacccttctgtttcttcagtggctgctgccttagctcctgtgttctgtcatctcctagggcttaatgtgcaaaaattgtgcaacccagctaggactccactgggtgcagagctaactggctgaggcatgcagggtaaatactgtcattagctcattctctgcataaaaaaatgaaatatactcaataacttctagtttttgaagtatctgattttatttaatcttcacaacaacttggtgaagaaggtattactattaggttgctacaaaagtatttgcagtttttgccatgacttttcatagcaaagccgcaattacttttgcaccaacttaatacctcaattttacagttgaaaaaaccacgttagggagagtatccaggcggtaaatgacagaaaggagatatgatctaaaatttcttaattctttattcagatgataaaactaatgtgactttgctctatcacagctattcttgtcattttactgcagtgtcaaaattctagatacatatttttaaatgtattttaaagacaaaataacataacatatgcacattataaagtgatgtaggaaatttaaaaatctgtgaacagttttaaatcacccacaatattactgctgaaaaataacacctcttactatttttatgtatttataaacatttttctgtgtatttatatatttcttttgacattatggttttgcatcccattccattttatcatatttccagtgaagtgaggtggcattctaaccttatcatatgtacaattttactgtattgtctttcagtaacctacttttgctggatatttaaatataaataaaaattagtctaccttgaatttaccttttttcaggatgaaatctatgcttctccaaatgcagtctgaggacagtagtgccagcgtcatttgggagcttgtcataactgcaaattctctactgagtccaagtctttggggtgaaatccaggaatttctgttttaataagctctccaggtgtttcacacatgcagaattttggactgaagtgtttggttttctgtaagcgttgatgaggcaaagcagcttaggcctattgtaggtgaaaggcaagcacaataattgttatactttgaagaaaaagaaaacttttttccttcgttcgttctttccttccttccttccttccttccttccttccttccttccttcctttcttccttcctttctttgagatggagtcttactctgtcacccaggctggagtgcggtggcacaatcttatctcactgcatccttcgcctcctgggttcaagcgattctcctgccttagcctcctgaatagctgggacaacaggcatgtgccaccatgcccagctaatttttgtatttttagaaaagaccaggtttcaccatgttggccaggatgctcttaatctcttgaccttcagcccacgttggcctcccaaagtgctgggattacaggcgtgagccaccatgcccggcctaatattttttaaaaatgtctgtagagatggggtctcacaatgttgcccaggctggtctccaactcctggctccaagcattcctcccacctaagtctcccaaagtgttgggattacaggcatgagccaccgtgcccggcctaattgttaactctgactgagaacttttgtagattgagaaagtggctggtagtatattgtagataaaggccacaccagaaagggtgagtgtgaggtaagcgagctcctgtggggaatttgcctgaccagagcacaacattcacattggcaagcagctgaagccaagaaagacctgttaggataacccaagttcttgtacacatagatgaagatctgtgatataatttatagatattgaggaaacattacacattatttaacataaaagtgatgtttcataactagaagaacattggttaaaaagcacactttagtgagaagtgaggagatatttgggtagaacaaccaatgaataaggtgagtgttgtaaacaagataccaaatgaaagacaatgataaggagttttggcagaagaaaaagacaatgatttattactaaatattataatggaaaagaaggggaatggtttcaatggcagattggacaaagggactaagaggaaaactagaatttgaacctgacatcctggtttctcttgagctatacataccaattttaataatctggagagaggtgtaaaaaattaacaaaacagttttattttcaaagattgtgagtttagtttactcttaactcctctgtattcctaatcacctacatccagttggattctatgtcttgccgatcttaaaaaaaaaaaaaaaacatttgaggccaggtgcagtggctcacgcctataatcccagcactttgagaggccgaggcgcagatcacctgaggtcgggaattcgagaccagcctgaccaacatggagaaaccccgtctccactaaaaatactaaattagccgggcatggtggcggatgcctgtaatcccagctacttgggaggctgaggcaggagaatcgcttgaatctgggaggcagaagttgtggtgagccgagatcgcgccattgcattccagcctgggcaacaagaacgaaactccgtctcaaaaaaaaaaaaaaaaaaaaaaattgaatcagtcctatttactctattctttgtcatattgctttagtttaagtactggtaatctttcaactggcagcctatagttgaaacagcctaaatactctttttaccttttgaattacttccctaaaacctattgcattgctgcacagagttttcattctgtataagttgatataaaacctatattgacttatggcatcttcctgctaaaagtttaaaaatacttttcctctgctttttattgtactgttttacttggtatgacattctgaattagagcagccgtgtagtttatcatctgaatgagacccttgggacattgaaagtgggcatattaataattacactgggacaaaagttgtctgggctttgccgagctttctagccccatcctcttctaagagcagtttacaaatgagcaataccaaaataattagtgaacaaacacggtttcgaaggtcttctatccgtgttgttcacagctgtatctgcaatgcctaacgcactgctcagtgcagcatagttcctcaataactatgtgcaaagggaggaaatgagggagggaggcatggaagaagaaatgggtagatcaaagaattttagaaagcttgaatctagtatgctgttgtttaaatgacatagagttgaaggtctaacatccttggaaagaggaaggcatagaaagccaaaggaggcacagagaacttggtagaggaaggttaaaaaagggaggtcccagaatcagaccacccatgaaactgactttctgattccaaccaggctctagtgaatttgactggagaaacaagtttttccagaacctaattattcctgttagagtaactactgaggtttgtgcatagccaggctggaaatccagagaggtggcaatgaccttgagaccctcctcagtgaaagctctctaattctaggaccatgcaattatttttaattagtacaatataagcttaacaatgttttgtaatttattttgtactattttatagtttaacacacaacaacccctaaggagtgtaattcaagtgcaacttacccaaagacttcactgcttttgtatcaggttgacatatttttaccgaaaacatatcttagttttgtgaagaaaactttcacattcttcattaattcctgggcagagctgtttaaaagaaagttttgtcagtagcattttagatgttctaactacaaaggagatatgtaaatgtccgttttgtacttctgaaaacaggtgcagtctcagtgagaaaaagaaaatttgtcatgagcactggaataaaaagggaaataatgaataagaacataatttaattacatgaatgtcagccgtctacacaaactagatttgatgtaattaaagcacctggaacaaataaaatgaatcaaggaaatctctttcctttttttgagaaaggaagattcaaaattacatactatttatggacaacttgtacaaactatgcaaaaaataagtgtgcatgtgagtgtatgtgtgtgtgtgcacaagagagaggcagagagagtgaagggtaatttttcctggcctcttagttcataaccaacaaagcagccaatataagttttttatagtaaggggataatatctataaataagtagaaattaaatattgttttcaatgatcatgagccccagtaaaataaaaattacatttatttaaggattgattattttagtcttttccccaacataaagtcataccaggagcttgctgtctttggtaggtcaggaatgcttatagagaaagaaacaaatcatgaatttaaatttagagacaaagaacgctctttccaggaagaactactcctaactagtggtttgctagcattgcaatatgccactgggacatttatctggggagccatttgttctgtgctgtgcttatgtaggatattttgtttgttctagctatctacgagccttcctgtgaagcctacaaacacctaggacagacatcaaattattactggatagatcctgatggcagcggacctctggggcctctgaaagtttactgcaacatgacaggtaactgtgtcatatttatgttttatgaagatgcttttctatatgtcacgaataagtagttccaccaatggtttgtttctttggtgctatgtttttatcacaacatctaatcagcaacatattgctggatttgttagataagatgatgaaatgtattattagagcaataaaacattttgacactgtgcttttcaaaaagttcatgtttgatgtgaacaattaagcatcatttttttaaaatcagcatgtagggggaaaaaaacagaaagtaaagttgcaaagttcagcccaaagaaagaactagtaacctagattagggaaatttagcatcactgctccaatattctcactgtgcatgctagaggaagcttttagatcgtgacagaccttcctcgattctccataatgatagaagaaatctttctaagtcctgaaatcccattctgataatagcaaaaattacctgaagcttttatgaaatatatttgggcttttcttcttgggaagaggacctagtttttctccacttccatgtgaaatgagattatgggttcttgtcaacttccacaacaatgtgtaaaatgtgcagatctctaagataagaacagattttccatcagacacttggcaatatcttacgcttcaaaaatccagaggaaggtgtgaggtatgcattatttactggctccagcaaaagaccagcatttgatgtgaactcctgggcataatatgataagggtaatgataataagatgctactgatggtagttactgagtgtgactgtttaccatctgtcaagtatcatgacaaatcctttggacagacacttgagtttacatcctggcttcattaatcaccacatgtgtaatattgggcactttagtaactttgctaaattcagtaaacctcagaatctttatctgtaaatgaattaatgagaatacccacctcatagcattattgtatgaatacaataaggtaatctgcatatggttcttagcttattgtctaacacacggtaaaccttcaataaaagttattggatgaaaaaatttaaaggctttagtagttaaataacttgcccatattagaccaggtgtggtggttcacgcctgtaatcccagcatcttgggagactgaggtaggtggatcatgaggtcaagaggtcgagaccattctggccaacatgaggaaaccctgtctctactaaaaatccaaaaattagctgggcttcgtggcacacacatgtagtcccagctactcaggaggctaaggcaggagaatcacttgatccctggaggaggaggttgtagtgagccgagatcaagccactgcactccagcttggtgacagagcaagactccatctcaataaataaataaataaataaataaataaaacttgcccatattattcaggcaaattcaaactgaattatatgcagcccatggatcttctggctatagttcagaaccacttatagagttttattttgtctttggttttgttttctatacaaacttcttggctccacccctgcagactctgattcattatgtgtgaagtggaaatcagattgtaaaactagaactgaaaaccatgaatggtactctaggcaagcagacaccagcgaggaactctcagcagtatcaggaagccaggcatggtacagaatgaaagggaaaatgatgagggcatcagtgtagtatggaagacatgtggagaagataataaaatggaagctgaccagcctgggcaacatagtgagaccacatctctatttagaaaatgtcccagctacttgggtggctcatgtggaaggattccttgagccccggaggttcgaggctgcagtgagttgtgatcacactactgcactccagtctaaaagagtgagacctgtctcaatttttttttcaaaatagaaataaaaaaataaaatgggaactagcgtccccctaaatttctaaatttcccctagaaatatgcaagatgctagctcccagtttaatttttttttctattttgaaaaagaactttaggcatgtctcagagaaggaacacacttaccagagagattaatctaagagttcactgacagctggacttgtcaatgcacttgaattcttttttatataccttcatttttatctttttagcactaaaatattaacctatgataacttgacttaatttataagaatctcgattctggtttctcctaatatatgaaaatatataatacaattaaagtctattcttaacctcaagggaaatcagggcatcgtggcttggactggacaattaagaatttattttagttattttcttaaattcatctcaaaggaaattagaaaagaaaacaaaactataatatacataattctcatatcaaggacacacacaacacacaggactagtctactctcaggagagcttctcctgtgcattgaaccctttgctcagaaacatatgtcttatcttcatcaatatctcccttaaacagcatggctgcaatttaactcagcacttcaaatgacttctgagctctaaggagcagaatacaactttttgcaagtagaattttttttctattcattcaagatagttacaaacatcagtgtgttcaaggacccttgaagaatcttgccttacaggccagcaggcacctttcagttctttgccactaaccaacccttccttttcctggaaagaatgtggatttaacatcataaagagagcatgatgccacaaagcttggcttgggctattccattttcaagagatacatgttaaagaagaggagggagtaacagcatgaagtagtctataaagtcttgatatgtaactctatgtcatgaaaaattataaatgctcccctaaatccgaagtataaaaggaggcaagcactcaaaaaggtgaagaagagaaatgagccatataaatcaatcccccagggcacaagagagattggcttattccaaagaactgaaatcccagtggctggaacatagtgagcgtaagagagtgactcaaaataaagcaggggaaaggtgggtgggggcaggccagagcagaccagccataaggagtgtagggcagaaaaaagtgcgcttttttttattattatttttcaattgcagtgggtggtcgtctatggaaagattttaagcaggaaaataagatcttgattgcattcatacatctaccacttgggcttctataagagacagcatgaaaacattgggaccagctctgaagctattattgcaaaagtccaatgaagagatgatgctcccttgaactagggtagggatggtttaaagtgatgagaaattgatacatttttagatctgttttgaaggtagaattgacaggattggtaaaagtttggatgagaatgtttaaagagagacagttatcaatactaacttctcaacatatggactgagtagctggatgaactttagtgccatttaggagaagtggacaattaagggtaaaacagttttaaaggaagctcaagaacttacttttgacctaattaaatgtgaagtgccatgtgccatctaaactgagatgcaaattttacagttgggtgagccccaaaagcctgattgggttagagatataaatgtgccaattattagcatattaatatatgagaattgataatatcatttgggggttgatgtaacagagaaacagcatctcaggaatgagctcttagaaactcaataggcgggacacgatgactcacgcctgtaatcccagcactttgggaggccaagacaggtggatcgcttgagcccaggagttcaagaccagccttggcaacatggtgagaccctatctctaccaaaaaaaaaaaaaaagcaaaaacaaaaactagctgggcatggtggtgcaaacctgtggtcccagctacttaggaggctgaggtgggaggatcacttgagcctgggatgtcaaggctgcaatgagccatgatcacactactgaattccagcctgagtgccagaaaccctgccaagaagaagaaggaggaggagtaagaggaggaggaggggtagagggagggggaggggaaaggaagggggagggggaaggggagaaggggggtggggggatgaggaattagtccgttctcacgctgctataaagaacttccctgagttcgttctcacactgctatgaagaacttccctgagattgagtaatttataaaggaaagaggtttaattgactcacagttgctcatggctggggaagcctctggaaatttacaatcatggcagaaggggaagcagatgccttcttcacaaggcggcaggagagagcatgtgaaggcagaattgtcaaacacttataaaaccattagatctcatgagaactcactattatgagaagtacatggaggaaactgtccccataatccaatcacctctcaccaggtccttccctcaacacttgggaattgtggggattacaattcaagatgagattcggacagggattcagagccaaactatattactcaataattcaatagagagagattagggttctcgtgttaaaatatttaataagtgtttggaaaaatatacataattgagggtaagtagagaaaaagtgtctgagagcatttggggggcaaacagatcatctgtgtggaggttaaaatgactgcttggatcctagagaatgacagaaagacttggagaatgaagagcaacttggcatccatgcacacatatacagtggatgtggtggtgccacagacgtatggcaaataatagccactagaatgcggggaacatggtatggccaggaataatgaaccttctaaggatgctgcatagacagcataggggagccatggattgagctacatcctaggcaattagggggtgttctaaatgacagagcatttcaagcactgcataggacaccagcaaaatcttccccaaaacggctgactcatgagctgagtgttgaagaacaagtgggtgttatgcggctgagaaatcaggagaaggaaaaataggtcaacttacaaaatgctttgtgtaggatgcaaagcagttgaaagtttgtcctgaggtgaaagcaagcaatggatggtttcaagcaaaagagtaatttaatcaggcattgtatattaaaaacatcactttgacagctgtgaataatattctccaaaggacacccagagataagacagggaaacaagttcgaaagcccccgtagtaatgcagaggttgaaaatggagacttaaagtagtggcaataaagtaaaagaggaggagattgatttgatgggtatttaagaagaggagttggccagaccgttcctgatgagacagagaaagttgaaaatggtaaccacatgacatggagcacagaggagcagaggaaaactaggaaaagggtaagattctatgttgctttgggtccctgtaattcaaccaggtaaagttgtcctacaggcagatgctacgcaaagtcactgtaggaccttgaacacattaaaaaaaaaatctttggccgggcacggcggctcatgcctgtaatcccagcactttgggaggccaaggtgggtggatcacctgaggtcaggagttggagaccagcctgaccaacatggcgaaaccccgtctctactaaaaatacaaaaattaactgggtgtggtggcgcacacctgtagtcccagctacacaggaggctgagacaggagagtcacttgaacccggggggcagaggttccagtgagccgagattgtgccactgcactgcagcctgggcaacacagcgagactccgtctcaaaaaataaataaatataaaataaaaaaatctttgtctcgggtttcttgtaaataaagttcagtaattggaataagttgatatcttcactgcctttccttcaaaaaaaaaaaggaaaatatttccattgttaccatgagacatgaaaaaaatcactgcttgcagtcaaataatttagacagaggcttcttatctcaaacaagcttgaatttactatttcttgctaagtttgacataaattgactcttcattttttatcgtaaggcagtagttctactatgtaattcttctgactgtctgcagctcagagctacatctcttggaaatttagaaattagggggtgtcctaaattatagagcatttcaagtgctgcacagttgatgacattgaggagagaagatttttcacagaatcctttgtagaaaaatttatcatcctgtgaaagccaaagcctggtttctttttttagatcttagggtacatgataaaatgtgatcattgttagcctcgccttccttctccatttttatgctccctctgaaaatttggtgttaaaacttttgtgaatataaactatcttatattttcagtatcaacctcttttaattgtatatttctaacatttcagcttttcatttccattttcttcaggtgttaccagcatcctctccctagataccctgaacctttgtatttaaaaggttctttctgctttcacttagttctttctgctagatgattaatagtaacaatagtaaataatgctcgatccagccattattcttgaaactttactgtctatccttaaacctaagacaatatttttcttcatcttctatcctctaactcattttctccataactccctttgcattcatttttttcttaatttaagcaagcatctgtgctctagtgcgtgaagtttaaagtccaaataaagtactcctcttgcattcttcctagccctggttttgtagttttatcaaaaagccattaagcttgtttacataatttgtgctttataaagccccaggatttagctgatcaaattctattatcctctctaatagtgaaagctgttcgtgtctttttaatctaatatttatagagagcttgtaacggaagtttctaagcgcttgcactcagtattagtatcgtatttagtattatgtttctcacaagttttacaagtacagtgtgggcaggaggaaatgggtcactgaggtggtggacttgggctccagtggagagtatcataaacccacccacctccacctccccctccccgtgtccacaaagcaaaacagtttctatcctatagtacagtcatgcaccacatagtatttcagtcaacaacagactacatctagaatggtggtcctataagattataatggtgtatgtttactgcaccttttctatgtgtagataggttatatacacagacaccattctgttacaattgtccacagtattcagtacagtaatatgctgtacaggtttgtagcctaggagcaataggctttaccgtacagcccaggtgtgtaatgggttatgccactgagatttgtgtaagtacactctatgaggtttacacaatgaccaaatcacctaatgacacatttctcagaacctatgcctgttattaagtgacacatgactgtactattttccttagcagtttacagtaatacaaatttagtatccacagtttctgtgtgtcaaggcacaggtgacctgggtcaactgctcagagtcttgccaggctgagaccaaggtgtcacccagggcttgggttttaccagagacttgggatcttcttggaagtttattcaagtgttgatagattcatttccttatggtttaaagactgacgtctcctattcttattgtctattggccccagattgctctcagctcccagaagctgctcccagctccctgccttgtggctctgcctgtccaggaggagctctctgactcgctttccagcgctgacctgacttggtcgtcactcaggataattacccatttgattaactcaaacccaccagtttacagcccttaattacacctgcaaaatctcttcatcttttccatgtaaagaagcccggtcccattagtgacaccccatcatatttgatggccccacccccagtctaggagagggtattatgcctggtgtacccaccaggtggctagaatcttgaagaccattttagaattctgtttagcatgcttacctatgtgcctctgtaaattattcataattccagcaacctttatttctaccttttgagtaacaacagtgccatatttagattataaaatcttaggctttactgttaatgctcttataattgtaacatattgttctgtaaaaactttgacaataaagataagcaaaaataaaaattgcttgtcaaccagaaatgacaattactaacacattagtcactgtgcaataaagattgtatattttatacaggtacctgcatacataattgagggcaaactaaatgccaggcacatttttaaaatatcacatgcattaactcatccaataactcatgacgacctcacaaggtgggtaatactattgttctcccattttttgatgatgaaactagagctcagagaacttaagtactgggccacacatgtagtaaataataaagcttgacttttcagccaggcttgtgtgttcagagctggtttgtagttaccgtgtgtatgtgtatgtgcacacacaagttcacacatatataggaacagcactcctcattttagattctgtagtacgatttgcaatatgattgctgaaatgagcattttttattcaaatctcttcattatcattgaaactttcttacacagctctgattcattatctgtggtttggacagcatttttgttataaacaatttacttcttaattatctaactaatgccttggggtttttaatcagaggacacattttaaatgaaatcgatatataaaccattataggcaattagtatgatttttagttcttttttttattattattatactttaagttttagggtacatgtgcacaatgtgcaggttagttacatatgtatacatgtgccatgttggtgtgctgcacccattaactcctcatttagcattaggtatatctcctaatgctatccctcccccctccccccaccccacaacagtccccagaagtgtgatgttccccttcctgtgtccatgtgttctcattgttcaattcccatctgatgagttcatttttaattcttaattcaactacaagtattttctctaatataattttctaagagctttacataatttgtatatttcctgtctacctaggtttatcatcccttaaggtttgagcccagctttcagaataacttaaactctatccccaacatctagttaatttttcaatgtaaagtcttaaactgaatctaacaaaatcttgtttgaatatgcaacaggattgaatggaattgtactggatatcatcggtaacaatgatcgtagtgtctcattcttccccttttagagaggaaatcatgtagaaatgaggacacacagagctctcctattctatattagggcttattaacattcataagttgggcgctactaagcttctaaccccttcattttcctttatatcataactatttctctgatgtgtatactggcttcctccattatattccctctactcatttttatttctttctcatcaaagccattttctctcctctttctgtctcctaacctagtttacctcctctatggttaacccactcagagaatagctgtcctttatgtcttctttcagacacatcttctcctctttgtcgacctctcacaggctgtctttgttataaacctttgtaatcactcagcaagtcctgcttcacgcattcagctatttcagttcttcacaatcagtataaatctttgaattcaattctgctcatacagcttcaattgaaaatctcggaaccaactcactgatcaaacacagcctgtaaagaactcttctccgtaacggattacccactcccaaagactcccttctggattcagcctcattccagagcttctgcctgccaggctttctttgcaatctcatcttcattgtgtgtcagccatagtgataggttaatactatagaagttctcaaatggttttcaaacttcaaattaaaaaaaaaaaagagaggaaaaccatgagatccagtgaggcctacaccacaggagaggacccagaaagggggtacaagaccccaggtgaaatcaagatgaagtggctttaggtatatcacaggtcactcagcccttctgaggtttccaaaatcgtactctctatgcaaatgctcttccttcaaatgttttcatgtaacctgacaaaacaatatcttatagacactgcttgattttgtgcttttaaaagcactgcctttcttatgcaatttctctgctcaaaatccgagaaagacttcacagtgtggatggctagggactgttgtttgattacctctggcacttggaatctgaaactcttgcctagtctacagtaatcaactattcaaacaggatgggaaacacacacacacacacacacacacacacacacatgttgggaaattcaattaagatcaactcatttctttgcaatcaaaaatcaaaaaccacaggaataatctcatacttttttttaactaggaatttctctcttccggctaaacttaaagccaataataactgtttctgtttctccaaactttaggtttttccaatttgtggatcaccttttatttcttctgaggatgtcaagtttcatatcagaatgtccctggaaattttagaaagaaaatctcatatagcagctaatctctctttttatcttgtgtctttgtccaatcaccacaaccaagaaagttaaatagtaaattgcaccaatattatatgttgcccaaactggaaaatatttaaagttttatttcctggacctgacttaaactagaggccctaaaacttttcagtgccccacataaatgattgctgcataaaagtacttgtctcattaatgaagaatgaaaatacaactttgggaaaaaatatccctgtggatgaagttgtcaaaaaatctgtttgctgcatttacgtacagacaatttcattagcattgaactcttcacataattattaatctcatgttcggtttttactcagatttctgaacaaaatcagcattaaaaagtgagattaggcaaaaacttgctgtatcattcacttcatcatcattactgttgttattcatgttttgcttttatgtgcatccatgttattctatcttcactggacccctatttgtccttctgtttctaagctcacttggtgtagctctaggtttcagggctaggacaaggcagcataattttgagagatgaaatgaatgcctttgctgctccaggcagcagggcatggaggacagagcgggaagtttgttagtacattgtagaatctgatatctttttgctctcaggttttaaaagactataaaataatattgagcatcttgctgacatttcactttgttctaacatgaagtgtttgctctctatatctggggtataccatcatcatggacttcatcttcaccatgtctgtgtttatttatccaagaatgtcttcatcccccctatattggaatgcatgatttttatataatgtcttcttcattttaattttaccctctaatgtggatatagcacatcccctggtagcttcttgatcctttagtacaacctacttcttctctgaaagttagaagaatcttgtttttgttccagatgttctgaaatttcaaaacaacgtgacttggaataggtcagttttcatgtatttgctgggtgttcactttaacattggcaactcatgttcttacatttctttttatttatctgtttgtgattctgtctcttatgatttatctattgtctctttctagaatgcttttcattgtggttttaaatcagagttcttttttcttcttgaaaatttccttttctaatggcgttctattactgctttatgaatgcaataccttttttgtatcccaaggataataaaacatctttttttcccttctttcttagttttctccaagttacttgattctgttcatttttttctgaccttcacagctttcctcatattcgtgattattattagctgtgtgtttattattacgagtgggagggtcttgttgacttggagctttactgtgggttagagtaacaattatgtcctggcttgctcagtacagtcccattttactcccattgccctgatgtccttgtgaatagctcttccttttattctcagtagtgtccttgtttggatgataaattatttgatcacctcactgcagaggaagctgagtgttcccgttttaggactctctcatctgttgtcagcattatttttttcattttctctttattagtcaggttctctaaggatacgttttaaaattctttcctggaggtttctgatctggttgccaacaatcttggaaccatttggggaaagaggtctaacagcatgaacattcagtatttggtacaagtgtaggcaatctccattttctgtgtagtttccacattctttgtaatacttggttcttctcaatgcagggattcttttagaaaataaacctccagttatctcccagagtgagagaggagtagtcaatcagccacaaggcttaggagacctagggatctactatctgtcaaacagccttaatgcagttctccttactttattaattactgaatcttttatggattcatggtcgaaagttgggttggttctcatctttccagactttcaagttaagattcagcattctactaagtcagtgagcacatattcatttactttccatcctccaaaattgtattgctagtattgattcatattctcccggtctttgtgggaaatgtgtgtgtgtgtgtgtgtgtgtgtgtgtgtgtgtgtgtgtgtgtattccctagctttaggagtatgcatatgtgtatgtgtgtgtgtgtgtgtgtattccctagctttaggagtatgcatatgtgtgtgtttgtgtgtgtgtgtgtgtattccctagctttaggagtacgcatatgtgtgtgtgtattccctagctttaggggtatatatatgtgtgtgtgtgtgtgtgtgagagactgtgtgtgtattccctagctttaggggtgtgtgtgtgtgtgtgtgtgtgtgtgtgtgtgtattccctagctttaggggtatatgtgtgtgtgtgagtgtgtgtattccctagctttaggggtgtatatatgtgtgtgtgtattccctagctttaggggtatacaactgtgtgtgtgtgtgtgtgtgtgtgtatgtgtgtgtgaattccctagctttaggggatttagaaggcatataagttaattgtcagtgtgccagtgtttactcaccatcctaaccaaggtgcagcttctttatttttaattctgtaatttaatgtcataaaaccaaatagttcaaatacatgtttcaaaacacgtattttaaaatgtatgaaaatctccaaattttaatgtaaattaataaattttcctttttggttaaggagtgtcataattcttaaagtgtttattattgattatctgctgtatgagaggtaatatgataaattctttcatctattgtgtttcatttattcttcacaataaccctgagaagtattagggtcccaattttgagatatggaaactgaaacacaaacagatattaacattctctgtaacacaatttacaaaaggctgtttacacaaagaatatagatttggatgacatcctgtatcatttagtggcataagtgtgtcactttcactttttaataggttgaaacattcgaagaaaccctcagttcttataataatataaattactattattattatttgaaaatttttttcttctctctatgatttctggttaactggattctagactgatcaagggccatgtctgtcttgtttactactgaacccagcagagtgtctggtatatgtcagcactactactgctgtgaatagacctcaccactgtgtctttttcagtagagctaagtagccaccaccaatctcagtgctaaataagaaaacaagtttgagataggtaagagtgtgcatcacttataattagaagacatgcgtttattagcaatatgctaaaaaaatcattcccacaatctgtcctataaacttgaaaaagtccaagtgctctatccttttaggtgctccaacttgtccttgtatggctgtttttacagtaaatatgaaaatattctagaagcaggattgagtttgccttatactgggatcaggtaactagagtcctctaatttaatgactgaaaaagatctatttaagaatcaggcctcagtcagcattatgaaaagtaaaaggtaaagagttcactagattctttcatcattttgatgcaagagtgaagagttactaaaatgttttagctaagcaacataggtgaacatcagtaatttcttccaccagtgaaaagtcaacttccataatgcaactaacaattaaatttatgtaacaaaatagcaggttttgagctatgataaatgcaacttatacgtttggggtagtatctacctctaaaatctgttcttttaatgaaatgctagccaacccccctatgaagtgtgggttttgttctcgcttagggtgactgaccagccttacaccaacccttggatatagagccatattgtctaatacacatgcaattatatctaaccatccttgggatgtattttaaaagtaaattacaaaccacatagcctatgagttgactatccaggtagttttaccaactgtttataaaagaaactatgtcaacataaagcagtcagtttggaaaacacgtgcaagagatggttactttcacgtgaccagcatgttgcttagttgtaacatgctataaagggttgtgttttactaacagtgtcactgatgatcctcggttcattcatcatacttctgcgtcactgctgctacttactaactacaatcccaggccagcttaagcattagttttctttacattttgctttgctcattgcttctttaatatatccttattaccatagtcttccctctgtgttctccagtagatagaagaagaggatttgacatgacgctaagcacattaatataatagtttcttctcccagtggtatttgcatttcaaagagaataacaacaagatgaaccaaaatatggaagcaatattttcagacaggataccttccattgctctctaaatcactcctatctgtagcccccattctacttgtgtatacaaaggcttgtagcccatgtaacgtttaaagtctctcccatgtagagtttcttctattggggtggcaggagggggctgaaatggcaagccactatttctattaactgctctgtcttttgcttcaatatctgtttcataacaagttttttttttctcaatagctaccccattttataggcaaaggctcagaggaaaatgagatcagagaaaaaaaatgagttaaatatcatctgcaaacaaatataaagcaacacaccatgcaagaaaggctcaccccctctggatagagaattctctcttggtatcgtgttggtgtcattgttctcaccacctctactctcctcaagtttatcttttctttgggagttccagattctatttattaagtatccagtatttccatacacagtattcatttttaatattgaaatcctaatctccattcctattgatatttgatagcaaaatgttccaacttctatacaacatttgagtacttccttcattgtggccgctttagaatctatctgtatgtaactatgggtaggcaaggaccaaacttgctcagaaagtttcatagatgctgcggttttatcattacattgcctatctgcatggtgatttttttaatcagttattataagcatgtttgatacttttgattgataatggaaagtaaaggaatgaaagttcagctaattaaaagagatgattagaaagaagttggctttgcaggagattggttgataaaacaactgatattttctttttcttgtttcaagccttgggcagaactcttatgaaagcatttagaatttagagggcttgtcatggccacactaagcatctgactcatctggttgctgcaatgtcattaaaatgaatttttggtgccggttcaatttgtctttggctctacagacatgaccttattcacattgattgctctcccattaacggtagtgtagtaaaggaaacgaaataagaatatagtgttcaaaagcaggtctacatgcaaagggtttctttaacagtattattatatcatgatgttttcagagatgtgaagtatatttattaagtatattcctagattataagaatgttgctttaaatgatatattaattttctaccatagtggaaaattatttagtatacagtataaatcattcctaaaataaaaaattatgggatttatataagcatgtcaatatcaacttttcatttagaaaactacaaaagaaaccatttatttaaacactttaaaaccctgtgtattacgaaattaaagtatcattttcaacagagatacaacttttccgtcttttgccttctctaagcttagaaaactcacaaagtttatgaactttaaatcaaaatcaatgtttcttagtttctcatcaatattattttaaaatattgaatatctttaataaatatggagaaaaaattaattcagaaatattcttgcaaattggtctcttttaacataatctttaagtcattgcttacacttcccagtcactttagtaaattcttaattgacgtggttccaaatctcttcctaattctggtcattatgttcttttttaaatgtaatgaactgtgtggtgtgattaacagcaagcttcatgccaagtacaatacagtggggttttatcagatagcagagagagggtgtgaatcgtttcccagacttatgaaatatctatgtttatcattctttgttatctcccaggtacagtttttagaattttaatgtgtttaaataagcttgcataattgttaatgtatttacttaaccaatatttatgagtgcatcttatgtttcaggcataggtacacagtgacaaacacacataaaatctgattgtgtggaacttataatgttataagtatgtataaaattatttcaaataatctgttataatatgccagtgatacagttgttgctgtcagagacattgaattattgaaaaatgagaaaagtttacattattaatatgccatttatagccaatttctgatagatagttaattaccttaagaaagcaattctcaaactttagtgatttgtgcattgtcttcagaagtttcaccaagccccagaccacctatttaattatttaataaatatgtttttaatggactccctttttaaaatcttattctcattctaagcaacaatttccatgaaaggttgtgtttagttcacttgacattgcttcctactgtgctgtcagaacatcatattgtttagatatatcataatgcaatatcatatgaaatgatatttcacaaaccatcaatggtacatacacttgggaaattctggcttaactaaatccttgtacctaatttaataggtacttttctccaaaactattaacttgtatgaccttagaccaagaattgtgactagtacaattcacaaattgtcaaaattgaataccttatctaaatgcaaagaagtcttcagcataactttattttaaaacacagatgttgtgatttgatagtaaattattcaactggattctaatgagttatttgctgactgttcatgcatgttgacccaagtactcttcattcccacatctgtcctttagacagtctcctttttctgtccttccaactataactctgatttaatatttaatgaacaattactatgttttatattccttccctcaaagaagacaagctgtcccaagacattctaaaatgaccactcctcccacccctgtgagttctctgtgcaaccctgccgtccctggcctctccttctgtctctcaccttaccaagctcttagtcctaagtttcaggtaatggctattacaccctcactgaattttgagctgaagagaatattaattacctagtcacatctagttttacagatgaaaaaattgagacttatgttttgacagtccatacttaaatgctgaaattttttttaattgggttcagcatcttcacagaattaaccccaatcatgacagttcgaacatttcctgaaaacaccttgtattgctgtctatttccatcggtttgcaaaatgatgttgatcttgttttttacattatcattttttttttttttgagacggaatcttgctctgttgcccaggctgaagtgcaatggcacgatctctgctcactgcaaccttcgcctcccaggttcaagcgattctcctgcttcagcctcctgagtagctaggactacaggcatgtgccaccgtgcccagctaatttttgtatttttagcagaggcagggtttcagcatgttgaccaggctggtctcgaacttctgacctcagatgatccgcccgtctcagcctcccaaagtgctgggattacaggcgtgagccagtgcgctcagcccattatttgtttatctaatagcttaatcattcatcactgacattttgagcatttaaacaacatcatcctcaataaagttctagaatttctccaacgctgtgttctagacatggcacttcatgtgaacaattccacaggaagtaggtggtactattactattcgcttttatatgtgaggcagccaaatcataggtagataactggcctagagtcaaccattattaagcaggagagtggaaactagctttgtgtgatgttggagatcaccatttttgtcacttcattataatatccactttattccaggtgccattctagaggtataagatactgtataaatttataagacacaaattatatttttaacagatctttggtctagtttaaaagacagaagtaaaagtatttattcaccagatttacatacaagtaattttgggctattgtcacaattcaaatctaccttcataggagaaacattcatgattatggatatacatggaaccatgctgtatagacaattccaatcaaaatgctccacattgctttggacaatgtcaggatcactggaataagtacatagcatggcaaaatgagttttgtgttgtttttcctcctggaaataaagccaatataagacccctggtcaaccaagagaaaagcccataaaggcaggttccagtagctcagagtaagtgtataggatttcttgtgacaaaagcattgtgacatattatcagtgaatttcccttctcccatccaaatctggtgattagtcattaactccagcttaacagcaactcagcagtaacaacatgtactcggtttagttatctgaaataaaacaacaacaaaatgtttctagtggtatgactgttgtaaaaatatacattatatacaaagcagagaacttatacatagtaggagtttgctaaataaatatttctaattgattaaagaaaatacaatagtaagggcctgcctatttatacatataaataatttgagttatggaatgtaatgtgagattatataattttttctccttgtgctgtaagatatgaacaaagagattttagaagaaaaagatataaagaattgtatcacttattaaaaacttagtttattgaagttctttaagagacattgtacttttaaagaattttcataatagcctcaagtttcaaacaagtgaatgtctgtaattgacagccaactctaatgagagttgtggtgttggaaattagcttagtatcttcaattctttaccctgaactggtttacactggcacttgtagattgcatgttcttattggaggtgacattgagagattacattaagttggttatcgatcatactgtataggttcactttactaaaatgtaatctctgtttcaacaaatctaaatctgacaaaatatgccatttttatgccttatggactcagaggttataagggggatgagaggcaggttgcagccccaaactctgggcatttcaaatctagcccagagtgttatttattaaatcaaatgatacatatgaaaatgtttcctatatttaatatgcagatatgaaactatagtactttaaaaagtacaaaacaagtgtcattgaatactttctatctacaaaacattctggagagtatttgaatgaataaatcaattccctccagatatttagtagtaaagaaattctttatgccaatagtgatttatctatcctaattatcataacagaagtaaaacaaaatagtgaatatatttattttattatttctagcttatcttattaattgtgtcagcttcttttcctatttttcctcgtatgagttaatctggtcttattctttctgaactaaccatatcctaccctgactttaccaaacatacaaaagtaactatagccaaagctactaatattaatctggacttccttatgcaaaacaatgttcacattcatttaactgcggactctaatccccagagcctatttaatcattattgtgatatcgtttttgttacttcaaacatttggcatgcaggcagaaacatgtatatgtgtattcctgggaaatctatcaagcagattcccaggaagtctcctaaggtgatattgattacattcataatattattattgttcagagaccttgttgaaaaccaagaggtggtgaaagcctaagcgaatgacccattaaataaaactcagtagactgatgtatacaactaaaaagccaattaatttaatttatgagaaataattatctagaaaccctgaaactcaaaattataactactgcatcctctctctatggcagttccacataatcagctccatttgggggcttagaatcagcatgaaaggaattacataaatcacatgaattgatgacatacggctaagcctgtttgttgcattattttgctacttcagtctgctggataaaattcctctccattggatagtgctttgacaatcaccaaccacttctgctcctacaactctattttttttccaaacttttaaaatggaacaaataccattctgctcatttcttatatatatatataaaagacatgacatatatatatatatatatatatatatataatgtcaaacagattaaaattagttctttctgacttacaaatcaatccatctcatataggttagtttacatttttctattctgatccatgtaccaattttaaagtttaactctttgcagataattgtattcctcacatgtccacattgtggggacaccaaagtactcacagcatattctctaaggggagatgtctataagtcaacattataaaatatgaacattatgtttactgtcagtgtctcagttaacaaaataattcattgattctcagatccatatgatttttcacaatttcaacatctctgaaatcagcatgtgtcttactatcggtagcatctcacaatctctattggccaagccgagacggtggcatgggtgtctcttcctgtggacatgtggcacttgtatcaaaacttgaagaataggcctcagtgccttagaggaaagttctggagacaatagaggctcaacctttttaagaactctgtcaccaatgcttttgtagacagagagaaccattcagagggcacatcagtgattcaagccgcaaagtgtttcaagagcgttagactatgaaagagaagaaatttggggaatggctcaaccaagtcatgtcacttatgttttccttttcaagtatgcacaaaagtgatataatttttaaaagattagaagagctcttttgagatgcttcattttctctttcttaggggttcacgatagagtggtgtatcttacaatccatggcctcctaattatgaaatataacaatgcatactttcaagtaatattccatctgtatacatttattagacattttagaaatactaggagcagaaatcaacatctttttcaaggcgggcaaatctttatttactcctttgtaaaggatcattttagaaagtcatttccttattctgaaatatgtagtggataaatttaagtaatattttcaaattctgtcctaatagcaaatggaaaaattaaagctgttgattcatgaagtatgatgatctattctattaccacagagtcaaagccattacatggtttgcctgtgaaaaaatagtagagaatacaaatttgtgtagataagatatgggaagaaaatgtcatgtttaaatctgtaaatggaattccctggaaaagggttagcagcaccactattaccgatgtgaaaaattcagagcttcttgcctcttcctctctgatccagagatgctgctgagaaagaaacagctctgttttgaagaggctacagcaggcaggcatcttcatgcttacacaggcctctctctgctgaggtggcctcttggggaagcctcacaaaaactccctatcctcagctcccaggatcaggggagaaggatgcccttgatggcctgcggagatcttgagacaaggcatgcggccaggacagacgttgattggcatgaccctcagtgagaatctcagtgaccttcctaggacctcctgggtctgctagggcacatcagtctctgagtctctgtgttgcccacagccttctgtctgcactttcctatttgacagaaacagcttcataaaagcagttcccataaattgaattcccgtggcttgacctaatttactatctccatatgtcggttccaaatcagcagcaggcatatttacagacctgggttggttggcttacccaattaaagatgttaagtaattaaagtgtattactttttcaagtatggagtattatttttcaaataatgcagtatatccttatatactgcactatttaatatgctgttctaatttaaaaaacaataaatatcattactatgagttaggaataaaataactggtgagttatatatatacaaatttatatgtatatttgatataaaattatatataaatataaatacatttacattgtatacaattatatatgtgtaaataatatttattatctcattatagatatatagatctattaatatatagatagatgatatatatagatctatatatatgatatcaatatatgtgtatagctatagatgatattaatgtggaatcacaactagaaataaatagtaggcaaaggtaattttgaggccaaaaatataaatacttataatctctcacctttaattaattcagattttaaataattgaccaacttattttaaattattttctatggaatttctgtggtgttttacctctctaaaagtgtgtgtgtgtctgtttgtgtgtatatatatgtgtgtgtgtgtgtatatatgtgtgtgtgtatatatatctacatatgtatgtgtttatatataatactttataggctatatgtcagtaaaatatttgaaaagttttattctgagccaaatatgagtgaccaatggcccatgcatgatacggcccttgggagatcctgagaatatgtgcccaacttggttttacacattttagggagatttaaaacttcaatcaatacatgtaagatgtacattggttcagtctggaaaggtgaaactgaagcaggaaggagttagggggcaggggcttccaggttataggtaaattaaaagattttctgattggcaattgattgaaagagtttaattatggtctaaagacatagaatcaagagaaagcaatgtctgggttacgttaaggggttgtggagacaaaggttttattatgcagatgaagcctccaggtaacaggcttcagagaaaagtttgcaaatgtttcttaacaggcttaaagaatccattctatcagtcttaaggtctgtgttgatgttaatgctggtcagctgggcctgaatttcaaaagaaaggagggtataaggaggcttatctgactcttcctttctatcagggtctgaactagcttttcaggttaactttaaaatgcccttggccaagaggtggggtccattcagttggctgaggggcttagaagtttatttttagtttacatagatacacacacacccacagagagagaagaggaaggaaggaaggaaggaagggagggagggagggagggagggagggagggagggaaagaggaaaggagggagaaaaggagggaatgggagggtaaagaatgaggcagaaacaaaacggaaatacccttcacagctaacctgtgcatttgtgctgccattgggcttgtcattagttgtgttggttgttccttgcacaagggcagccagactagtgagtcagggctgaaatcagttcctgttccacttggaaaccacatgctctggcacccatctgcatttgtggggaaagtgacacctttttctaattcatgcaaagacaccatatgggctacctgtggcctggcaacagagtctaccacttatacccacagaagattaagcatttgtgctcatcattaccctttccagccactgtcttttaaaatctagtgacacttcagtgcaaagttgtttaactgataccttgtttttggtgaattgagtagatactggcaacctaacaaaccacgagaatttggacagaggcatccccaaaaaagcagtgaggaaaggaagtgtttgcagctaaaatacatttaattacatcctgggaccacttcaacatcttaagcatgtggaccacagctacctcttcattaggtgttgctctctatttgatttacagaatgcagggtcagcacttgtgaattagcgtcgtgaataagacattcataaaaccttatcagttcagaaccgatgctaagacaagacgcaggtctagagctcataagactggtgacaatttcacttatttatgtcagagaaatgttacacctgtgtttttatagcataaagttggtgagccttcctctgtgcaaacctcataagccagacaacacatgcaattaattgacagagacaagagaatccccatttctgttttctgcatggctgctttgcttacatttcagcatactttacctcagttttatttttgaacttgatctagtttggattttgtacacccctaaaaattacctaaactcaattgtaacactagactgctgctgaacgtcatgcttatagagttggaagtgttctgttgaaggatcatttatccaaaagcaacagcaaagatttatcgatacctagtaaaattctgccattccatccttcactgtccagctcccttctgaagatcggatattcttttaaaggcaaataagacgcatagtggtattttacttggaaccttatgagagagaactcaatatatttgaagaccctggcatttgtttttaaaaatactttattgtgtgtgttttttctttccccatcatagcattgttaggggagaaaattgcattatttaaaagtatattatgttagaagccagaagtcttgagctatatttctctgctgtctgtataaccctgagtccatggacaaataaatttgctttcctgagcctttgttttcctgtttagaaaatgagacaattgatctagataaaatttaagctcccatccaatcataaatgttccataatactaatgtagaaaaagcaggttactcagaactatttctgaatccaaaaagatagatagatagataaagctactttataaattatgaattttttttgtagagtctgagactttatgtaaaagagaaagagagatggacatacagagagagagaaaaaacaaaacaaaacgaaacaaaaaacagagaaagaggtgctggatatatttggaccctcctttgtgagaagggaaaagatgatcccaggagaagatgggatcatctcatccaagaaaagatgatcagctagaaccagattgctggggtagtctagaacaaacatttcaaaagaggttcactactttatgaggagacagttctcaaacaagaggatactctgtgaatagatgtattagaatttatcaacagaagcactctttcttcaccccttccagctatagtaccctgaatattttgatattttaatgcaaaagaagacatatttccctaggttttaatttttgactacccaagaaaattatcaacctgtaaattgcttttttctctatattgatataataattagaaccaagctaatcagatgtgccattatgttctttccttcacatcatagtgccaggcaacattgaggggacagctggccagcctgatgccaaaagagaggcatctaagcctcttcaggcaactgacatttataggaattatggtatagcatcaataattcacacaacctcacaacaagtgctggtaagcagctggtctgtagacaggggcctcatcacttactcatgtttgagacatttatactggttcattgccttaccttaaggcttctttaattgtagggaccacgaaaagaatgcagcaactagcaattaaagcaaaagtgctgctctgcattataagggtatatgttgattacttcatggagagggtgattggcttttgaaaccctaagtgaatgtttggtcacaaaaatctaacattttaaatgatcaatttatttctgtttatcatttccttgagctgtgaattgaaaagaaaaaaactctaccacttattttatagaatcttagacatttagtattgaatgtttccttagaaatgatccaattctttattttgtttaaaaaacaaagatctagagaactaaagtaactttcctcaaatcagacagctggttagtaaaagttttaagactagaactcaagtttggtgaaaatgtttcccctaactgacctttgcatgcacaaagttcgactgattataatccttggcttgggacagactgtcattattcatcaataacttatcaacttttattttacaataatataataaaggcttatggacccagcagccctccaaacagcaaggagcatgtcaataatatgctgaacttatggtccttctcattcccctttccttctccctttgctacctagaagtaaccagcaacctgaatcctgcattttcttgatgtactttgcatagttttatggcatgtaaatgtatgtcttaaaaatatatttttaatttataaaatgtgtatcatgctgtatataacatgacataatattgccaagactcatccatattgttgtatatgcctgtatcatagtgtatttttcactctcccattaataagcttttggattctctctaagttttttccattgtgaacagtgctgctatgaatattcttgtaaatgtcacctattccaaaggtgcatgagtatcccaggggtatatacttagcaagaatttcttggtataacactatacagttattcagtttcagaaattagtgacaaactatgtcccaaaggggtggcaccaatatggactttcaccagcagcgtggaagatcctgtagattgtatctatctggcttttactgtagagggccatacagtcattattgttggctctatgggcctcatatggtttctttggcagctactgaactctgtcattgtaggtaaaagtagccacaggtaacacataaatgagtttcataaattttcacagtataaaatattgttcttctgcttctttccaaccatttaaaagtgtaaaaaacataatttgtgagtcacacaaaaacaggtggcagactgattactttttctttcctcatcctatcttcttttatttattttttatttatttaaaaaaattattgatagcctgttacatgccataacccgttccaaattgatatggtttggctctgtgtccccacccaaatctcatgttgaattgtaataatcccaatgcatcaagggcggaagcaggtggagataattgaatcatgggggcagtttcccccatgctgttcttgtgacagtgagttctcacaagatctgatggtctttataaggagcttcccccttcgcttagcactcattctctctcctgctgccctgtgaagaggtgccttccgccatgattataagtttcctgaggcctccctggccatgcggaatggtgagtcaattaagcctcttttcttcataaattacccagtctgttatttctttacagcagcatgagaacggactaatatacaaatactgaggattctgtccgtgaacaacttataactttcctgctctcacagagtttgaactctaatcagaagaggcagaacatagacaaatgtatatattctaagcaagtcatgataggtattttaaaggcagattcagagaagtagatgctggtggtaggaggtaatagtttacatagaatgatgaggaaagccctgtttgatagaacaacacaagttgagttcatttttaaatgagggattggaacatccaagtatctgaggagaaactactgagtgagagagagcagcaaacctctacacctcctcccctgagcttttatggttctaatagcatgctgatatctcttcccaaatattccacaagctcctttaagtcttcatttgccaatctaaatttatcatctactacagccttggatttcctaacttggtgaagggcacctgtgtgaactcatcactcaaaccaaaacccttcaaattttcctgcatcttaggttgccttttactccaagcatcaatttactaaacaagtaatttcattttttcccttagtatctgtattagtttcctagggctgccataacaaaataccatggactgggtagcttaaacaatagaaatgtattttctcaacttctggagtctaggatcaaggtgtctgtaggtttatttttttgtctgtggcctttctccttggcagatgacagctttctctttgtgttttcaaatggtctttcctcatttcctcttcttgtgaagacatcagttggattagatgaaggctcaccttcctggcctcattttagctttatgtcctctttaaaggtcctatctccaaatatcgtcaaattctaaagcactggggattaagacttccacatataaattttgagaggacacaattcagcacatgagtatcttctaatctaatacctttcctctgcttttattgctaccaccttaccatttccttcccttttttatttatgtttattggttttctgattctagattatactcttaatgatcaattgtccccaaaaccagcagaatagtcctacaaaaataaaaatgtgatcttattttattctgcttgaatctttgatttgttccccagtagccttcaggataatgtccactggcatactgtatcctcaaagaactgcaccatctgcatccctgttcttcctctcaccaggtaaactctcatgctgtcagctacaacaatagtaaactatttgcagttcagggcctttacaaattttctttgcctgaaatttcatctctgccttaatccagtctttttaagtgacagattaatatattccaagaagcatggctcaatgtcatctatgaaaaacattagcataccatcattttcaccattgtctgagttagctgttcttcctctgtctcccaggtcatgatatctttcatatcactgacattgtataggataattatttctgccttggactaagtgcctgtgaacagggactgtgtcctgatttattcttacatctttagtgcctagcaaagggctgctcctcttaggcacttagtaaatatttgttacatgagtgaatgaataaatatataaaggaataaaaatgattagatagaagaaacatttttgtatattattttgatactctaaagctaatattctaatggtaatcaatatagtttaaaaataaaccattcaattttactaaacaaaatggtgaactataattggattacatggtataattatgacaatatgcatataaaaattaaaagcctacatagcaaattaatacaccaataattactaaaaataatacactaataattaaaagtggttgtttctggttttttttttttgcaaatgattaagctgtacacaatttattctttttttatacttttctgtatttttcaaataaacttgattctatgaaatatcccatgacccaattcatgttaagcaaatttactacccttttctcaacatcttcaaactgttttctttacatttcactgtttagaaaatataaaatgatatctgcaacaaattacattctgctacaaatccacattttcacgacaagaacaaaaaaatgcataacaaggcatagaggataaatttctctccaacccactgtgaaattttcattaagcccctcatatcttctccaggtctaggccctaaggacaaatgaagagtctaatctttgatcaaggcttacttcaagccaaaattatctattgctctagagaaactcttccaaatggtcataccctgctgctatgaaggtgacagtcctccccactgctcacatattgcatagctgcaggatgcgaggcaaagacttgaaaaacaagattaaaccttactcaaaacattatttccattaaaattacatcacaccgaatatcattacctaaatatttttatctttctgtaactcttacaaaacaaacattacccttgaggcaaccttgcagaataactttcacttaggagaaatgaaaaaggaacagacattataattgtagggaaagaataaaacaataatggtgcactttcttaagaccttcccttatttttttttttttcatttgctgattatccctttggccaaatagtagaactgtggaggttcagagatggaaggaaccttactgatcatctagtatgtatagcataatttacagttgtggaaatttaaagcccagataagccaaggaacttggttaatgtactgattcttcttcctctgggaaacctaggaaatgaattggatgataagtgacatggctctgttattaatttcagccatgtgattgatttcacaggttcttcagttaaaaagacttgggttctgtcccccttttaccacttaccatctgtttaaccttgggtagattatttaggcctttaaaaacctccatttcctcagttgtaaaatatcaattttagaggacctatcatgtaaagaggtgttaggattaaatgacaaattgcttagaactgtacttgggatcatagttggctactactattgttgttgtcatttatcctacaggtaatcctactgtttgagataaggcattctgggagacaagatttaagagcttttgaagaagacaactttatcacatttgcttcagactgtttagtgtgtgtccagcttcaatatctctctgtttcttagacattttaaagactgttaaaggaggagaaaggccagattacaacaattgttgacatttagtgaaggcttagtataaaacaggctctctcctaagtgaattttgtgtagtaacccatttattcctgaaaacagcttcacgaagtaggcaggcactgttctaatatctgctttgaagatgaagagacagacgcaggggttggtttcaacatgtgaaagtatattttattatcacctcccacattcacttctgcaattccaacatttgcaaggcaagagaggatttgccaccctctggtgtctctttttttttttttttttttgagatggagtctcgctccagtcaccaggctggagtacagtggcccagtctcggctcactgcaatctccacttcccgggttaagcgactaccctgcatcagcctccccagtagctgggaccacaggcgcgcaccaccatgcccagctaccctctggtatcttgggtttgatcttctgcttcgggctgtggcttcaggagctggcagtggcttgcgtggtggcaggagaagttcccaccagtcctctggctgtcataacatgcatttcatagctctcaccatatgtaacagtgagcaagtttttatttatcaaaaaggtagcctttgatgaggggcttgactacctgcttatgaattaacaaatagcagatataaagatttctaagtcatgctcttagggcaagaaaatgctttgaaatactatctgatctgcttattttctgggttttcgccttctccaccccttccaagtcaaggtctgagtctgagttctattggatattcactacaactgagagttattattgttctcagctttgagccttaaactaggcttttagaaactctaagcaagatagcagttttaaagggaagaatttttcctgaatgactaaattaggttttatcatagtcaaaagcatagattaaccaaggcaagctctaaagtaagaagcaatatggtaaaaagagagcatggtaaaaacaaagttcttatcacatcttaaatagaaaggcctttctattaatggtatacaagagagaaagcggaaggagagagagaagagatgggagaggagataggaagagaaaggggtagaatgaaggaaaaaaagaagaaataaaattgctgtgaaaggagagcaaaggatagcagagagaggaacaaagcaaaaccagacttccctcctcccctcactttctgcttggtgcccaaatccagagcagaggcagaatgcagagatacccagattgttttcagggaactaagatagggagacacataaggatcatctccttcaataaaaagagcgttgatgtcctcataaattttctctattcttaatgtgtcactctcctctaacagccatagtcagtaaactttttatgaattcccttcttagctttgtgactcatgtctagatttagtagccctgatctctgtttatcatcccttaaccttagcattcaaatgattcaccaatttatgcatgcaattgtattgtgatgccttattttccaatctccaaagaagtgtcatttgggaaatattgtacaggtctggatataaatgttactctatccaacatgtaactcatatttacaaattgaaaaagtttcagaatttttatggggacatttaaaaacgttaggtggcttaaaatattccctactgatgtacatcatctcatttgaaataatgtattcgatggaagcaaatgatctagtgaagagtattcttcatcttgctttccataataacttacggccgtatctcagttctcaaaatgcttttccaattacagctagcacttgatcatttgcgtgcacagcactttacctgaacgattgttgtggcacttttacctttctaccttgccacctgtcctgagaccctcctcagaaatcgtagttgctgagtctggagtagagaggttggtgactatgcagtaaggatacactgtgtctaacttagaatcttacaagatgtcactgacctccatctcctttgaagactctccgtgacctctaaaagttggagttcctgaggccttaccctgggctttcttctctttgcttgacgtataaatgttttgtttttgtttttgattttttgttttttttggcagtcatctcttccatttccatggcactaaatgccgtcttcatgctgcagctccaacatctgttaagctccagatgtttatatcttgttgtttaccaggcgtcagcatttaactgtctctcaggcatccccaatctgacttgttaaaaatgaaacttttgatccctccaccaggaaaatgtgttctttcattattcatttagacaaaaaactggcagtcatcatacacactcgtctctctttctctccttttctttttctcactctcttttactacctgccatatccaacccaccaataacttctattttttaaatttctgtcaaatatatgttaaacttattgaccttacatccactgccatcaccctgattgtagctactgtcacctccattcagggctacaagatcttctacccctacctaccccaatccattctccatgtaacagacagagtgatcttttaaaaacagaaattcgattgttttgcttccctgcttaaaacctgtcggtgcttcctatcattctttgtgttaggtatccacactccttctcggggtctcaaaccttgtgcagaatggcttcttgctaacctcagcctgagccccatctcattcattcagccttttgttttttctggaactcaccaagttgtttctcctcttacaacctttgtgtcagaggcattcaaaccagagcaactccatcttgaataagagctgggtgaaataaggctgagacctactgagctgcattcctggacatccttaggcattctaagtcacaggatggaataggaggttggcacaagatacaggtcataaagactttgctgataaaacaggttgcagtaaagaagctggccaagacccaccaaaaccaagatgcaatgggagtgacctctagtcgtcttcattgctacgctccctccagagtcatgacaatttacaaatgccatggcaatgtcaggaagttaccctatatggtctaaagaagggaggagtcctcagttccagggaattgcccacccctttcccagaaaactcatgaatagtctaccccttgtttagcatataatcaagaaataaccataaaaatgggcaaccatcagccctcagggctgctctccctatggagtagccatttttttatgcctttactttcttaataaaattgctttcactttactccatggacttgctctgagttctttcttgtgcgagatccaagaatcctctcttggggtctggattgggatccctttccagtaacatttgtaccatctcttccttctatctagaactttcccctgtcccacctacccatgcccctcactcccaacccagccttatcctccatcacttactttttgatcttttaggaccagttcaaatatcaattgttttgacacggtccatgttcaccctaaggagatccttcctgttggtattttttactaaaatctatttatttcctgaaaattacccatcctattgaattcttatttagtctctttccctgtttcatcttttaagatattctttgaaggtcaagtccatgtctgttttattcaccactaacaagccccattacctgggcccatggtaagcagcttattgaatgaatgaatgaatgaatttcccaccaataacatgtgagttagataggaactacctcaagctcatctcagagaagtgctttttcacatgtctaaatcccccatccttcagccccttcatcacttttcttaaaaagcacttggggctggttgcgagtaagagtgggaaattcaaatttgcaaagttagttcctgatagttcggaaacgtgtgtcctggggatccaatcatatgatcatttgttctgcttcaggttctttgctagccacccatatcctgctccagtcaattcgcaccctttagttcccaagggcgtaggtcagaaacaatgctcagtactttcaatcctggcattgccagcagcaataggtcaggcaaacactggggttgctgggaccacttagaatgtggaatgggaaggagcagttctaagatcattaatggtttcagcatagaaaaacaaaagtccagagacctgccaaacccctgtggggtaattgtggttctgtaagaacttggcctctgagttcggcattgcctgtaattacagcctttctttctttctttttttttttttctactttaagttctggaatacatgtgcagaacgtgcaggtttgctacataggtatacatgtgccatggtggtttgttgtacctatcaactcgtcatctaggttttaaatcccgcatgtattaggtatttgtcctaatgctgtctctccccttgcccccgaccccgcaacaggccctggtgtgtgatgttcccttccctgtgtccatgtgttctcattgttcaactcccacttacgagtgagaacatacagtgtttggttttctgttcctgtgttagtttgctgagaatgatggtttccagcttcatccatgtccctgcaaaggacatgaactcattcttttttatggctgcatagtattctatggtgaaattacagcctttctattcagcatcctcatttgtaagcctctgaaatgtctgagattatgattatcagtgcataagccctacactgtgagcttactaagaatattttcttatgtctgctatcattgggtgatatggtttggctgtgtccccacccaaatctcatcttgaattgtagttcccataatctccacatgtcatgggaggtacctagtgggagttaattgaatcatgggggcggttaccctcatgctattcttgtgatagtgagtgagttctcatgagagctgatggttttataaggggcttttccccctttgcttggcactgctccctcctgccaccatgtggagaaggacatgtttgcttccccttctgtgatgattataagtttcctgaggcctccccagccatgctgaactgtgagtcagttaaacctctttccttataaattacccagactcaggtaagtcttcattagcagctcgagaatgaactaatacattgggctaaaataaactgtcccaatatataaggaccacgttgtaaaaacttctccactgcttccgtcttttgcctagaacatagaacaggggttaaacgcttccatggtgtgtaaagttgagtgatagattaaaatgtaccattggtcaagagcagtagctcacacctgtaatcctagcagtttgggaggccaaggtgggtcaatcctctgagatcaggagttcgtgaccagcgtgaccaacatggagaaaccctgtctctactaaaaaaataaaataaaaattaaaaaaaaaaattagccggcatggtgtaatcccagctactcgggaggctgaggcaggagaatcactttaacccaggaggtggaggttgcggtaagccaagatggcaccattgcactccagcctgggcaacgagtgaaactctgtctcaaaaaaaaaaaaaaaaaaaaaaaataccatgaactaggtgacaaaataacagaaatttatcctctcatagttctggggagccagaattctgaaataatgatgtccacagggccatgctctttctgaagtttctggggaaaaaaatctttccttgcctcttccagcttctggtggttgcaatccttgagttctttggcatgtcactgcatccctcccgtctctgtcttgtcatcacatggtattctccatgtgtgtgtccatgttcagatccccttttcctatgaggataccagtcattggattaaggctcattcttactctaacatgttatcttaatttgattacatctgcaaagacgctatttccaaataagatcacattcacagtttccaggtggacatgatttggggatgatactattcaatgcagtgtatgagggttcacttgtattcagttatatcaggtaataccattaagtgtttcttaagcttttaatatttgaaaacaaccttattcacaataattgataaaataactacatttcagaatttaaatatacctgaacaagaaatgacaaatggttgtcaagtacttttatgcttagaataccatgctttcctcatgcaggaaattggaacagaccctggtcatgggcgtgttaaatcctcctctttcatccaccactgatctgtctcataacttgatcactcctatggaactgactgtcatttctcagtttcattctaggaggcttaaaagttctacagagcaaaagtatttttcttcctctttttgcttttttgcttgttacttttgttgaggggtcagcaaatgtcctctgaagagccagatggtaaataatattagtaacattaggctttgtgggcctcacggtctctaccacaactattcaactctgcctttgtagtgcaatggcagccagagataacctgtaaacaaatcagcatgcccaagttccaataaaactttatggacactgacatgtgcattttatataattttcatgtattgtgaaatattattcttcctttgatttcccatccatttaaacctgtgaaaagcattcttagctggaagactgggccaagaagaggtgggccagaatttgttttctgatttctgccaagtcttgttccctctctcttgttggttgtctgcctttgctccaccttttctggcatagaggacattctgcagggtactgtgtttcatatcctttttttcctttcccttctcctcctgcctttgaccttccctttccttttcttccttccccctcctactactatgtccctaaaataaatattcactacccctaaactatatttgatcattgcacattgattactgtaatcatttcctattttctaaaaatttgatgagtgtgatgtaggtcatggtgataacatgagggtagtcattctcttatttagaggtagaaattagatttaaatttctggcataatataagtatgaattgtaataatcccctgaacattattagaaatgtagattttttctcttctgagtgatcagcctccaaacatatccaaaattggagagagcactgtaaaagtcctgtgtccccgttactcagcctcaacaggtttccattcacagccaatgttgttttatttgtacctctgtctcctccctcctgtgaaattattttgaagcaaattccagacatcagtattttcactggcgtccctgtgaagagaccaccaaacaggctttgtgtgagcagcaaggctgtttatttcacccgggtgcaggcgggctgagtctgaaaagagccagcaaagggagatggggtggggccgttttataggatttgggtaggtagtggaaaattacagtcaaagggggttgttctctggcgggcaggggtgggggacacaaggtgctcagtgggggagcttttgagccaggatgagctaggagaaggaatttcacaaggtaatgtcatcagttaaggaatgaacaggccattttcacgtcttttgtgattcttcagttacttcaggccatctggatgtatacgtgcaggtcacaggtgatatgatggcttagcttgggctcagaggcctgacaagtatattttagtatgtatctcttaaagacattgactcttaaaaaaaaatatatatatatatatatatatatatatatacacaccatcatagtaacatatctagaaacaattaatacaaatttcttaatgtctttaaatatccagtgtttacatttccctaattgtcctgtaatttttttatgtacaatcggattgaattgtaacctacaaactgattagttgatctacttcttaagtctcttaatttttagattcaatctttttctgtctctctttctttctctgtttctcttccccctattttaagtttatttgtaaaagaaagtaagtcttccgcctgtggtgtttcctacagtcttgttaactgatatcttcccagtggtatggtctagagatttgaggaaatttatgttgtatttgtttgttaataatattttataattgttgcagtatccttccatcaagaggtccaaatgtctacttgtcgttcttttgtggtgttagcagccatggatgaccattagtgtaattattagcagttgcaaaatcatgatgttcttcatacagttggggtatttatcccttaaaaaaaaatgctacctgttgaactagatgattatcctgcatttttataggaattataggacaagtgtttatttttttctttaataagatttcaaaataaatttgttttctagtattctccaaaggcaatcaatgaaacctaatgtttgtttattaggcattatgtacttcagtctattttttttttttttttactttaagaacatattttatttaacccaatatatccaaaatattaccacatcaatgggcaattaatataaaagtttattaatgggatattttacattcatcagttcatcctacatcttttttttttttaatactttaagttttagggtacatgtgcataatgtgcaggttagttacatatgtatacatgtgccatgctggtgtgctgcacccattaactcgtcatttaacattaggtatatctcctaatgctatccctccccactccccccaccccacaacaggccccagagtgtgatgttccccttcctgtgtccatgtattctcattgttcaattcccacctatgagtgagaatgcgcagtgcttggttttttgtctttgtgatagtttactgagaatgatgatttccaatttcatccatgcccctacaaaggacatgaactcatcattttttatggctgcatagtattccatggtgtatatgtgccacattttcttaatccagtctatcattgttggacatttgggttggttccaagtctttgctattgtgaatagtgctgcaataaacgtacatgtgcatgtatgtagcagcatgatttatagtcctttgggtatatacccagtaatgggatggcagggtcaaatggtatttctagttctagatccctgaggaatcgccacactgacttccacaatggttgaactagtttacagtcccaccaacagtgtaaaagtgtttctatttctccacatcctctccagcacctgttgtttcctgactttttaatgattgccattctaactggtgtgagatggtatctcactgtggttttgatttgcatttctctgatggccagtgatgatgagcattttttcatgtgttttttggctgcataaatgtcttcttttgagaagtgtctgtttatatcctttgcccacttgttgatggggttgtttgtttttttcttgtaaatttgtttgagttcagcaaagtctcaggatacaaaatcaatgtacaaaaatcacaagcattcttatacaccaataacagacaaacagagagccaaatcatgagtgaactcccattcacaattgcttcaaagagaataaaatacctgggaatccaacttacaagggaagtgaaggacctcttcaaggagaactacaaaccactgctcaatgaaataaaagaagatacaaacaaatggaagaacattccatgctcatgggtaggaagaatcaatatcgtgaaaatggccatactgcccaagctaatttatagattcaatgccatccccatcaagctaccaatgactttcttcacagaattggaaaaaactactttaaagttcatatggaaccaaaaaagagcccacatcaccaagtcaatcctaagccaaaagaacaaagctggaggcatcatgctacctgacttcaaactatactacaaggctacagtaaccaaaacagcatggtactggtactaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtaggaagctgaaattggatcccttccttacaccttatacaaaaattaattcaagatggattaaagacttaaacgttagacctaaaaaccataaaaaccctagaagaaaacctaggcattaccattcaggacataggcgtgggcaaggacttcatgtctaaaacaccaaaagcaatggcaacaaaagccaaaattgacaaatgggatctaattaaactaaagagcttctgcacagcaaaagaaactaccatgagagtgaacaggcaacctacaaaatgggagaaaattttcacaacctactcatctgacaaagggctaatatccagaatctacaaagaactcaaacaaatttacaagaaaaaaacagtctattgcaattgttactcttattcatgatcacattgtcccatgttcagccagtgggtgtaccttccagttggtttttaaatatttatgacatgaccttcgttgtctgctgtttcttcctttgggataaaacaggttgttctcagctaatctcttgccccacatctggagcctgctacttctctgccccacccactttgcttctctgctcttcatttggaataggaagcataattcatttacctctgtggaaactctgttgttttagaaggggagatgccactctagcagtactatcagagggtaaataatggaaccaaccaatccagcaactctggcacttctgaaatttagacaagggggtcatgttgtgtacttggaatgcacctgcattatgttgtggagagcaacacaggcaaactctgaaaaccaccctcatgtgtggctcactctgaggccttcaataatgtgttctttggaattcagatctgctcactgcacataggttgcaatagacatcatattattcccataatagtcttcaataaatgcttctgaaacaaatatcaatgaataaatgacattttcagcttttagagatgaaaatgacctagcccattttgtctgatactccatttttacctcaggaaactaaggccttgatatttcaagtgatttgtccaagttcatagtgcaaagtagcagatttaatccccaaatcatctgacctcaagtgcatcgtttcctactatacctactgcctctagactgtattagatcatttagcattaattattttgatcattgtccatttcttttttttccttccttctatagggatgaaaaaactttctaccctctgaatttttgataattgagcctatgaaatcaactgacagtagacacattaacatgaaacagaaattttaattactgcaaatgcatggagtcccacaaaatatgggactggaaaatgtgttcgatgactgaagcttatataacatcctgagctacagaaaggaataggggcctgaggcttctaagggtggtggtgacacaaattatgtgaggtgaggaaaggaaatgcatgtcgagcaaaggttaccttgtcatgcagataaagtctctctggtaataaaagttgtcttcaagcagccctcagaagaataggtgcgagtctgagtcacaatctgggcatggtgtccgcccttcttgtgatataaatccatcttccctagttgatgagattcccagagagacaattcatgacaaatgtgtttctttcagaggacctgcccttcattagaaagggaaagttcagaaaaaggttctccctgcgcttttgggggagaaagaggggcaagaaacggaacagaagagcagagagaacttggttctccttcagttcaaggcactcaggatatcaaagcatcatattttggggtattgttttgtggaccccagcacctcctttatttctctttctctctgtccctcttcccttctctctctctctctttctctctctctgtgtgtgtgtgtgtttgtgtgtctcttctttctaatgtaaataacatgagcctcctgtgattgttgttcccataatagtgagtagcaagtctaacaacggttcaggtaacccccaggcaagcaaaccaaaaaaaacagcctgttcaccgttcactaagctgttcgtacagtacatccctatgcccatttccaagtcttagatgactttttctagcacaattcaaaaagtactttatttcacaataataataatagaaactcagaagctttactttctcacttacctaagtaagggtggtaatgttttaggctacagaaataatcatcacttaccataaatgaatcaccttagtgttgccagcatactgaaaaagcaaatgacaaacaagataattttgatagtcactttattgccttcctgtgaagtgctaaggaacggatttattttcttgaacgtttccccttggaggatctgctgaaatctttttaattccgaaatcagagatttgctagcttagcatttggcaaaaatgatgatttatcctatttaagcattaaactatctatgtctatttgggtttcaggtgaccagatggctgagcagggcacctttacatcttttattcttaattttatttcattaactcagcaagtatttattgaccactagagtaccaataccagataacctgtaagggaataaggattaaacagtgaaaatggcacccatagggaccttaacagagtagtggctacaacaaatatgttacagagacactgtgataaatgcaaacacagacataaacataggttgttagggaagcatacggaaatggacagctgatctgcgcttggccttgcattgcggttttgggaagtgattggtattttctgacaagtgctttgaagctgagacctaagggactaagcaaaagcagagtggcagtgtcctgcatgggggcagaatttgctggatttagaggcacttgaatattttgataagcctcacagagaattttttttttaatgagtgaaatcaccaaatgcatttgtacttttgttaaaattaaagttgagaacaccaattttagtccctttgaatatgttaactgtgctatcttcaaggttttctttctccaaaaagctatttctagctaattatcctcactaaggaaagtgatctgtcggactgtgttgctaaggctcctcacaatgggggctgctgcagtgactagagactgagtcaatgaggaaaattaaatacttccagggactgattatttgggaattttcttccaagggaagttcagagaaagcccctccctgcccttctgggagaaggggtcaagaaacgggacagaagatcagagagactttggttcacctttagttcaaggcactcagcatcccaaggcaccacactgtggggtattgttttgtgaggcccaacatttccttcctttctctttctctttctctctgtctctcttcctttctctctctctctctctctcttctttctaatgtaaataatatcttttgtctcatcaaagagtctttaattaagtctttttcctgggttggaagcaatgagaaagggtcacaaccccgtcaagggaaagtcacatataacacagcccgcagtgcccccaaggatgtaaattgcttggatgtgtttaatcttcccatgtttgaagacacagactgtgatgtgaactagggtcaacatgaaaggcagcgccatcttaggtgactttagcctgttaatagggaatcctcctgtccttttcaattgtatattttctgctgcatcaaagcttttcaggtaacggtgtcagaaagagcataatctctcaggttagcctggtacaacttaagtttaaactaactgctaactgaaaataaaattccccaacaataataaaaattttacaaagttaaacactaaagaattttttaaaatattgcataaataatttgttgtaggttataaatgtgtttattatttatatgctgcctctcattatttagatgaccctagcaggtgcctgaaaatgaacgtttacatttttaggttggaccataattacttattttgtgtatcttcttcccactagctttggtggcataaaatttgttattcatcttcacgtgcttaaggcctagaacagtgcttggaataaagcacattgttcaataaatggaagctcccatgctcacgactctgcttgccctataaggagacagtgtgtacacttaccatagaataattattatcttactgttcatctcagaaaaaaaaaaaaacacaatggttttaagaagtaccttgcaccttacacatacttttatgttgctctgtgaaaagtctttgcagtttagtatcttataaatattgtaagtaaaggtcaaattccacaggggtctataatttcaaatattacttttattgttttacctgtaaaaattttctaagtgttttttttaaacttactgttacagagctatctggtaggatctataaccccatgaactacattttattatttattttattttactttttggaaagacagagtctcaccgtgtttcccaggctggtctcaagctcctgggttcaagcaatcctcctgcctcagcctcccaaagagctgggataataggtatcagccaccacacctggccatcaactacatttcaaatggatgttttataggaatcatcattgatgataatgagagatatctgttggaaaacaaaatgaagaaagggttaaggagtattatcagcactgtcacgcgtgtctgtgtgaagagaccaccaaacaggctttgtgtgagcagcaaggctgtttatttcacccgggtgcaggcgggctgagtccgaaaagagagtcagcaaagggagataggggtggggccgttttataggatttgggtaggtagtggaaaattacagtcaaagggggttgttctctggcaggcaggggcgggggtcaaaaggtgctcagtcggggagcttctgagccaggagaaggaatttcacaaggtaatggcatcggttaaggcaggaaccggccattttcacttcttttgtgattcttcagttacttcaggccatctggatgtatacgtgcaggtcacaggtgatatgatggcttagcttgtgctcagaggcctgacaggcataatatttattgaacttctgtagactaatgggcactgttctgggtagcagagattcatcaatatataaaatctgcaaaagttaaaacaaacaaacaaacaaacttctctgacatcctggagtttattgccctttaagaaggtggtgggccgggcgcggtggctcacgcctgtaatcccagcactttgggaggccgaggtgggcggaccacgaggtcaggagattgagagcatcctggctaacatggtgaaaccccgtctccactaaaaatacaaaaaattagccaggcatggtggcgggtgcctgtagtcccagctactcaggaggctgaggcgggagaatggtgtgaacctgggaggcggaacttgcagtgagccaagatcacaccactgcactccagcctgggtgacagagcgagactctgtctcaattaattaattaattaattaattaaggttgtgggggagacagacaatacaaaataaacatcacaaaggaggaaattgttgactgtcagaaggtgatgtgtgctataggaaaaaatagaggtgatgtaggggtgggaagactttcctttatcctctgagggtttgatgagtgagtgtacgaaataatctgaagggaggcagatgaacaggagaaaagacacacaaatttgttacctacaggaggacatcactggagagaaacctgaacacccaaaaggccagtgagattttgaagcttatataccttcttcccagggaagaaggtagagtggatatagtcaaaatttaggggagagtaaataaattcggggaaagacaaatggcccagagcataggggatagtctgagtgcagggttcacctccaggctcccctcttgttttttgttgtcgtggtggtggtactggtgtgaagggtgaggacaatcagtgtgtttttcccctcagagcaaattgtaaagctaaattagtcattatttaaatttactatagttgcctttataaaaactttaaatttacattatacatgttgaaattgaagctatgcaattgtaatataaacacggatttacaactaaagcatgttataatgtaaataattgattttctgtatgaaatcctaggcaatattgtaaaattgtacagacccgtcaactttttccacttaaatattctgagtaaagtttaagggtgttgtagttttcaagtggttttttttctttgtttgtttgtttctttttgtctcttgtgatccaagttttcttctctggttggtgagattactggggcaaagatttcttgacaattgagttccttttgaaggatccttcctaaggccggtaatgggagctcagaaaaagctcctcactgcatttgctgttctccaggtgccctcagtttgaagcaaccagcatgccacagtggcacattttggggtggtattttcttagttccctcaaaggtaaaatgcagagtgggttatatgtttaaacaggacagttgggtgggcctcagtgaggacgtgccctgtgaatagaggccaaacagagatgagagagctagcccaggggagttttaggggaagcatcttctagtcagaggaaacagcccaggcaaacgtcctaaaacaggagcatctggcatgtttgtttgttggttggtttgttttgagatagagtctagctctgttgcctgggctggagtgcagtggcatgatcttggttcactgcagcctctacttcctgggctcaagcgattctcccacctcagcctcccaagtagctaggatcacaggtgcacgtcatcatgcccagctaattttttgtatttttggtggagacagagttttgccgtgttgcccaggctggtctcaaactcctgagctcaagtgatctgcccacctcagcctcccagagtgctgggattacaagcatgagccaccacgcctggcccatttagcatatttgaaccacagttaggtcagtgtggtgtagtagatattaggagtgattttttttttaatgaagagcaagcaatacgttatgaagtatccttaaataacagggagcgttctctttaaggttcctcaggaatggtcagtcatggatccaagatgacatttacttagcctccaagtttgaattcaagatcaaaatctaattactgttacaagcaacaagaatcaaagagtaacatctccttgctacacaggttagaagactccttattgccacacagatgaattcttgactagcaaatgcacataaaccacatccctacccagtgtgagtgaaaaaggaaagggaagattagcttgtctaagtatcgatgtaaatgtagtcagtaactctagctgtattttaaaaggattttaacatctctacaatggaataaaaacattaacggatatccttcttcctagaaaatggctaatgctttcctacaaaaaaagacacatatgagctccaaattgttcttcatgtgggtgagaatggtctgtcattatttatacttgttcacagtgcttcatctgtcatccatctttgggctgtaattgtgagcttaaaaataatcactattttccaccacctgcagaacataatctgcactttgagctcatttcctcagtgttccctacagagttccatctgctttacataccttatttctctacacatgattaaagctgctgatgctacctgaactgcatacatagctggcattatggaatgcctcaaactaccacagcgtgctgtggtgagatgcctttcctatcagagtctaggcttacaaaaatgcatgaagtgtttctcatatattgcatatttggggtgaaaaaagacaatgacagccaatttttaataagttatgtcagggagatcataattattgatcttctaaacaaaactatctataaatatatggtcttcaacttatccaccgggaagacagatgaaagtttcaaatggatcctcttacaaatgactaaaaaacactgcatcataatctaacattatgttgagtctttttgcctgaatgttttctaaacaattttgtagaagttagttaatactttaaataactagacattgtaactaagaaattattttgtaagttattcaggaaagtacacatagctcttataaaatgaccagtatttgttagtttcttttataaatctgaatgtttatataaagtttacctgaaataagatacatcttgctttcatatggaatatttcatgtttgtttccaatagccaaattaagaaatataatttcaaatataaaattaaagcttatgtaattttctttctttttttttttttttttctgagacggagtctttctgttgcccaggctagagtgcagtggcctgatctcggctcaccacaacctctgcctcccaggtccaagcgattctcctgcctcagcctcttaagtagctgggattacaggcatgcaccaccatgcctggctaatttttgtatttttagtagaggctgagtttcactatgttggccaggctggtctcaaattcctgagctcaggcaatctgcccgccttggcctcccaaagtgcaggaattacaggcgtgatccaccacacccagtcaagcttatgtcattttctaattctactctcctttctcaactcttagaatattttattgatatctgtgttcttaaactttacaaaagtgacatcatgcattaaatgctcctcttacttgcattttctactcaatgttctgattttgaaattcactcatgtttcataaatatacttctaattgttttattttcaaatattttataacaattgtataaccatagctcaacttattttccactcttgtcggctggccttttatgttgtttttatttactattgcaaacaatatttacaaaatatttaatgttcaagaattcctttaggatatataactagaaataattattattatgggatattctcatcttcatatttactttttattccaaattattttccaaaatagctccaagaatcagggtataggtgttcatatcctcaagaactctggatacagccacatttttaagtatttgccaacctgacaaacataaaataaaacctcattgtagttcttctttgtatttccctggttactgtgaagatgtgcatctccctgagttgattaaccatgtggtttacccatttgtaaattactggtctatgtttcttgcctatttttcttttgcgttatttccgtttctgttaactacttgtagaagttctttatgtagctggatactaatatttgttagacatatatcttacaattatctcttctactcagtggcctaaaatttcacattctttatggcatgtcgatgaagaagagagctgaattttaacaaaaccatatgtacccatttctcccattagagtgcttttcttacactttctttaagaaataatagaaaaagccggatgcagtggctcatgtctataatcccagcactttgggaggccgaggtgggcactttgggaatctgaggtcaggagttcgagaccagcctggccaacatgatgaaaccccgtctctactaaaaatacaaaaaattagccaggcatggtggtgggcacccataatcccagctacttgggaggcagagacaggagaatcgcttgaacccaggaggcagaggttgcaatgagccaaaatctcgctactacactccagcctgggcaacagagtgagactccgtttccaataaaaaaagaaataatagaaatgttattttgtgctttcctctatggattttgaaggtctgtgtttcattaggccttgaatccatctggaacaatttttatgtagggttaaagacagggatctaattttattttttcaatatgaataaacaattttaaatttctcataaatatctgacaacaggttgcatttatgtcaagtttacatatatacacagactttgctttaagtttttaaaaatttgttgcattattttaattggctgtgcctgtaccaaacctgctttaatcatgattcttgataggccaattgtctctgcattgttcttcaacaatgtcttggctattcttagaccttggctcttaaatacaaattttttccaccagttgctcaattacatttatatacacacacaaattattgggattatgattgaaaatggaattaatttatatactaagttattgattcttccagtctttgaatatggaatattcctttatgtgattcttctttaatattattcattaaagttttaaatttctcccaataagttcttgcatatattttgtgagattttgttttattacatcataaattctatttttaaaatattgtattttctcattagttattattggaaatataattgatttttgtatattgttcttatattgaataatcttttttaagctgtagacttttctaacaggtttgaaaatttatcagctccccatcttctctacaattcttaggataatgataatgattattattattatgttttactttctttttctaatgactaagaccccaacataatgttgactagaaacagtgattataagcatttctctttctgatgaaaaaaaaagattctaatattttgtgactaattctttgaaccttctattataatgaagttcttttactcttttacacatatataggggaattacaatttattcctatatagctcattttattgaaattattctttattatttctggtgccttttcttaatgtactatgttgcattaatttttaacattaaactatcttagtctaaacactccaagtataaaccaaacttgaataactcaagtttctaaaattaagaattcaagccacatgtgatggcttataactgtagtctcagtaacttgggaggccaaggtataaggattgcttgaacctaggaattcaagagcagcctaggcaacatagggagacacccatctttatcaaaaaaaaaaaaaagaaaagaaaaaagcctgatttagtagtgcacacctgcagtcttagctacttgggaggctgaagtggaaggatcacttgagcctgggaggttgatgctgcagtgagctataatcatgccactgcactccagccactccagcttgggtgacggagaggagcgagaccctgtctcaaaaaaaaaaaaaaaaaaaaaaaaaaaaaaaaagactacatctccaccaaaaaattggccaggcattgtggttcatgcctgtaatcccagcacgttgggtggctgaggcaggaggagttcaaaaccagcctaggcaacatagtgagaacctgtctcaaaaaaaactgttaaaaaaaaagaatgcaagaagatataatttgtatattacgataatcagaatatataatataactgaggcagtacaatgtaaattcaacaaaccataggcacagttctcttgtgaagccataattgacaaatattattggcaaatccatctttattggatcattcttatcagcatacaaatacattgtaatgattgcccttttaaaaatagaaaacgccatcacttttgatgaaagaaaatggcttgaaagaaaaatcgtttttttttcttcctactctcccttcgagactgatataatcagtctttctttcacatcagaccatggaaaccctcttggaaagatcatattacccatactttcgataaattcaataattaatttagtcctcattttacttaacattgaaataccacttaagtccgttgatgactctctttctgttgaaactgatcatgtggctttctctgattttcctcccgcctcctggtctacctagtcttggtctctttattggctcttctatttcccacaatttctcccacctcagtaaatggtaccatcatttgcctggataaatattcagtccaaaattctcacaataatccttgtttcatttttttttccccctgataggtctcatccaaaacatgaccagatctttctggctgtatctttacatgatagatttaaagtctattttaaaatatttaaaacaaattatattttttaatgtatttccacttctctgtcacctccactgccaccatccaaagtctaagtgaccatctcccattagctaaagtagtagtttacaagtcatctctgtgcttccactcttgccctgctactaattattgaccacacatgagccacaattacaactaaaagcataaatcattcaagtcacactactgcttaaatctctgctgtggctttccataacatgtaagataaaatctgaagactttaatatgccttacaagaaactacaatatctgttccctgcctttttgtcttatatcatttcctactcttttctctctttattgtattctggcaaaataatctgccagattattcctgcttcatggcctttccatttgccattagttcatcttagattactcttcccattgatcttcatatcattccgaaatttgctcaaatattaggatctcccttaccaatctgcctgaaatggtctctctcactcctcaatcattctccttccacttaccaagctttttttcacagaagatataagtaagtaaaataaacgtgttagatatttgtttgttttctgcttcccatgtttgaaactagactgtaagttgcctgagatgatggattttatatcgtgctcattgccgtacctctagaactcagataaatggtaagcatattatgagcaactagatatatcttttcaataaatgcatattgaagatgttcttgagtttgaagaaatgatttttaaaatatgaagtaatcttttatctccacaagttttctacacccacgcctacgatcgtgtgctagacctttcaacctatgctgcaatcttatagcccactattccagacctttccatttctgactcatccagatcctttatttccatttacagaatccctcttgtctccagggtgtgtgttctgagcaataagaaggataaaattgctcttatcaccttctccttcttcatgcgacacatccccattcatctgtcatggttcacgacaaatgctctgtcaccagcttgctccacagctttctcaagctgggttatatggaccttttatttggatacacaatatatctctgttttagcacttgtttctattttgtagtcttaagcttaatgtcctctaactgccactggaccataagctcatagaaaacaggaaagcaagtctttttcatctttgtgtccccagagcctggcactactggaccagatcaggaacttaataaatggcttgtggatgcatgaatgattaaattatattaccaacttatgacattttttatgtaataggctatacattgttgccattttaaaataatattttaaaaagtctaaaatagtatctgcatattgcccctccccacccaaaatgagtgccgtgctgtgagaaagacaataaaaattttatgcttggtttgccaccaagcataaccccactgagtcaaagagatgcagggtagtaaggtaaaaacagcacgcaacccagaattaggaaaacacatttctattattttgccactatctcttagtattgtttggtgtaacccacttttttctcctaagacttgatttcttattctctaatagaagaaagtcaagatgggtgccctccaagatcacattattttgatattatttgatagtcaaaaattttcacataagaatatagcttcctttaagtggtagggttgcttcctctggatacatgcttgtataagactgcaaagctttgagttttgaaaaaacagttcttattaatgctatagcatttaattggaaatcctagctcacatctttcttatagttagtgttcaagtgctgattgattgaatcaggataataccattaagacttctatgcccaaagaaaacagacaaaattattaagatacagttgctaagatgcagaagaaatttaaagatatagaaaatggaatttattcgttttattaagcaagccaaggcttatacgcaatataaaagatcttaagaatatgtcataggttactacctactgtgttgctatgagacctgcactagaaagatctaatgccacctgtgaaaagtaactatagtagaccataaggcagctaaggaattcagactacacattgtatgttggccacacccagtctagcaagatttatatatacattttaatttagaaagttcataatattccttttgtaaaacaaggatcatttcagagaaaatatgaaaaaaggtggaaaaaatctctctgattaacaaattgcacattaactggtacgatgacatggtttgaaaaacaaaaataatacttagctgcaaatacaggtgtataggacacatataaaaatttttcattagactcagctcatatacttttattaaaatgtgcataatgtgaacttcagactgtatatgaataacatagaaaagaatcaggaaacagctataaaatgtatatatatataataacagctattatatatataataacagctattatatatatataataacagctattatacacacacacacacacacacacacttatacgattaagaaactggttacattctggaaggaattgttttttgcttttttttcactggtcattttccagctttatcagtccctggccagagctccagccatgcaaggaattgagttcttgagaagtgaattacttgaggattacagatatgttgagaatatggggtcagtagtggaggcagcagagggatttttctaatgtgctcatgtcaacatgactacactggttaatcttgagggcccgttattgccagagacaggaacaggtctccagagtatgttccatacatgcccagtgtttcaaatataccattaaatcagcagtatttacaacaaaataaattgtgacaatttaaaaataggtgattacatgatgagacagatactaaattctcagtagttccacaagacattttcataacatagtaatccaaagacagtatttaaaaagcattagttaatccgtggcttatttgtgaaatgaaacttagaaatttaaaatttgctatatgcagtagtttctgtttgcattatatgcataaatgataacacatataaacacactaaatatgggaataagattcttaatttttctacttatgatactagcaaaggaaaatctgtagagtgtaaatacatgttttgttctagatggtggacacatgaaaaattgttcatatccatttgtcacttaagatttaatggctcttccactgccctgaagggtgagtcccggaccaggcagtattcatcacaaactgacttgagagccgtgggccttaagggaatattggagataggctagcaatattccctgtggcccgttgtggtgatgaccacagggtgacactccttttcctttggaaggagagagaagagtgggaagtgctgcatcttgtggcttgagtgacagctcagccacagtacaacagaacaggtggagttctgaggtttttgactctggtccctgattgctggaggatggcaactctggacctacctgggacctcgggtgactcgccaccctgaagggaaggacataggcctggctggctgtgctacctgatgattgtagaaccccagagccttgagcgaacataggcagcagccagggagtggttacagcaggtcttggggcaacacccagtcctgtgctggctttagatctgacccagcacaatcctagtggtggtggccaaggagtagttgtgtcactccacccctagctttcagtggctcagaacagagagagacactctatttgtgtgggaggaagaagaaagagaacaagagttttcgtccagtaatccataggattctttcagatcttgtccaaggccatcaaggtagtatgtctatgagtctgcaagaaacacagcattactgggcttggggtgccccctaaagctgttacagcttagatcacaatacccaagtccttctgaatatctggaaagctttgccaagaaggatggggacaaagaaggtgagaaggtgaagactacaataaatatctagctttttaatgcccagacatccaagaacatctactagtatcaacaccatccaggaaaacatgacttcaccaaatgagctaaataaggtaccaggaaccaatcctagtgaaacagagatatgtgacttttcagacagagaattcaaaatagctgttttaaggaaactcaaatttaagataaagcggagaaggtattcagaattctatcagataaatttaacaaagagattaaaataattatatattaattaaaaataactaatatatcatataattatatattttttaaattaattgaattaaaaagaatcaagcagaaattctggatttgaaaaaggtaattggcatactgaagaatgcatcagagtcttttaatagcataagagatcaaacagaagaattagtaagcttgaagacaggttatttgaaaatgcacagtcagtgaaaacaagaggaaataataatttttaaaaatgaagcacatctacaggatctagaaaatagcccccaaagggaaatctaagagttattggccataaagaggaggtagaaaaagagatggggtagacagttaattcaaaggtataataacaaaaccctagggaaagatatcaatatccaagtacaagaaggttataaaacactaagcagatttgacccaaagaagactagctcaaggcatttaataactccaaaaggtcaaggataaagaaaggattctaaaagcaacaagagaaaagaagcatatagcaggcaatggagcttcaatatgtctggtagcagacttttcagttgaaaccttacagaccaggagagaggggcatgacatatttacggtgctgaaagaaaaaaacttttaccctaaaatagtatatctggtgatgatatccttcaaatataaaggagaaataaagacttttctagacaaacagaagctgagggattttatcaacaccagacctgtcctatgagaaatgctaaagggagtacttcagtccacaagataaaggatgttaatgagcaataagaaatcacctgaaagtacaaactcactggtaatattaagtacacagaaaaacatggaatattataacacagtaactgaggtgtaaactacttcatcctaagtaaaaagactaaatgatgaaccaataaaaaataaaaagtacaacaatttttgaagacatagacagtacaataagatataaatagaaacaacaaaaagttaaaaagcagaaggatagaggtaaggcatagagtttttattattacttgtgcttatttgtttgtttatacaaacagtgttagttgttatcagcttaaaaaaatgtgttataagatagtatttggaagccccatggtaaccacaaaccaaaatcaaacaatggatacacacaaaataaaaagcaagaaactaaattataccaccagagaagatcaccttcactaaaggaggacaggaagaaagagaagacaaaaaaacaaccagaaaacaaataacaacatggcaagagtaacttcttacttatcaataataacattgaatgtaaatgaactaaactctgcaaacagaagacatacagtagctgaatagatgaaaaagaaaaaccatttgatctgttgcctacaaggaacacacttcacctataaagagacacatagactgaaaaataaagggatggaaaaagatatattccatgcaaatagaaaccaaaaaaagaaaaagagtagctacacttataacagacaaattagatttcatgacaaaaactataataagacacaaagaaggtcactatataatgataaaggtgtcatttcagcaagaggatataacagttttaaatacatatgcatttaacagtggagtaccgcgatatataaagcaaatattattagagctaaagagagagatgggccccaatacaataataactagagaattcaacacctcaccttcagcactggacagatcttctggacaggtaataaacaaaaaaacatcagacttaatcttctctttagactgaatgaatttaacgcatatttatagaacatttcatccaatggctacagatcacacattctttccctcagtatatggatgattctcaaggatagaccatatgttaggtcacaaaacaagacttaaaacattcaaaaaatgaaaataatattaagcatattctttgaccacaatggaataaaactagaaattgataacaagatgaatttttgaaactctacaaatactggaaaattaatatgctcctgaatgaccagtgggccaatgaataaattaagaaggaaattgaaaaatggcttgaaacaaatgatgatggaaacacaacataccaaaaaatctatgggatacgataaaagcagtactaagaggaaagtttatagctataactgtctacatcaaaaaagaagaaaaacttcaaataacctaatgatgcagcttaaagaactagaaaagcaagagcaaaccaaacttaaaattagtggaagaaagaaataataaagatcagagcataaataaataaaattgaagaaaacaatacaaaagaccaatgaaacaaaaatttggtttattgaaaagttaaacacagttgacaagcctttagccagactaggaaaaaaagatccaaataaataaaattggagatgaaaaaggagacattacaactgataccacagaaattaaaaggattattggtggctacaatgagcaactatatgccaataaattggtaaatctaggaaaaatagacaaattcttagacacatacaacctagcaagatttaaccaggaagaaatccaaaacctgaagatatgaatatccagtaacaagatcgaagctataataagaactctgtcaataagaaaagcacaggaactgaaggcggaaatctgaaagcctttcctcgaagatctggaacatgacaaggatgcctactttcaccactgttattcaacgtaatactgaaagtcctaagctagagcattcagacaaaagaacaaaataaagggcatccaaattggagtggaagaagtcatattatccttgtttgcagatgatatgatcttatatttggaaaaacctaaagactccacaaaaaaactattagaactgataaacaaattctgcaaagttgtagtatacaaaatcaacatacaaaaaccagtagcatttctatatgctaacaatgagcaatctgaaacaaaaaaatcaaaatgtaatcccatttacaatagccacagataaaattaaatacctgggaattaaccataaagtgaaagatctctataatgaaaaatataaaacactcatgaaagaaattgaggagaacaccaataagatgaaaaggtatttcatattcatgaattgaaataatcaatattgttaaaatgtccgtccttcccaaagtgatctatagattcagtgtaattcctatgaaaataccaatgacattcttcacagaaataaaaaaaaaaattttaaatttaaaattaaaatttatttggaaccacaaaagacccagaataaccagatctatcctgaacaaaaagaacaaaactggaggaatcacattacctaacttcaaattatgctacagagctagagtaaccaaaacagcatggtacagcataaaaacagacatgtagatcaatggaacagaatgtataacccagaaacaaatccacacagctacagcgaattcattttgacaaaggtgccaagaacatactcttaggaaaacagtctcttcaataaatggttctgggaaaactgaatgttcatatgcggaagaatgaaactagacttctgtctctcaacatatacaaaaagcaaatcaaaataaagacttaaagcaaagacctcaaaatatgaatctactacaagaaaacactggggaaactctccaggacattggtctgggcaaaaatttcttgagtaataccacacaagcataggcaaccaaagcaaaaatggataaatgtgatcagctcaagttaaaaaaaaaacttctgcacagcaaacaatcaacaaagtgaagagacaccccacataatgggagaaaatatttgcaaactacccatctgagatggtgttaataaccagaatattatataaggagctcaaaataactctataggaaaattttaataatatgtttcaataattggccaaagacttaaatagacatttctcaaaagaagacatacaaatggcaaacagacatgtgaaaaagtgctagacatcattgatcatcagaaaatgcaaatcaaaacaacaatgaaatatcatctcaccacagttaaaatggcttatatccaaaagacaggcagtaacaaatgctggtgaggatatggggaacaggaaatcctcatacactgttggtagaaatgtaaattagtacaaccactaagaagcattcagaacttccttgagaagctgaaaatagaactatcatatgatccagcaatcctactgatgggtatatacacaaaagaatggaaatcagtatacggaagaaatatctttactctcatgtttattgcagtactgttcacaatagccaagatttggaagcaaccaaagcatccatcaacagatgagtggataaagaaaatgtggtacatatacacaatggagtactattcagccataaaaagaatgagatacagtcatttgcaacaacatggatggaactagagatcattatgttaagtgaaataagccaggcacagaaagacaaacatcacatgttctcacttatttgggggatccaaaaatcaaaacaattgaactcatggacatagggtggaaggatggtttccagaggctgggaagggtagtgaggggttgcagggggaagtggggatggttaataagtacaaaaaatagaatagtaagacctactattaggtagcacatcagggttaccatagtcaataataacttaattgtacattttaaaataactaaaaagagtctaattggattgtttgtaacacaaagcataaatgcttgagtggatggatacctccttctctgtgatgtgatcattacacattgcatgcctgtatcaaagtatctcatgtaccccataaatatatatacctatgatgtacccacaaaaatttaaaatttaaaaatattgtatggttccaaaggagttattgcaatgtgtaatatacaagtgttacaaaataatttgtaaaatgcatcaacagtaactgttctatttcatcaaaatagagtttatatattattgtttgcatgtgctcacaattaccaaaaaattattttaaaatgtcaattaccaaagaaattgttttaaaatgtcatggcactggacttggtgggcaagatggcagataggagatagggctaatgtgcagttctcacctggatgaactgaactgtgtgtggagactcacactgtgatctgttgctccaagaaccaacaaaggaacataccaggaaaacctgaaggattcccagatcctttgaaagaagcagcacactactacaaatttcatgaaacaggtgaaaaactgagcattcccaaagtgtgagagaaggaaaacctgcctccaaacatacatttctactgggggacctgaaaatccagatcatgagattatggaagaaggatttaacctctcctggagttgaaatggatttagggagtcacatgaaatataaaagtagaagtagcagcagaaaatgccttgcaggcagtcccagtctccagctgaagcccagggaagccatctctgatgatatcttataggggcccttggggaaggcagccagaggaattgggaagtagtcacagtgcaaaggaaactctgaactgaaatttgtagttgtttcaactgggcacaaatcttctcaggtgaagtccaggagacaagcaggagtggctgcagattcgagcacaggagccgcagccaatggagtgggcagatgcaaaggagcaagggccatgcttgcttttttagtggggaagtctatgtcctcaggcaaggtcttattggggcactgtgggagtgagactggccttgccaattgcatgggggggtgggttaggcctctcactaatggctattccccacttctctggtgaactatatgacacagcagaggcagccaagatgtcttttggcctgagaaccaccctgcatccccacagtggctatagcaagccccagccaaggagaggctgagctcagacctgcataaccctgccctgacctgataggatttctttacccaccctagtagctgattacaaaagataaactcttgggagctttatggccctgcccatcacctgagaaactgaaatacttaccctggccaagttagggcaagcttagatccctccactaatactgcagctgttgctgtcttggaaacaccaccttctggttggaggccaaccaactcaggccattacagcaactcatggtagaataaccctgatcccaggaaggagaagacaacacctaattccactgcctacaagatactggctaaccagagttcctgagcgtgtccctgtgaaaacatcactgctagcataaccatcattcaagaaagccagcacactaaacatatctacaaccatggactctcacagagtctacctcacttcgctgccacctctaccagagcaggtgctggtatccatgattgagagacctgaagatggatcacatcataggactctgtagacattccccagcaccagtctagagcctggtagcccagcttggtaaccagacccaaaagagcaataacaatctctgcgttccagctctcaggaagccccatccctagggtaaggggggaagcaccacatcaagggatcaccctgtgggacaagaaaatctgaacagcagatgttgagtttcagacctctccactgaaataatctacgcaaacgagaaggaaccagaaaagtaattctggtaatgtaacaaaacaaggttctatagtatccccaaaagatcataccagctccccagcaatggatccaaaccaaaaagaaatctctgaatagccagataaaaaattcagaaggttgattattaaggtactcagataccagagaaaggtgaaaacaaacttaaagatattaaaacaaggtggggcatggtggctcacgcctgaaatcccagcactttgggaggctgaggcaggtggatcatgaggtcaggagttcaagaccagcctggccaacatagtgaaaccctgtctctactaaaaatacaaaaagtttggtgtgtggtgggcacctgtaatcccaggtacttgggaggctgaggcaggagaatggcttgaacctgggaggcggaggttgcagtgagccgagattgtgccattgcactccagcctgggggacagagcgagactctgtctcaaaaaaaaaaaaaaaaaaaaaaagatattaaaacaaaatacaggatatggatgaaaaattctccacataaatagatgtcataaagaaaaaacaatcacaacttttggaaatgaaagacacacttacggaaatacaaaaagtgtagtgtgggaagtttcaacaatagactagaacaagtaaaagaaagaattttggagctcaaagacaaggctttcaaattaagccaatcagacaaagacaagaaaaaaaaaagaataaaaaagtgaacacagcctccaagaaatttgggattatgttaaatggcaaacctaagtatagttggttttctggaggaagaagagaaatttaaaagtttggaaagcatatttgagggaatacttgaggaaaacttccctggccttgctagagatcaagatacccaaatacaagaagctcaaagaacacctgggaaattcattccaaaaagatcatcacctagcacatagtcattaggttatctaaagttaagacaaaggaaagaatcttaagagctgtgggacaaaagtatcagataacctataaaggaaaacctatcagattaatagcagaattatccatagaaaccttacaagacagaaagaattggggtgtcatctttagccttctgaaacaaaataattgtcagcccaggattttgtatccagtaaaatggagcttcataaatgaaggagagataaagtctttttcagacaaacaaatgctgagaaaatttgccacaactaagccagcgctataagaaatgctaaaaggggttctaaatcttgaaacacaccaaaatagaacctccttaaagcataaatgtcaccaggcctataaaacaataacacaattaaaacaaaacataaggtattaaggcaacaactagcatgatgaagaaaacagtacctcacatctcactgctaatgttgaacgtaaatggcctaaattctccaattaaaagatatagaatggcagaatggataaaaatccaccaacaaaatatctgctgtcttcaaaagactcacctaacacataaggactcacataaacttaaggtaaaggggtggaaaaagatattccatgcaaatggaaaccaaaagcaagcagcagtagctattcttctaccaggaaaaaacagactttaaagccaacagcagttaaaaaaaaaaaaaaaaaaagacaaagaggaacgttataaaatgataaaagaattactccaacagaaaaatatcacaattctaaatatatatgcacctaacactggagctcccaaatttataagggaattattaccagacctaagatgtgagatagatggcaacacaataatagtgggggggcttcaatactcctctgacagcactagatagttcatcaagacgagaagtcaacaaagaaataacggacataggccgaccgctgtggttcatggctgtaatcccagcactttgggaggctgaggtgggtggatcacctgaggttaggagttcaagaacagcctggccaatatggtaaaaccctgtctttactaaaaatgcaaaaaattagccaagcaacgtgatgggtgcctgtaatcccagctacctgggaggctgaggcaggagaatcacttaaaccccagaggcagaggttgcagtgagttgagattgcaccactgcactccagcctgggcaacaagagcaaaactctgtctcaaaaataataataataataataataataataataataataataatagacataaactatactctagaacaaatggatttaacagatagttacagaacgttctactcaacaactgcaggatatacattactttcttcaacacacagaacattctccaagatagaccatatgatagcttacaaaacaagtcttgataaacttaagaaaataaaaagtatatcaggtattctctcagaccacagtggaaaaaaagtggaaattaactccaaaaggaaccctcaaaactatacaaatacttggaaattaaatcacctgttccttaatgatcattgagtcaacaatgaaataaagataaaatttaaaaattgagctgattgatgatagtgacacaacttatcaaaacctctggcatacagcaaaagtggtgctgagaggaaaattcatagcattaaatgccctcatcaaaaagtctgaaagagcacaaataaaaaaatctaagattatacctcaagcaaatagaaaaacaagtacaaacaatatgcaaacccagcagaaaaaaagaaataacaaagatcagaacagaactaaatgaaatacaaacaaaaaaatacaaaagataaatgaaaaaaagtgggttctttgaaaagataaacataattgatagaccattagcaagaataaccaagaaaaaaagagagaagatccaaatgtcaattagaaacaaaacaggaaatattacaaccaataccacagaaatacaaaagatcattcaaggctactatgaacacatttacaaactagaaatctaatgtagatggataaattcctggaaatatacaaccttcctagattaaatcaggaagaaatagagattctaaactgaccaatgacaaatagcaaaattgaaacagtagtaaaaaaaaaaaaaaaaaaaaaaagccaacaaaaaagtccagaaccagacggattcgcagctgaattctaacggacattcaaagaagaatcgacaccaatcttactgaaactattccaaaagacagagaaggagggaattctccctaaatcattctgtgaagtcaatatcaccctaataccaaagccaggaaaggacataacagaaaaggaaaactacagaccaatactgctgatgaacatatatgcaaaaatcctcaacaaaatactagctaaccaaattcaacagcatatcaaaaagataatacaccattatcaagtgggtttcgtaccagggatgcagggatgatttaacatacacaaccaaataaatatgatgcatcacataaaataattaacaacagaagtcatatgagcatcccaatagatgcagaaaaagcatttgacaaagtccagcatccctttacgaataaaaccttctgcaaaattggcatagaagggatgtacctcaatgtaataaaaaccatctatgacaaacccacagccaacattatactgaatgggaaaaagttgaaagcattcatcctgagaactggaacaagagaaggatgcccacccccaccacctctatttaacatagtactggaactcctagctgtagcaatcagacaagagaaagaaataaagggcatcagaatctgtaaagaggaaattaaagttgtgctgttcacagatgatatgatcatatacctagaaaaccctaaagattcatccaaaaagctcctagatatgataaattaatttagtaaagtttcaggatataaaatcaatgtacacaattcagtagcactgctatacaccaacaacaaccaagctgagaaacaaatcaataactcaatcccttttacaacagcttcacaaagtaataataataataaaatacttaggactatacctaaccaaggaggtgaaagatctctacaaagttaactacaaaacactggtgaaagaaatcattaatgacacaaacaaatggaaacacaacccaatgctcatggatgggtagaatcaatactgtgaaaatgaccatactgccaaaatcaatctacagattgcaatttccatcaaagtaccatcaatattcttcacagaactataaaaaacaatcctaaagttcatatgaaaccaaaaacaagcctgcatagccaaagcaagacaaagctaaaagaacaaatctggaggcatcacgttaccctaattaaaactattctacaaggctatagagaccaaaacaggatggtactggtgtaaaaataggcaagtagaccaatggaacaaaatagagaatccagaaatatagccaaatatttaaagccaactgatcttcaacaaagcaaacaaaaacattaagtggggaaaggataccctattcaacaaatggtgctgggataattggcaagtcacatgtagaagtatgaagctgcatcctcatcgcttaacttatgtaaaaaatcaactcaagattgatcaaagacttaaatgtaagtcctgaaaccgtaaacattctagaaaataacatcaggaaagttcttctagacattgacataggcaaaaatttcatgacaaagcatccgaaagcaaatgcaccaaaaacaaagataaataaatgggacctaattaaactaaaagcttctgcacagcaaaagaaatagtcagcagagtaaacagacaacccacagtgggagaaaatctttgcacactatgtaggtgacaaagcactaatatccggaatccacaagaaactcaaacaaatcagcaacaaaaaaccaatcccatcaaaaagtgggaaaagagcatgagtagagaattctcaaaagaagatgtacaaatggacaacaaacatatgaaaacatgcccaatgtcactaattatcagggaaaggcaaatcaaaaccacaatgagataccacctgatatggtggttcggttgtgtccccacccaaatctcatcttgaattgtagttcccatgatccccaacccagtgttgcgggagggaccaggtagagataattggataatgggggtggtttccctaatcctgttgtgatagtaagttagttctcacgagatctgatggttttataaggggcttttctgcctttgcgttgctctcattctctcttgctgccctgtaaagaggtgccttccaccatggctgttaagtttcctgatgcctcctcagccatgtgaaactaagagtcaattaaaactctttcctttataaattacccagtctcaggtatttcttcatagcaatgtgagaacagactaatacagtaaattggtactgggtagtggggtgctgctgtaaagatatccaaaaatatggaagcaactttggaactgggtaacaggaagagactggaacagtttggagggctcagaataagacaagaaaatgtgggaaagtttggagacttgttgaatggttttgaccaaaatgctgatagtgatatggacaatgaagtctagtctgaggtggtctcatatgaagatgaggaacttattgggaactggagtaaaagtgactcttgctatgcaaagagactggtggcattttgtccctgcctcattcaagaggaagcagagcataaaagtttggaaaatttgcagcctgacaatgaggtagaaaagaaaactccgttttctggtgagaaattcaaacaggctgcagaaatttgcacaagcagcccatcccatcacaggcccagaggcctaggagggaaaaatcttttgtgtgttaggcccttgggacatggtgcccagcatcccaactgcttcagcgccagccttggctaaaaggggtcaaggaacagctcaagccattgcttcagaggatgcaagccccaatccatggtgactttcacatgatgttgggcctgtgggtacacagaagtcaaaaaccaaggttggagaacctccacctagatttcagaggatgtatggaaatgcctggatgtctaaacagaagtttgctttgctacaggggtcaagctctcatagagatcctctgctagggcagtgcagacgagatatgtggggttggagcccccacacaagactttggacttgagcctttgggttaatgctggaataagctaagactttgaagaccattggaaaggcatgattgtgttttgaattgtgaggtcatgagatttgggaggggccaggagaagaatggtatgccttggctatgtccccacccaaatctcatcctgaattataggtcccataatcctatgcgaggaccagatggagttaattgaatcatggaggcagtttccccacatcttgttgttgtgataataagttagttctcataaggtctgatggttttatagggagcttttcctcctttgctcaactctcattctctctcccgccaccctgtgaagaggtgccttctgccatgattgtaagtttcctgaggcctccccagcaatgtggaaatgtgagtcaattaaacttctttccttcataaattacccagtcttaggtatttattcatagcaacatgagcatggactaatacattaccttattcctgcaagaatggccataattaaaaaatcaaaaaataacaggtggcatggatgtggtgaaaagggaacacttctacactgctggtgggaatataagctagtacaagcactatggaaaacagtatggagattccctaaagaactaaaggtagagctaccatttgatccagcaatcccactactgggtatctacccagaggaaaagaagtcattatatgaaaaagatacttgcacacacatttttacagcaacagtatttgcaattgcaacaatatggaaccagcctaaaagtccatcaaccaatgagtggataaagagaatgtggtatatatacaccatggaatactactcgtcataaaaagaatgaaataatggcattggcagcaacctggatggagttggagactattattctaagtaaaataactcagcaatggaaaaccaaatattgtatgttctcacttgtaagtgggagctaatctatgaagacataaaagcataacaatgatataatggactttggggacttggcggggaagggatggggtgagggataaaagactacgtattgggtacagtgtacactgctcaggtgatgggtgcaccaaaatctcagaaatcaccactaaagaactttatgtaaccaaaaaccacctgtaccccccaaaatactgaaatgaaataaaaatttaaacattgtgctttctcagaaaaaaaatgacaagacgctgtaaaaatttttaattattttataaaatagatacatacgtgcatgtgtatttcttttcaaatctttccaaaatataattttattgaagaatagtatatcaataaataagttacagcatgctacttttctgctcaaaatcctccaatgccaacagttgcttgttttcctttgactacaagccagatctcttactatgacacagcagactgctggtcatgctcgtcccatgcccaaccatttctaactcccgcttcttcctattcttccttctgtcactcagtggactctttgtatacctgaatgatgccgggaaaattccagaattagaacatttgcatttgtatttcttctgtctggaatattttccccaggcattcacatggcttgctggataactaccttacacattcaaatgttattttctcagtgaagccttttgcagcttttgctgtatttgaaaaggcaatccccattcacagggtctatacttcccttccttgatgtagcttttctcccagccattatcactggcaaactatatatatatatatatgtttaattttaattattttgcttacgatctgtttttccgccactagaatggaagaatataagctccaaaactttttttttttaatcgaatttttaaaactaactttgagacagggtcttgctgtgttgcccaggctgatcttgaattcgtgggttcaagtgatcctcctatctcggcttcccaaagtgctgggattacaggcatgagccaccacaccctgcccaagctccaaaaatgtataaatgcttattgcactgtggtttccttagatacattccctagatctgtatctgtcatatcgtaagcactcaataatatttgttgaatgcatgggtgtgttacaaaacaaacatataacagataatgcataggggtttgatagagaaatgtttgtggtgagaggggcagaagtagagtttagggctgagaagtcactaggaacaaatcagtagagactcttcaatctcagcaaataggtaatatttttaaagttaatgaagttgtgtaagatagagactgtaaatgggtgaccatttggttttatttgcttaaattaatgcttgcctttatgaccattatattgaaaagacgtttatgaccctttaaagaagacatcaggtttgaaggctattccatcatgagtcaaagaaagatttggagtactactgcaggacaaggctcttgatagagatttgtgagaaaaaaaataaaaaatggaagcagtgtcagacactagaaagttttatgccagaggctgactgtaacagaaaagatcaaaaccaatctaatttaattaatgtatctttaattaggtgaaggtaaatctgcaggtctggacacaaatgacaaacagtttatcatcagaatcatgtcagaaagtgacagaattactaaaatatgatgtggcttctttgcttatcagaagaactaaaggaaggcagttacaaagaggctaaaggtaaaactggaatatatttattctacagaaaatatattaccatgggggacactgtaactgaacttttctgattgattcaagaagagcaaactggaaagtgctctagcagagagggatgttgttatagatgaaaggggtttagagcctagaagatgaagtcacttgtctagagtctcacaggatagtcctgaccaagccagaactgggaccaaaatgactttaaactgttcctagattgagtagcttggatctatttaacttttacttttttatttttttattttcctttaagttcttggatacatgtgcagaacgtgcaggtttgttacatagatatacatgtgccatggtggtttgccgcacctatcaacctgtcatctaggttctaagccctgcatgcatcaggtatttgtcctaatgctctccctcccatttaccctgcaccccccaacaagccctggtgtgtgatattctcctttctgtgtccatgtgttctcatttttcaactcccactcatgagtgagaacattaactttcgttaattcctctttctactcaactaatatttctgaagccctactatgtgccaattattgtgcaatctctgctttcttaacttttaatgtggggggacagactttaaaaaaataaaatgtgtgcaagtaaaggggagatgaatgctagggagaaaattaaagcaggaagaggaggcagagagcagctgtagaataggaaaggaaaggctggcactggaagagaagaaggagtgggtcctgagggtgccgaggaaagacaaaggaagcagcaggtgcagaggcactaaggagggaccctgctgatgtgtttgaggaatgaaaggtccatatggctggtgccaaaggagcaaggagggaggattgacatgtgagggcatagaggcggggaggagccaggtcacggagggacttcagctgttttaaggacttgacttctactggaacaagacccgctgccattgaaggctttgagcagagtatcagaatctcacttatatttgaaaaacctcaccctgactcccgtgttgagtgtagatgtgaggaggcaagggtggaaagcagcagactggttaggaatcaggatggctttaaccctagtagtggtggtgggttggcaggaggcgtgttcaaattttggaaatacactgaaggtagagcagagaggattcatgggcaggcttgatgatgaatgcagaagaaagagaggcattaatggtgactcctgggttttgtcttgagcacctgaaagaatggagttgccatgtaccaaaataagaccaaatgaggaggaagttcaataagtctcttttaatctacagcacgctctctcttgcgctctgtctctctctcaccacttctttcctctctacccacttcctttgcaatttatcagttgataaaactatattggtctatagagtttcccacgggcagggatttcatggagtatttccctgtgtgctatttaatatgttcctctctcccttataaattctggaaatccagaatttaggtctatagacttggtcaaattcatgcttgatttttatcaatagtacattacgtgtaacattgattgtgtattttcatccaaaggtgcatcatgtgtggtttcacttgtggttatattagcagccattgataatcattgcttagatcctactaaatttgtcagaagttaggaaatcatgatactctaatcccaccatttagtcttcttttatgagctgaaatatctccataaagacaatatttggtttcattaaggttcctataacaaagaaaggccaaaggcttgattcttctctttattcgccaatattcaaaataatgagttggttacctagcatcttccaaaattaaacatttttaacaattttaataaaattaaggatttaaatatatttgatatgcctcaatccattgcagaatattcttgttgatgttcagattggcccatctttggccctgggtgtttttgaactgccctcagtctctaattgcttctttttttctactgggatatgttcctggctcatctttcatcttgcacatttccagccgtagaagccatcatttctccagggatcctagttttatcttagaggaaatggtatttagtgatcacagtctggtgcacgaggtcagtccttgtgtaggagctttttcagtgcacagaggcaagacatatgccacatttaaaattagataacattatcttaggttcttagagatgcttctaactaaaatttaaaagtatatggagcttttatttaaccttatctattttatatctgcttcttttctcgcagtgaaattttcagggtcaaaatcaccaagataattagtcacttgctttattccacatgtacagaacatttcaatagcagagaatgcaatgtctaattttgcctaaaaggtcagtgtgaagagaacatttgttgacaagatgaggatacatattctgatgagagcaaacaccatgtaggaagactcagaggcttgaaagagagcatagttcatttaggaaagagaaaatcctgttccaccagaggaatgatggatgacaaagtcagcaagaagttgggacataatgagcctgatattcaatgctgcagatgttagagcaccaacaagatacaaaagctttttttttttttctttttttgccttgctttcaggaggtatcttgcatttgttttcaataaaaatattactttcctactttgtcctcataagcagaacttagggatgagcaaagagcagggggttttaaggattgctctccttaacactgttctacaccagctcagtaaaaagaccatttaagtgtggctcaattattttctgacatttggagaagcatttgcatactaatgatccagggtcctggttgtttttctccccacagaggacaaagtgtggaccatagtgtctcatgacttgcagatgcagacgcctgtggtcggctacaacccagaaaaatactcagtgacacagctcgtttacagcgcctccatggaccagataagtgccatcactgacagtgccgagtactgcgagcagtatgtctcctatttctgcaagatgtcaagattgttgaacaccccaggtaggctgagaatggaatgttacttttaatcactatctcagctggtgcttagaattgcctaaagaatccaacaggtgtggttcattatcttatagtctagtcttcagtaggaaggaagctgtaaataagtaaaataaaatcattgggcttgttttctggggaatgaagctaagaaagaatgattttgaggaaaaaatagtccattgttttaaacttacggatttttaaattgtatgtgcatatatgtttctagtgcttaactgtcagtagtggctgtgggacaaagtttatcagagctccttgtgaacattcaagcaattccctttgagagcttcaggtgtctttattgtaaagatgaaagcattctaaaaattgtctacagccaaataggatatagaatagcgatagaatttagagctctttcttcccagtagttgcttcacagtacctgtttgtctcaagaagtctagcctgattttttgttttcatgatggccaacttttagcatgtgctagtgtgtgtgtgagtgtgcacatgcaaacacacatacatgtgtgcaagactgtgtccgggtgtagagaacagagagattccaaaagatatactggaaataactttactgcaacaagttccatatgctctgggagtcttggcagtaaattcgagatgttgtcagaaaactgcatctctgtgtctgtagtaaaacacagtggaaataagtcaaagaaacatgagctcataatttccaaccttaccacttcccaagtatgtgactttggtggagtgagttgacctctttttaaaattttaccttaattgacaaaattgtatatgtctttcgtgtacaatatgatatgatatatatatatatatagtgcaatggctaaatcaaactaacatatgccttgcctcatacatttattattttttgtgaagcaaatacttaaaatccatgcttagcagttttcgagatataataaatacattgctattaaccgtagtcaccatgttatacaatagaccttttgatattaagcctcagtttccagcgactttttctgtcaaggagaaattataatgcctacttcagggtgattgggagaatttcataaggtaatatactaggtacttataagacttgatacacttaaggacatgataagtagcaagtagtatattgattttttaaaatcatgttaagcaactttgtgctatgtcagagaccaatgggctgttggatgccccaaaacagcaatgaattgaaagcaatgttgtagggagcagtttacagagaagagttataagcaaacagtgataaggctccgatgactgaaggaacaccaaggttcttaatctcacgcagaactggataaaacgacatggacatacgtggagtggttttaaggagaggagagtttaacaggcaagaaagaaggaaggaggaaaaaaacagctccctcatacagagacagagagaggaagggattccaatgagagaaaaccctgtgtgtggtggtaaagtggctgcttatatgaggaggctggaggaggtggtacctgacttgcatagggctcagggaattggtttgaccgggcacgttattcacgtagcccagggggaaaactggccctcccaccctagccttttaatatgcaaaggcagggcgccatgatgctctacccacatggagatatgtgggggcggccatgttgccaggcacatgtgagggcaaggaagaacagggcaggaatcgccatgtttgggtggacccagtttctaatggccggtatttgcacatcaaagcttgccggcctggctctaagagcgggggctttcctgctagacaagaaacattttggagctgctttaaaagaccccttttcccctctatgtgtctaaaataatttcttaataatttcttaataacttctataacgatagtacacaatattgtgaaaatgtgagtgctttctatgtgcaaagccttgtgctagaattatagacagagtaccctctaagaaataaggttggaaaggagggtgggagtaaactgggaaggaaagtaaatgctgtgctgtggagttgggacttcatccagagggccagtacttctcagactttagtgggcattacaatacctggtgagataataaaacctgctttgctgggctccatttcctgagtttctgattcagtaggtctcaggtggtgcttgagaatttgcatttataatgagtgctatggactgaattatgttcccccaaattcctgtgttaaacccctaacacccaatgtgactatatttggagatttggctttcagtaagtaattaagattaaatgaggtagatcataatggtggggtcctagtccaataggattggtggcctcaggagaagaaacagagctctgtcatgtgagggcatagcaaaaaggcagccacctgtaagccaggaagagagccctcaccagaaacagaatcagccaaaaccttgatctttcacttcccagcctccagaactgtgagaaaataaatttctgtcattgaagccactcaatctatggtattttgttatggaagcctgagcagatgaatacaatggggttccaagtgatgctgatattcctgctctagagaccatgctgagaaccagcacaactcttttttctgttcactttcacttatcataggtgtgtgtgtgtgcgtgtgtgtgtgtgtgtgtgttttaactggattctgtttccagtgccaggaaaagtcaaagactgtatgtagaagaccaagggcaataagagccactaatgaacctcatcagcttgtcttcactgtttcatgagcggctgctccttattgaagcccttttcacagattccagttaattagtcttcagtcctggggtaggggtggaggtggggacaaattcctgaccagcaaaagaaccttggtactctcagctttatgttctttattttctttctttcttgtattaaactccaaagtcagctttcagtttttgaattttgctctggtaattaaaaaacacagtatggcttccaaatatgttcaacttacggttgaggtaccaggagaattagactagaggtgggaaaatagttcacctttagtgctcctggtcttgcagttcagcatctttctttccccctcattgacattccttgtctcttcccctcggccaccgtgaagcctcacacacataaccactctcctttacaaaacataaaatgtacaaaacatcaggaaaaatgggataaacttgttattaagcactctgttagttgcatttcctaataatgagatgaagacatttttctttaacctctagatacccctttcacgagaaaaactgctaaattgaaatcaagagtaaacttttaatctgaacagtaaatatatcactttctttgtatttctagacatctagacactgggtttcccatcatttgtagattattattgtacataataaataatacttcaaaaatcagtttctcataagcttcttgcctgtttggacattctatatatatatcaaatctttggttcacataggatttgtacttaacaaatgtttgctgattcaaatgaaatgaataatatatagctttaagtgttacctcacccaaccttggggcagtggtttaagcaggagtgtgcatcaaaatttttaggttgcttgtcaaaatgtggattgaatggccttactcccaggctttgatagagcttggttggggcctcagaatatttgcttttaacaaacacccatgggtaattctgtgaatcacacattgagaaacactgtctttaatttatggcatgaaggtttctcatgttggaatttaaggtgttagtccttcatgtgggagaagattaaagggaatattagggcttgtctgacccattgaaataaaatggcatacatagttacctccttcagctaaaataaattggcataataaaaattttaaatccttctgatataccagtctctaaatatcgtaaagtgaatttcagcttacccttctgagtcattttttacactcccaattttcattttccaggcctactaatctgcagaatagctgacgcaaggaaaaggagtggttgagacagcaagttccttgtattgttatattttgcatatgtcaaaacaagaaagaacacaatttaataaaaatctttaatttgtgttttaaagaagctaatgtttactgtaattgatttttttttcctccttcatggtaacattcaattttaaatatccatttacttattcttaactaagactgaaattatattagaacttctgtagtagtacttgtgacatctgttcaaatacaaagtatattcattatagtgattgcaattaaaatgaatatcaaatgagtttgtaatagctttgcgcttaaaatgttattttttattttaagagctttacgctcaagagttcatttggggctctatagtttctaatgatacttatgataaagagttgatattcatatggacctcatttttattttgataaatattcttttataccataccattagctagtaaatgtaaaattacccattattagtatcttccaatttttacaaggatagtaatacatgccttgtaatgtgctctcttttattactacaaaacttaaaaatggaaacaaattaaaaataatgattttgccagtatttatggtcatgtccattctcgcaatgtaactgttacttcagttgtcctcagctttacaaaatacacagaaatggaaaaataaaaagttattttattttacgtagaaaagcctgcttagaatgaggcataccaatttgggaatcaccaaattagttctacccaaacagagaaaaatcattaatggtcatccaaatggatgtctacatgatttatatttatatccccggatttgtaaatgtaatattaccttaacttatgaagggctaaattagtgaacagtgaaatctacttctcaaataagtaccataagaacttgaatttggccgggtggggtggttcaggcctgtaatcccagcactttgggaggccaaggcaggtggatcacttgaagtcaggagttcaagaccagcctggccaacatggtgaaaacccgtctctactaaaaatacagaaaattagctgggtgtggtggcatgcacctgtaatcccagctacttgagaggctgacacaggaaaatcacttgaactcgggaggcagaggttgcagtgagctggtatcatgccactgcactccaacctgggcgatagagcgagactctgtcgcaaaacaaacaaacaaaacaaaacaaatcttgaattagataaatcaagcactgagggagttcccttagagcctacttgagtagtcttagtcaacaatactaatacttttagataaccaaaatgtttctctgtatttggacaagaactattatgctgccattaaaatgtttatttgtgtatcttacatacattgtagtcatatatttattttacaaatcatattacactttctagttaagaatttttttgctgaagtattgattccttacatatatatttatttaattgtagagataaaaagttatcttccctatttttctggctatatttagccctgttttgttggtttccagtgtttttcctcttttaatttttcagtgttggctagttttcatgaatgatactttttactgcttcttttgttgaaagaagcaatataaattatatatatttttggatagtttactattagattttgtatctattgaaattgaattatgcttacaatttttgcctataaagtaagctgtgtaaaattcagcatactttatgatactaaactgtgatttagtggctttgaaaagacaagaaaacatgactctggcattgtaacatataatctatttttagcaagaaattctaaactttggtgcggctatcaagcaaatgaatttcaagttatgctgtgcattataagaagctgcagcatttaactcttaagacgacatggataaatcaattccaataaaagatttttcagtaaataaaatttattgtgactaatcagtgtattaatcagaagattatttacttaattattatacccactcattgtattaaaattgggtgatataattaaatgagacaagcaacgaggatagtaataactaaagggtaaaattagaaaattgtatcgagtaatgtttcatactcagacaactagcatctgcatgatgggcactgtaattgaaggggacagagggattgcagggagaagagtaagcaactatttcaacaatatggataggagttgatgagaacctcaactggaataatgagtaggagaataagtcaacaaatattttttagttttgcctgtgtatcaggaagtgtgacatataagctgatatgggaaagattcatatgagttaactaagaaaaaaatgagagaaggattctgggttagcgatgtcagcatattcaatgattcagagatggagatcaagagacactaatttgaaggaagtgagaggcgtcagaatggctggagtagtgaacttgaaggtgggagaggcagaaaaatggaaaccggaaattaattcagagtctctacctaatgttgaggattttatttgaatggcaaacagaatgatttcaagtagggaagttctggctgttccatggatactggagtggaggaagcagaggtggtgggaagagtctgtccgcaccagagtgcacatggactgcatgtctgggaggccagctgggacttgagagaaagtttgttgttgttgttgttgctgttattgtttttaagtttagatgctggaatcaacaggagttgtgattacttatatatacaggaggaagaaaattcaagggtgactcaagtttctgacttgaaaaactggccaacagttctaaggcttaccttgtttattaagaaaaaactggagaattggtggtcacttagctttaacatgcaaagtgatggcactaggaatacaggtttttatgtgatctgtgatggctgatggcatagtgtaaaatccttttaactgacatcaaaagattaatgaattaaattttttcttccttgaaattttcttaaacatactctacaactaaaataaaatggaagaactaagagtatcatcagaatcctaatgttttccattcttgtatttatattgaaagatcagaaaacatatagtcaagactgacctatctcaattatgtaccaattttttttttcctcatgcaaagcctcctgtattgcttcagcttcctgggctgccttggtttcatggcacctgcatgatgtctgaagcaagggaggagcaggctgcaaacctaagcgcagacaattaaatactcctgcaaggaagtaacacgttgtgtgtgtgtacattttatggaccaaagcaagtcacatgttttgctgggcctaactttagaagaggacaaagtacaatcttcccatgtactcaggagcaaagatcacgtggacttattgaatagttgtaatgccttcttaagatgactcagagaggtaatgggaggagaaagaaaagaacgcagaagaaaagaaaaatactaattttgtttatttgtttgtggatggaatgttattatgttcactttttttttttttttgagacggaatctcactctgtcaccaggctggagtgcagtggcatgatctaggctcactgcaacctcagcctcctgggttcaagtgattcgtgattctcctgcctcagcctcctgagtagctgggactacaggcgcatgctgccacgcccagctaattttttttcttttttttttgtattttagtagagacagggtttcaccatgttgcccagactggtctagaactcctgagctcaggcaatctgcccgccttggcctcccaaagtgttaggattacaggcgtgagccaccgcgcccggccagttcacttttttttttttaacgagggtcagagataaagagagactccactcaaaggccaatttcaatgtaagaggacacccttcttttacagattaactggtaagcaaaaaaataaaataaaaaataaaaatactggtactacaattatttgcttccttatgaaactttctacaattcttacccacggtgatcaccattttttctgaatttctgtttcacttagggcctaacctctatcacttagcagttgattatgggctattcatggcttttcttgctcttcattgttttctggtgttttaatgggctctttcttacaataacacaaggtctttgaggacaggggccatatcttagtatcttccatcatgcccagcttctagacatctacctagatagtgaataaattagaaaaacactaattttaaaaggggactaaagaagaggatgcagctagctaaaggaactgaaaagttattaaacagtaggaagaaagaatcagattaggaaagtcctataattgggaagctaagggagatgggtatttaacaataaacaggcaagcaagtaaaaaaataagcaaaagcaagaaaattgaggtatggtgaatggtgagacatcctagagaggaagccatcccctgtcattatctgttgggaggctgctggagtttcatgtcagtggagtttggtggattgagccactgaagactgcatggggaaaggaaagagcaggggtaagttttcaaaaggttgatggtacgaggatggctacatgtagaaaagctgcttaatcagatgacaaagcaagagtaggggtttaaaaatgtttgatatttttagggatgaggagttgtaagtaaatttataaactgagaaggagacattggagaggttcagattaaagatgtaagacagaaaaggaataataggtcccaggagagaaagaagagtgtagaatttgctttggtaaagaacaaggacacctgtttcaagaagggagctaaagacaagggcagaagttctcattaaatgtcttgaacaataccattctagacatttatctcatttaactctcaaagttacgcaaagtagattttattatctctgttttgcaaaataggactcagaggaataaacttactgaaggctaccatattagttcattttcacgctgctgataaagacatacctgagactgggcaatttacaaaagaaagagttttaatggactcacagttccacatggctgaggaggcctcacaatcatgatggaaagtgaaagacatgtctcacatggcggcagacaagagagcttgctcagagaaactcgcctttataaaaccatcagatcttgtgagacttattcactatcatgagagtagcacaggaaagacctgcccccgtgattcaattacctcccaccaggtccctcccacaacacgtgggaattgtgggagctacagttcaagatgagatttgggtgtggacacagccaaaccatatcagccatcattgctggaagtggaaaaactgagtttcaaatgtatatctatcctattaaaaacctttctgacacactgaagaaactgtgaacatggagaagtcaatgcttggccaccaaagtgagtatagaactaatcccggcaggaattgtacccaccctcatctcttcaaccactatgaaagaacgttttccctcttgtcattttcttttttgtgtgcatgattagaaatgctatttaccaagtgacctttggtcagttccagtatttctgattaataaattaatcttaaggtaaattttattaagggtagctcgagttgtactaaaagggtactgctagtgcctttcaagtggcagacttgagctttgaggtgagactttgattttgtatgtagcttagtctttaaaataacaaatataaggatgaaatggaaactctgtgaggttatccagtcactctgtagagcttgaaaatctgccttctcatgtctttctgtttaaggtagactctaaccttttgattctgaaaagccatgttcaaataaatacttattctagtatagaataatcataaagcaaagtgaaaatgcaaagactgcatgagaattatgggtttcatgtttatttctccttgtagttatctggctatatgttttcttaagttttcagacgggataccacactgctgttaatcttttttaaacaaagattatatattaaaatgagagcaacttagaaattacaccaaagctgaattttctttgaagatgatcacatcttaatgaacggatttgtcctaatttatgagaagtatgagtttatagagttgcatttaaactaaacttcaatatattaaaagaccataaagccaagtttttaaaatttgcattttagtttattatattataaaagattgtaaaaatgaagaaacggctattatccaattcaaaaaattaaaaaactacttttggactatttttcaaaattccatactacttactctgccattctgaataaaaaaagggataatcataaaaagtcttctaaaaagattggatagataaaaaaaaatgtactttaaactttgtgaaggataaaataatgtaacaaaatttaaggagaaaatttttaaaaagtactgacaattttattatttatctttatgaatattactctctagtttttgcttccatctgtacatactttcacagaaacaaaactggaatgaagttaatctgatagtcttttctactgacattaaatcgtaattttttccagttcatatattttccttaaaattatccactttaattacatcgtaaaatgaagataaacttaattcatcacctgataaacctaatcgtaaattatttttgaaaatacctcccctaaacaagatactgaaaaaaagcatcagagttttacaataaacttctcttggaaatacctaaagtattactaagatattgctcagttattcattctgcaaacatttattgagtataaaatatttagctgggtgctatgagaatacaatgagggtaaaaataatacagttgacccttcaacaacatgagtttaaactgtgagggtctgcttacatgtggatttcttctgtctctaccacctctgagacagcaagaccaacccctcctcttcctcctcctcctcagcctactcaacatgaagatatgaggatgaagacttttataatgacccacttatgcttcatgattagtaaacgtatgttctcttccttttaattttcttaataacattttcttttctctagcttactttattgtaaggatacagaatataatatatataacatataaaatgtgtgttaattggctgtttatgttatctgtaaggtttctagtcaacagtaggctattggtagttaagtttgtggggagtcaaagatgtaggtcaatttttactgcacagggggttggtgccccaacccctgagttgtttactggacttttaaatagcatttgccttaaaatatagagtgaaattttttttatgatgacaataaaatcattttgtataagacttataaatactgaaaaaatcttaactagtatgtccatcatggataaaagactgaataaatttagaattcataatgacttccaaacattttgatatgtgtattttgcattaggtaattctgcctcccctgtttgaagaggttatatttggaggaaagatgaggaaggcttaggaatgggagaaaatagggtctcagagtactattagctgggatatcagttcaggttcaaccggagaaacagaacaagtagaagatatatttagagatttattgcaaggaattggcttatgcaacagcggggcctggcaaggcaagtcggaagctggggcacactatcaggaaggaaaggctggaactgccagacacaaactgaagctgatgtccacaggaggtagttcttcttcaaggaagtctcagctctattcttaaggcctttcaactgattgaatcaggcccatccagattatctagaatatgctcttttacttaaactgtaattacatttacaaaatgcctatgcagcaacacctggaagagtgtttttttgaataactggaccccgtagctaagttgacagataaaaccgaccatcacagtcaacaaagatgacttttaatatgaactactgataaatctatttctagaatagcaatgatttattccctcatttgtatcacatatgcctctctaggtcagcatagtcaggtgagatccacctattacaggtatggagggatcttccattgtcctatcttttcatttctaatgaagatacagtttggttgagtgtcaaattgccaaacaaagttagaacaatggcaatttgagagaatcaagtagatcaactcagggagataagtcaaaagacaaagactccttttctctgtgttgtttcagaaaagttggctcagaaaagatggcttcattccacattttaatgaatatggcatgtgtccattaactcctcattctcttatctaaagggaagcacctccattgagccaaatacaaacatcctctttctacaaccttcggaaagctgcaatgtagccctatcttgccatcaacattcctctgcaatgttttctaacttacagttgaatcaagttccactaccatgcatcataaaggtaatgttaaagatgctcagagaaatacggttgaagaaactcatccttacagaagcacctatgaataaaataatccataaattttatttcagagactgtatctttcccgagctagtattttcccaccaatgaatgataagacttctctgaaatactagtaacactgatggaagttggattctattacctattgtttgcttacaatttaccaacaccagtggctgggtaaatagtttttataggacaatgaataatgttgcagagtgttagctgactaggaatgccacagccattatgaccttcatcccgtatcttaaaatctctataaaaacatgctcaggtattttttctctcttggtattggacctgaaattcaggcttaaaaatatattgtcatctatatatctagataactaatgcttaataattatctccaaattagatcatgatataaatgaagggagaggaaatagcagtagtatttattaaaggttcacctgggcattttatatatattggctcattccgccccaaatctctgtgagttgtatatcggaatttctattttatatctgaggaaacataactttagaagggttaattaattcacccaaggaaaaacagtaaataccgtgctgagagtccaaaccaagattaaaatctaggtttatgtacctctagactctatatattttctacctcaagaagttagaaaggaaggaaggggggaagaaaggaaagagaaagaaaggaagggagggaaaggaaggaagaaagagaatgaggcaacctaataagttaatcagttggggaatttttaatttcttatattgaaacattaatatgggcttccagcatagttaaagacccaaactttatttttttgttgttttgttaagtagtaggccaaaagagacatttataagagctgcacaaacttctttctgaaaaatcctacctttttatgttttttcaatatccactattggccctgacaagtatattaaaaaatatggtttatataacaatttgtttgaaatgatattgaaaaacatttgatgtgaaagaaacgaaaaaaacatgcctctctctacagagcatttgactttcatgtttttaatatcaaggtatttcaaatagaacatatgaattgtatattgattaaatagaaaaatgctgtaaaaggttatccccttcttttcagacataagatatggaaacgaaatgttgatgttttctttctttcttcttcttcttctttttttgatcttttcagaagaaactcttatgtctaagcctaacacaagtgacacatccagtgtttcattcttaccttataaatttgcttttgatagagttctccgagatcctgttaaaacgagaaagatcagaaatcaccagcttggcagagcccggtgggcagcacctggggggatgaacagcaggacactgatacagacatgaaattcaactatcagagatattgagacttactccattagggtagggacttgcttcctgtcaaaaacaaacaaacaaaaatatgaaatcaccctcagttcgattttgtaagtaggagggagagcagactagaggaagaggcactaggggaggaaccacgctgaggagcagaaaggagggcactgggtgtataagcagaggggagggaggtcctgcgcaggaaggcaaggccctggtggacagcaacagcaactagaacaaacagtccactctgcaggtctgttcagccagcctgttggctatatttagtatttcataaattttataaactcatgttactttagttggctcaaatgttaaaatcaattaatctttctctttagaaggcagatatttaagcctacctagaaaccaaacatattttattttgtttttatttcaaaatctcaaaatggtgaggtaatcaaggcagcaaaattaagaggatcaacattatgagacgttgaagtataccaaaagaagcttaatatgtaaacgaggacaaacaggtttctgctccattaatcacagttataaatttgcataaagagaactgggagaacaatttataaggttctaatgtaaatataagaaatcttaatgaaatggtatcaaccaaagccgagaaaaagtgtgtacctcctaaatgctggttatgctacataggtctcttagattttcacaaatgacttgaattttggaataactagacaaatgttctccaaactaataaaagatggccaaaaggtagattaatatagtaaaaaattataatatacttttttggcatcggaatgttctaaaataattgtttaaatataggtgttagcaatatccaaaaatatattctaaacctgatgacgaaggtataagataatcaatggcaatgatttgtctcctccttctatccctgagcaatttcttattctttttccttccagtctgggaataaaccactttctttgtttagccataagaaacaactcatccattaaagttttatcatgagattgcagcaattcagttacatcttcagactccatttctaatgctaattcttttgttatttctattacattcgcagtgacttgctccactgaagttttgaacctctcaaactcactcatgatgtttggaatcaacttctttcaaactccttttattgctaatatgttgatttcctcccatgaatgtttttaatggcttctaggatggcaaatccttaccaggaggttttcaatgtagtttactcagatccatcaaagaaatcactatccatggcagctatagcctagcaaaatatatttctttttttttttttttttttttttgagactgagtctcactctgtcgcccaggctggagtgcagtggtgtgatcttggctcactgctgcaacctccacctcccaggatcaagcaattctcctgcctcagcctcccaaatagctgggattacaggtgcccgtcaccatgcccggctaatttttgtatttttagtagagacagggtttcaccatgttggccaggctgatctcttctgacctcaggtgatccacccgcctgggcctcccaaagtgctgggattacagacgtgagctaccatgcctggcccatatttctttttcttttttcttttttcaaggcagagtctcactctgtcacccaggctggagtgcagtggcacaatcttggctcactgcatcctccgcctcctggattcaagcaattctcctgcctcagcctcctgagtagctgggattacagacacatgccaccacgcttagctaatgtttgtatttttattagagatggggttttatcgtgtttgccatgctggtctcgaactcctgacctcaggtgatccgcccatcttggcctcccaaagtgctgggattacaggcgtgagccaccgcgcccagcctattttttaaataatataacttgaaagtcaaaattactcctttgtccatgggcaatagaattcatgttgtattagcaggcatgaaaaaacattaatcttgttcatctccatgagggctcttgcctaaccaggtgcattgtcaatgagcagtaatattttgaaaggaatatttattattttttctgggcagtaactctcaatgggcttaaagtattcagtaaacctgttaaagttgtaaacagatgtgctgtcctccaagctttgttgttccatttctagagcacaggcagtgtagagttaacagaactcttaaggatcctaggatttttgcaaaagtaaatgagcactggcttcatcttcaagtaacctgctgcattagcccctaataaggggctgtcctttgaaggtttgaagccaagcgttcacttttcctctttagctgtgagtgtcctagatggcatcctcttccaatagaaagatgtttcatctagattgaaaatctgttgtttagtgtagccaccttcatcaattaccttagctggaacttctaggtaacttgctgtagcttctatatcagcatttgctgtttcactttgcactctcacattacgaagaaggcttctttcctaaatctcatgaaccaacctctggtagcttcaaatttttcttctgcagacttctcacctttctgagccttcatataactgaagagagttagggccttgctctggattaggctatggcttaagggaatgttgtggttggttctatgcagaccactaaaactttctccatatcagcaataaagctgtttcacttttctatctttcatctgttcactggagtagcactttcaattgcctttgagaatcttttctttgcattcacaactttgctagctgtttggcgcaagagggttagcttccagcctatcttggctttcgacatgtcttcctcactaagcttaatgatgtctagcttttgatttaaattgagcgatgtgtgactttctttcactcgaatacttagaggccatcttatggttatgaacagggctaatttcaatattattttgtctcaaggaataagaaggcctgaggagaaggcaaaagatgagggatcagctggtcagtagagcagtcagaactcacataattatcaattaagtttgtcatcttctatgggcacagttaatggcactccaaaacaatgacaatagtaacgtcaaagatcactgatcacagatcaccataacagatgtaataataatgaaaaattttaaattttgaaagaattaccagagtgtgacagagagacacaaagtgagagcatgccattgaaaaaacaaacaacaacaaaaaaacccgatgccaatagatttactcgaagcagggttgccacaagccttcaatttataataaagcatatgatctgtgaagcacaatgaaatgagaatgcctgtgtatatctgaagtcacccaatggaggatgtatcagtgcctatgtctctgtgtgggaacataacatgatgtgtctgtgtgtgtggtttaaatatataaataacacacacacactcacaaacacacactcgtggtttcaaaaagaaactactcaagcacaattcttctactcaaaatgtccctgaagtgagacatttagctctgatgaacttctatactatgtggggcagacttcttgaaaataacaatacacagagcttatttgaaaagcaaacaaatcagattacttatatgctataggtgtttgctattaaatttgaaaataacatatgtggggagaataatcaggctgtaggtaactaaaagttgactgtcatcactaaattaactacaagtgaatccaagattaaaagtgacagaggcagaaaaaaataaaaatgaagtgtaatgtcatacagctgaaaccagagtaatttaccaagagcagatacaaattcaatgggaggggttggcttcggtgaaatatgggagataaagatctaaggtaacatagactaaatgtaaattttaaaaaatgatctgaggtgagaatgttgtggaaatatgtaaccaatatttttaagaactgtttttttccatcaattcaacattgctgttatcctgtttctagtttcaccttaatatagaaacaaagcaattccagtaagatatataaaatatgtgcaggcatgattcagaggaatagaaaaaagaatgaataatttgaggaggaaaaatataattggggttatatatgtaggataaaggtatataaaacaagcccttaaaaataatgttaactgccttgaaaatgttatttttaatgagaaagtagattaatgaagacattggccttcacttgtattagaaaggatttagcagagattttatctgaagcaacttcttagcatagtgtaaatgaaatatttgcctgagtatcgggtttagaagtttcactgaaaggaaaagaaacttgacttgctgcctcaaattctagtagctgaaattatatgaggtgaagtttccaacgctgtctcttaagatagccgacctggccgggcgcggtggctcacgcctgtaatcccagcactttgggaggccgaggcgggcggatcacgaggtcaggagatcgagaccatcccggcaaaaatggtgaaaccccgtctctactaaaaaatacaaaaaattagccgggcgtagtggcgggcgcctgtggtcccagctacttgggaggctgaggcaggagaatggcgtgaacccgggaggcggagcttgcagtgagccgagatcccgccactgcactccagcctgggagacagagcgagactccgtcccaaaaaaaaaaaaaaaaaaagatagccgaccttaccttaatgaattttccacaaacctaagtcagattctttgggcaaaacttgacttatccacagactctagttcaatcacaagcataatcacagtctgtgagactgaaatccataatcaaaatgccattaaattaacttaaaacaagaagactaactgctaaagggagaggagggtctggccaccacactgtgtgggtaaggtatatggagagccaaattgtaaactaggatgccagtgtattaatttgtaatgaaaaagtgtattgctgaaaggactggacacttctgttctctaccccgccaaatctccccctgcagggctaccagatgggaagccaaattaaaatcagatgcttgcttcttgggcttggaattggaacaagaggagtaaatgataggattgcaagttcagggtaacaggtcatctttggactgtggagccctttctcctaggctgccgatggctatgcacaaacttgatcttgtttactgtgctttcccctccagcttcccactgaccctttgttttttctatagttctgttaatgtactcaatcaggctacagtggggtcttgctggcctgggagctatttagttctctttgtggtaattttgttcccatctttccactgagtgttgatattttagtttaactcacaaggcacaatcttatttttggaactcttcagggaggcccccctcaacccagcactgacgatgtaagacaacagagatgattgcttaaatgttttccaatcctacatctctgtggcaaaaagttttttaacactatattatggcacacagataactgaatttcctttccaaagagtagaaaagacaaaggaaaggaaaatctgggtggactcagaagatgtggcctctataaaactaaatcctcaatcttttctcatttctaagaaggggaaaaatgatgatgattgagatgttggaattcattgtcaggaaacttgaatttttgctccccatggagatcaaatggaatatgcagatggagtactttatttcttggtagcttttatagatattttgatcattttcttcatattagagatttcaatttgaaattgactgtgaagatatagaaacacatgctcagcagaaacgtcttacgacatattaaaccattttctccctggaaactgttgtgataataaatactaccaacatagaggaaaccactggggtggataaaccttattatctatctgtgcattattgttaaaaatactaaaatcaagccatgtgtgttgcatggagttctactggaaagctatcatgtaataatacaaaggaagataagagagaagaaatacaaatgggagtgactagagagtaatacaattaatttatagccacatatattaaatttgtttaatattgacagtagatttacccctgggaaggagaagaagaaaacagaatagattttattttaaagaactcctgaaaccttaccggatgttgcctaatgaggtgatgtaacataaaacatcactcgatgctgtatttgcatactgcctttttcccctaagagattgttttgaaagaataacaaagaaacagaaatgaggtggaaaacaaaataacaaagcataaatattttctcagtgtttgcaaatattcataataatttcctatcctctgattcattagttctctcaaaagcccacctggatgtcctcagaatgcaaactgatacttaattattacattgggatctagattctttatagctatgccactcgtgtgaaaaatatgcatatctatttaagagctgtgcaaagcagtggtgatgtgagttatgccattttgctcaacacaagacaaactcctaaaaacagctttaatgtagacacaaactgttttgataaataaagctaactcttaacaagattgttcagagaagactgactttttcaatgtattcctttgtacccttttcctttcaatgtagaaccttctcttcctgctgcttcctacaaccttttcctcctacagttttctgagcaactccacttatccatagagaaaaagattttggcactctgattttcagattactcttagcccaaggtctacatatctttcccttcttcctcacccttcccaatttcacaggagacccagtgctcccttgtctcgctttaaattcttccctataataggccagaaagactctgacaccagatgcattggatttgttttctaactaaattttagtataaaaacatttaagtctagtgacatcacctcgtgcgtatggttttgcatttagtacccttcatattccattttgaaattggccattcactcattcattctctgaactggtgcatattgatcatctgctctctttaaggcactaagctaacttctatgagaggttaaaaaataagacctggtcccttaaggccagttaaagacaaggcctattaaagatttaatcttctactaaagacatttcaaacagcctttgcttaaagagaagtaagatggtaggagactggttagcctctgaaatcacattatgcctaatattggccctaaaaatatattttgttgaggtctttgttaagggagatatggggatatggggcagatgaaatcacagcatactcttcctctgtcagaattctcatgcccccctattgcacacccaccaacccaacaaacacacacattaagatataattacttatacccagacttctgtttgcaaggggctgctgtcctgcctatggctattgaaaacctatttctccatgatgtacctatctttcctgggccctttacctataatatgcacttccctcctcttccagtcatgtagtagatataatcctccagttaacccagcccctaacttcagtgttttattttgtctcaaaaatccaaatatttccatcgaatatttggtgtactttttagagaatgccgtgtcatttttttttgtaattcttcttttctaaaattcttgaattttaattttaagcggtgcatttttatttctgaaaatcaaatttggctaatgaagtgtttagcccaatccagtgaagctcagctccctctttgagccacagtctgtgctgtctaacgaaccttcactgaactcatgggtagtacaatttagtagtggtatttcagtagtacctgttgtatgcctcgacaaggctttggagaaaattcctctgttctgatttccaaattcagctcttttctctgctaattgcttcttcttcttcttttttttttttttttagacggagtcttgctctgtcacccaggctggagtgcagtggcatgacctcggctcactacgacccctgcctgctgggttcaagtgagtctcctgccacagcctcctaagtagctgggattacaggtgtgtgccactacgcctggctaatttttgtatttttagtagagacggggtttcaccatgttggtcaggctgttcttgaactcctgacctcgtgatctgcccacctcggcctcccaaagtgctgggattataggcgtgagccacggcgcctggcccattgcttcttgatataagtactagctattctacagcctgcaccatgacgtagccctacctagtagaaactttgagttagattgcagtcatcaaagccatttgcccttcctttgtctctaataaaattaccaaggacctctccttaagtagtctatcatcctaaactctcaggagatacctctgagtcttggttttctttaaggtttgcaagaaaggccaatcactcctttcttagaacatttaataccactttttaacttatttcctataataccaagatggcacacatattaatcaaaaacacaaaccctcccgatctgacataatgtagatgcaacattacacactttgcccagtaagtaccctctccacctcaaggatcctttgccctttacaaaccatgtttcaggttctccatctctatcacagcctgaagggcaatgtcccaatgtattcaggaatcatttagactatgatgggatggcacagtccctacatctgctaccaaatcaaggagctgattaacagtgcattgcagctcttggcaagagttagagtaggaaataaaattaaggtgtaggggttaggcaggaaattcagataaaactacttgggaaatgtagctaagcaagatataattatctaacttataattagactagaacatcaggcctcccatccctaaaggcttctttttgcaaagagacaagtgataccatcaggtagcagatggtattcttgtatgggtgcgagtgagtgatgaacacttcttaccttaagaatttggttgtaggaattattcctactggtgataacttgctagcttaatagttcattatttctgtgtcttccattcctttgggctagtacacttattaaattagaaaggtggggtggtctgcaaaatttcagtgacatctctacaggctagctattggcctctgccatttgatcatctcaaactatctagcaaattaatacaaccaacgaaagccgacagactacattgatttgaatataactccaatttttttattgtatttcttaaaagttctatgacatactttagtttgcagaaaacagaaagttacttagttttagagcgtgattttttttgtctcactggatgtttctggtttgtttgtttgtttgtttgtttgtttttgagaccgagtctcgctctgtcgcccaggctggagtgcagtggcgcgttctcggctcactgcaacctccacttcccgggttcaagtgattctcctgcctcagcctcctgagcagctgggattacaggtgcccacaaccacgcccggctaatttttgtaattttcgtagggacgggtttcaccattttggccaggctggtctccaacccttgacctcgtgatccacccgccttggcctcccaacgtgctgggattacaggcgtaagccaccgtgcccagctgaatgtttctgttttaaagatccttgcatgtggctctgtatgtaaccctgtccttgcaaagttgttagaaaaagataaatgaactcccattggtttaaggaattgactgtgaagagcgtgatgtaatctaaaaatcagaacaccaaaacttgtttcctctttggataagtagaattggtcaaagaacagagtttatgacttctcttcacataaaagatgacattatctatgatgaaagacctagttcttgattttcttcagattccacatggacatcttacttgctaaaagcaacgtggccaaacaatttctgcctgtagcaaattgttttcagttatgtttcctcacgaagtagtatcctgaaattaccagtttgcatactgtttgcaattattactacaaatgcagtttagcttttgtgtaaatgaatgaatttttattgtatatatttaaggtatagaacatgatgttttcatatatacatacatagtgaaataattactgtagtccagcaaattaatatatccaccacctaatatttagcttttaaagccctttaatttctaaatgtggaattggttcatttatttacttatttatccattctataactcattaattctttgtaccaacatttgctgaatatgtactttgtgtaagtcactttgttaagctctctggaaaataaaaacaaagttcaattttctgtgtagtaaaacgtgtttaaccacaagacattaacagagtactaaattaatagaaatttttcatgtcaactagtgcattattttgttatggcttccatcactaagtaccatagactagatggcttaaacagcagatactggttttctctcagttctcccagtgtgactatcaggattctaatcctgtttttgtatttgtattaaaaagtgatagaacgtatagtcaagacggatggattaaattgttcatctcgcccctaagaattaagagtttttgttggtggtggtttgtttgtttcatctctggctgacaggaagagtgaagaagagaacgctgtttcctcgtagccccaaataacatttcacctacttctaaagctgctgtgaggtatgcaaggtcttacataaagagaaaaatctgtctcaaaaatctgcctcaagattgtggagtcttgctctccttgcattcttttggtttttctgccacaattttgagacttatcctaggaattcagttcagcctttttttcgccttcaaaataagcacatttggctgcttattttgcagcagccaaaacgaagcattcggagatgttattgttgttgttcttctctatcggtccagtacagttccttttcttcttttattcctaggaaatctctttgaatctactctgtaaatagaaatggcttcccaccacacagtgaaaaccaaaatccttatcttgactttacagggtctttcatggtctggccctgcctgtatccggcctcctctctcactcttcctcttgctacgtggctagaagcaagaaaacagggaatctaatctagttttatctggctctaaacccactgctcttaatcaatacactgcaatgcccttgtaagttatttacctctctcccatacagtacgtgccaggtggcccatagttctagctcctatctccaacctgaaaccaattattttcacaaagtcacattgattaaagtataatatttacagaggtatgtgtaagagttgtagatgcaaagtttgattgcttttcacaaagtagatgccactgcataaccaaaatccagaccaaatttttacctgtgccccaatgaaccccttataaccctttctgaaacctaccccaccaagtaaccactattctgacttctgaaactataggtgtattttcctgtttatgaagtttaactcttaatttaagagtattagatatactgttttgtgtctagcctgttttgcttaatattaaatttgacagattcacctatgcagaagatagtatagttcattctcattactgtgtatgtgagtatattacaaattgtctcctattttaccgtagatggatatttgggttgcttctagtttggaagaaattcaaatactgccactagaaacattcttgaatatgtcttgtggtgaatatatattcttttccttcctcttatttttaaacttctattttaagtttagggatacaagggcagaggtttgctacataggtaacttgtgccatgggtttgttgtacagattatttcatcaccgaggtatttcatcaccttagtacccattagttatttttcctgatcctctccctcctcccatcctccaccctctgagaggccccagtgtgtgtttccctctgtctgtccatgtgttcacatcatttagctcccacttataagtgagaacatgcagtatttggttttctgttcctgtgttagtttgctaagaataatggcctccagctccattcatgttcctacagaggacatgacctcattcttttgtacggctgcatagtattccatggtgtatatgtaccacattttccttagtcagtctattattgatgggcatttaggttgattccatgtctttgtgtattctaacagtttacatcactatcagcagaggatgagaatattagagttctcattactctgtatgcttctcagcacttaatagtgtatctatatcatttgagccattctcatgagtatgtcataacactacctctttttatagaccttatttttccttaaagtaactaatttattttagctgtaggacgaaagcagaaaactcagacaaaagagaaatattacctttagcaaaacaatcagaaatgagatatcaaaaatcacccgaaatatactacctaaagaagactaataacatttccagcgttagtcggttagacctttcctttgtttgtgctttcaagtacagtcatgtgctgcataacaacatttcggtcaactacaaggcacacgtgtgacggtggtctcaggagactacaatggaactgaaaaattcttaacacctagtgatgtcccagctgtcgtagctgtagcccaccacattactcatgtgtgtgtggtgatgctggtgtaaacaaacccactgtgcttccagtcatataaaagcatatcacatacaattacaagcagtatataatgcttgataatgaaaatcaactatgttactggtttatgtatttactatgctatactttaattgttattttaaggtgtattccttgtacttctttttaggtttgctgtaaaaccgtattcagtgttatgccagcagcagcctcatacatcccatgtttactgtgtctcttgactgtatcatgttcttttgtgcttaatttaattacacattattttattcatcacggtccttaatcatcaaaattcatggctaatgtgtcagaaagaggccctgtcctgtgattgacctgaaagctaaattaaaagtgaataagaggtacaaagatggaaaatcagtaatggttattgctcaccagtcaggtctgtcccattccaccatagccatgatctcaaagaatgagaacaaaatgatggaagctgaaaagatcttcttcattgaaggcaatgagactaacaacagttcaggaagagcctatatcagatatggagaaacttctaatgacctggaatgaagaccagtcacagaagtgaattcctcccagcaccatgatgatcacagccaagcaagaagtttgttcgcaatgttgaaagaaaaggctggacccaactacaatgttgaatttactgctagctctgggtggtttaaatgattcaagaactgtttttcattacgttatgtgaaagtaagtggtgagtctgcaagtgctgatgtgaagacagctgaagaatttctgaaaactctagttttcagttgattagtgataagttgattgtgagggggaattacttgtcagagcaaatcttcagtatgaaggaaacctctgtattctggaaaccaatgccttaaagcactattatccctaagggggccaagtcaatgctggatgtcaggtttttaaggacagaataaccatctcactttggagaaatgttgcaggctacaaatagaaacttttaatgatatggcacagtgacgaccccagggtctccaagcatatcactaaacacgcactgctggtaaactagaggagccataagaagtcatggatgacccagctcctttccaagacgcccttctgaattactatgccagcaaaatgagaagtactattggagaataacatacctttcaggatttgcttattgttggtgatggtcccacacatgctccttttattggtgatctccatcccaatatcaaagtaatgtttttccctccaaacaccacctctttgattcaaccattgcatcaaggcattaaagcactttttaaggcctattacctgagaaggacttttacccaggctgctgctgcaaaaaaaaaaaataataaaaaaaataaaataaaaaaataaaagataccaatgcaattctggaaggattacgacatctctgactgcaccaagaatcttgcttgggcttggggtggtgtcactaaggagtgtataaatggcagctggaagaagatactcaagaggttcatcaatgacttcaaatgatttgctcaggatgagcaggttggaaaaatcaacaaggtggtggttgaactggcagacaacttgaacgtgggtgtggatgaggatgacatcgaggagctcctggaggttcttgagaaattgactaatgaggagttgttggaatagaacatatagctgaagaagaggcaacagaaaaggaaactgcaggagaagaaaaggaaaacccccaaggaaattcacagtgaaaggtttagaagtttttacagacctcaacaaactccttaaaaagtttaaaaacgtggaccccaaaactgaatggttcgttcatagaggaatgttcatagtgcattgtctactgataagaaaatctatgattaaagaaagaaagaaacccagcaaaacttcataaacatatttctgaaaagagtgacacatctttaaaaagagccttaagcaggtccttcaggagccattccagaagcaggcattgttatcacagtagacagcagctccatgggtgtcagtgcccctgagaacgtcccagtgggacaaggtgtagaggtggaagacagcagtagtgaccctaaccctttataggcctaggctactgtgtgtgtttgggtcttagtttttaacaaaaaagtttaaaaagtaaaaataaaaaattaaagattgaaaaaatatttaaaaatcttaaggtaaggatataaagaaagaaaatatttttgtacggctgtttgtgtttcaagctaagtgtgataaaagagtaaaaaataattaaaatttataaagtaaaaatttataataagctaaggttaattatcaaagagaaaagttttctatatatttagtgtggcctaagtgtccagtgcttctggcatctacagtagtgtgcggtgatgccctaggtgttcacatcctgtcaccactcactgactcactcagagcaacttccagtcctgcaagctccatttttgttaagtgccctatataggtgtgctttttttttatcttttatattaatttttactgtattttttctatgtttagatatacaaacacttaccattgtgttacagttgcctaaggtatccagtacagcaacacactgtacaggtttataacctaggagcaataggctataccatatagcctagctgtgtagcaggatataccatctgggtttaagtacattctatgatgtccatacaaagatgaaattacctaatgatgcatttctcagaacatacccccactgttaagggacacaaaataagattttacacaaaatcttgttacttcatataacaaaatgcaacataaaactttcaaaacaaataaatacacttatgccccataaatgttaatgtgaaaatcatatttcatcaaaaatctatattactatgttaaaatgaacagccttgtaacatatctttgcataggtccctaattaattttcttaaaataagtcccaaagtggaattcttgtgtcaaaaactatgtattttgttacagctttcgaagactactgttagacaatattgtaccctgaccaactatatgctaccaccatcctacatttttacccaagctggatgtgggaattcttatttaggtcattgtgacactagtttattggtagtcgttactggtagtgaaacaatgactccaattcacttcccagccagccatcctggaggggctctgggtgcccgggcaagccccagcctctcatctgcatgctcaattccactcttcttttgtttcccattggcaccaccattgtccgcctcctggactcatctcttggtcttctccatccttccagctattccagctatcatatcatgaccatatcaggcttggactcccccctaatatttattcgctaccataaactaaattatgttttccatcctaagcacaaacatttcactaacacccgtcatctgtttgtgaggcagcagcaggagcaggtaatccacggttctgctttctctgtactcttctagaaataggggagcttagattctccctggatcccatcttctagagatggcattactggtctcatattctattttctttcatgtattgaaacttttgttattaatagcttctgactaaagtgaaaatgtcaatgtgtaaaatatgtggggtaatgtgttccacaatatacagagaaaagctctgaaacagtctcctgtaattctggattttctgttttcttcttgttttttaaatttccgggttcttgagtccatgtggtctaagtcctgcattaatcctgaacacatggcagcagggataaagggaagacctgaggtccgtgttccaattcgccagggatgtgaatgccctggacgttctccttctgatagggacaggaggcagagaaattctaggcagaaaagggtggatccccaacaaaaccccaccctcaagcctgggaacacagtccaaagtgagaacttacatctctgtttctggctcaaatatttccttttccaaaaccatgtgtggccctgccccatcctgtgcctataaaaacctcatactcaaccagcagagagaggtgaagcagctggacatcagagactgtggctggatgttggagagaagtggcttgacttcagagggagagcttgacagcataactttggagaagaatctggccagagatggccagacgtcaggggaagattaccttcccattccatttgcttttcagctccccttccaactgaaagccacttccattggcggtaaaatccccgacagttgccatccttcaggttgttcatatgacctcatttctcctgaattccaggcaagagcctggataccactagtgtggataaaaaaggctgtcacacttgccctgtgcccctgctggagggcagccacctcatgtgagtaggcagagggacgactcagctgttaacactcaagccgtccacggatggcagagctaaaagagcactgtaacactccctctggagcttcaggggtcatgggcatcacgccagactctgccacggggcctgcatgaagtttgctcctgctggtgcccaaaagcactggctctcggctcctgcctccacttacccgtgtgctccttcccatgagtggtggagcacagcggatccgagtgagtggagctggctcctgcctgcgctgaagcagccagttggttccagtgtttgcgcactccagttctcacctcgttcatttcatgctctttcctgcaaggagttgacggctgtgagctgggcaaatgaggcacccggttgcaagttccatgaaaggctcggggaaatatcctgcttcacttccatatggagctagtgctttgtaaagtgcactgacaataacaaagtgtagaggaggaccggacacaggctgaactgagcttcttgaaaaggctgcagctctcagaacaacgctgagaaaactggtccttcagctatagacacagagtcaagaactccatttttcaaattatatctcatgaaaagctggtgtccagtgacgtttatctgagaaaaagaaatttttttttggccaaaataactagatagatttttgttagactttataatgagaattatgaatttcctgaaagtgggatggaatacagaatgttccccaaattgtttccatggaacagctaatagcacatagagcatgcgtatttgctgtgacatgataaagctcaaggccagagatgtcttgtggggctcccaagtactctaacctcaaggtgcatgccctccactcactaattggctcctctggctgtgatcgagctccaaaagggaaggaggctaattcaaatgggatggccccaaaataagaggaatagtgtgcatttaaaccaggatatgggctatacctgcttacagtaccctttatgcaatctccagttcattaactctagtagatattgtgaagatactatcaaaaaaaggttatgttcccccaaattagggaagccctaagggattccgtatctcctttttgtacagagtttgttagaaaatcagatactggtctgagaaaaatgctgattcagatggtcaagagactaaaaaaaagtactttaaaacatcagaatgaaatcactgaaggcaatccttagctttatgatgtgctgtactcctggacaagatggtgtaagttgagatgatatgtcaaatctgatttttctataggaaaaaattgtactttagggaggtatagttctagccatgttcttaatacccaaaagttaatcagaattaccacaaatgatctactcattcaaatataagtagcccacaaataccatgttaaactttctaaatttgaattgtttaaaaaagcaaagttatagaaaatgacatttatgacccattatcagaagctttagatccaatattagaatattagaggcttttgtgctaaactcttttctttcttataaattctagcctttatttatctattttaggagggcatgtggcaaagcatggcagggaattctttcaaaagtggaatccaggaagaaaattccttgggaaactttggactggattctcaacaaacccttcagagagacttaaagccggtaaaagaccttttgcaaaagtgatccggggggcctccactttgtttctctggatatttctctgttgaaatataggtgtcaagcacgtcccattttagatgctcttcagacttcaaaacattaccttcctgctttcagggagccatttcatcagcttttgtactgtgtattcactgcagaccctgctgttatgcaaggtaccaccatggctaaaaattcacaagacgattcttagttgcactgattttttttttatttgatctttcacaatgttgctgcttccgtttcaaaaacgtctcaaagctttgatttgattgcagctggattcaaggatacccaaagccaagtttgatcctgaattccccaaatcaaaagtatttcatttcagatgtatgttctatacctggccataataatgaacagcaaccattactggagcatgcttttgatttttttttcattaacagtcatttttatgatttggaaacataattagaagattcctattccagactacaaatcaatggatttgattctactacacatttgccaataaagagcaatggtatcaaatgaagcatttgacctgtctttaaatttctttcattctgtaaattctacatgaggtatgatatatggagccaactggctcctctgccacactgctgcagttcagttgttggtattgtctggaaggaaaaaacgaagttgtggaagtgtgtgagttagttggaggtaattaccatgtaactgattatcattcatgttctgagcgctgtgctattacatacattattttatttcatccttgcaacatccttattcctatttttcagctaagtaaaaaatgaggctcagaatagtgaagtaattatccacggagagggaagatcagcagtatagattaagttggaataaatctaaagctcatcctctttcactatagcatgctgctttctagctatataagaaaaaaacctcattattctattaccccattgagaaagtactgttctctcttgttcagctgtctgctttacttagctccgatgaaatctaaattaaatgctctgctgctgatgatgttggtaacactctggtggtactaaccatagttctggggagtgaatgggaagaatggccaagactggagatggggacattagattttgagacacagaccaactgaaatgagactgtgttttctgttaataataggaatttaaatgaatcattgaaaaatcagagaaagttttctgaaatataggaagcaaatgctacctatacttctttatatctttcaaattaaaaaataattttcaatacatgttaaatggtacaaaaatcagtggggcttttttaaaaattcaagctttataagaaaaaataataaaacatgtgccaaatatgtctgaatactattaaatgtaaatggtgtatcattaaatgcactggctgtttgggagaggtgtaataaacaagagacacattgtagctatgaccgtgacgatttactttttttaattctggaggaaatttcaaactgtggaatatataagcagaaaggaaatgaataatgcatctaactagcatgcgatagtaagcctcactcccgttgtggacagacaatatacaagaaaagattttggtggaaagatgtaggtgctatttaaggggaggatattctttattgaaaacatatccagcaacatctgaatgccaaataaaagtctttacagtttcatctctccttagagagcatattttttagttgttgttttgtttgggagaaaattgcagtttaagatttacaaaccacttcatttgcaaactgctattactatagtttctgcctctgaaaatgtttaaagctgcaggcaatgaaaagacatattattagagcttttccttataaagaaagctctcattctattgtaaaaaatgagcgtataaaaatacaatattatttatagagttatttatataagcagcattttgatgtgccttcctgaggcttggagatattagaaagcagaatatctgagaaaacatatttcacttcgttgtttaaatgcaatagagatcaagagattatcttcatcatgataagattcaaagaaatttacactggtaattggagcttgtccatagaatttattccttattacaatatagactataggttgttacatttttttccttaagggaggtaaggttagatttttcactatttaggttgagactctttagttgataactgaaagttttcttttagcattcaatttgttcttgaattattttttatttcagcatatctttctaaaaattatgcatgatcagctcttttttttttccattttcctatcagctgtttatcttagatcttcattcatggatgtgttagtttcccaggattgccaaaacaaatcaccacaaactttgtgtcttaaaacaacagacatttattctctcagcagttctagaagccagaagtttgatatcaaggtattcataaggccaaacctccttcaaaggctccagggaaaaatccttccctgcctcttccatattctggtggctccaggcttttattggcttttggtggtatcactccaatctctgcctccgtcttcacaaggccttccattcagtgtctcaaatcaaatctcttttctcttataagaacaccagtcacttgacttagggcccacccaaatccaggatgattaattttgagatccttaacttaaacatatctgcaaaaatccaacttttcaatttccgaataagatcacatttccaggtgctaaggtatattagtcagggttccccagagaaacagaaccaaggggatatctaaatgacccttatgggagaccactagtgtcgatcctggttcaactctaaaggcctgaaaatcatgagtgctgatatctgagggcaggtactcagaaagaagaaatttattctttctccaccttgttttaaattcaatccctccatggattggatgattcgcacattggtgaggtggtcttctttactcactgtactgattcaaatgccaatctcttctagaaacacttcacagacacacccagaaatgatgttttactagctatctaggcatcctttagcaccatcaagttgacacataaaattaaccatcacacaggggttagcgtttgggcatgtattttagagggattcaggtgaatgtattacaagatgtgaaaaatagactttggagttaggcaaaactgagtgaaaaacatggatctgccactcacattgaggaattatgatcatgcccataattctttagagcacaagtttcccccttttaaaaataacgatattttaataattgtgatgatactagcttcacacatgttgtattagataatagcgtgcattgtaagataatatgtataaagcaattagctccctgctttgccaataaatggccattgttaatttattgattatatggattttatttttctaattagagtaattccattgacttcaatttctatagagttcttctttccttttatgcagcagaagttacaaaagagaatgtgacatgaatcatatctgtattgaaaatagacatacgatgactaattttgttctaaatgaagaatgttttcttatggaattattgtaagaattaaatggaaaaaaatgtatgtgaagtacttagcagttagcatttagtgttagctactattatcaacaattccctaaaacctgctagggttacagtaaccatggcaacacaaactctattttatttagtaatatatttatttgctaattgacaaacaaaattgtatttgttcactatatataatatattgttttgaagtctatatacattatggaatgactaggtctaggtaactaacatatgcactgcctcgtatagttatcatttttgtggatattttgcattcattctcttagcattgtttaagaatacaatatatggctaactatagtctctgtgttgtatgatagacgtctttaacttcctcctatctaattgaaatttcgtattctttgaccaatatcttcccaaccaccatccaccaactaccccagcccctggtaactaccattctattctctacttatatgagatcaactttttaagattccatttatgagggcaatcatgcaatatttgtctttgttcctttggttggtttgtttcacttaacataaggtcctccaggttcatccatgttgtcacaaataacaagatttcctcctttttcatggctgaatatagtattccactgtgtatacatacagcattttctttatccattcacccatcaatggatacttagattgattccatctcagctgttgtgaataatgctgcagcgaacgtgagaatgtagatatctctttgacatacagatttcatttcctttggatatatactcagtagtgagattgctggatcacttaggagttctgtttcattaatttttttttttttgaggaacctccatactgttttaaatactggctagtttacattatcaccaacatcaggcaagttctcctttctttacatcctcaccaacacttgttctcttttgtctttttgacgttctgagaagtatgaggtcatgtcacattgtagttttaatttgtctttccctaatgattagtgatgttgagcattttttcatatagctattgaccattttgtatatcttgtttagagaaatttagagtcatggctcatttttaaattgagctatttgttattctttgtttgttctgccattgagttgtttgagttccttgtttattttggatataaaccccttatcagatgtgtagtttgcaaatattttctttcccccattctgtaggttttctctttactctgttgattgtttcctttgctgtagaacagctttctattttgatgcagtcctatttgtctatctttgcttttgtcgcctgtgcttttgaagttatatccaaaaatcgttgctcagaaaaatgtcatgtagcttttttttctatggtttttcaacgagtttcacagtttggggtcttatatttcagtttttaatccattttaagcagatttttatatatggtgtgagataaggatctaattttattattctatatgtgggtatccagttttcccagcaccatatattaaagagactctcctttctccatggtgtgttcatagtacctttgttgaatattattagttataagtgcataaatttatttctggagttcctatcttgtctcattgttctacacgtctgtttttatgccagtgttgtgatgttttggttactatagctatgtagtatattttgaaatcagggagtgtgatgcttccagttttgttctttttgctcaatatcacacactcctttctaaacctcatcatcgtttagggtatataatacaattaataaatgcatatataattatatgtcttttcaaataattgataacctaaacttgataaccaatcatagttttacatactaactggcagttcctttctatcttgccctgaatcttattttatagacatacatttccaggatgttacatgagccttcagtttagctcatcaatactcagctatccaaaattcctcattgccttgcagcagtttttcccaataccagggccatgttcttagctggctttgaaaaatgttttgaagaggcatcttctccagaaatcttttgagactgatctccccaaatatgaatggtgctaggattattttactaataattgaaccttctaatgcttttctctttgttattgatttcttttgtggcattaatttttaaagtgcttgatttcccagttgattatttgctatattaatcatatgtctttcaaggtcttggctttgttaatactgtcttaactgactacagaatgaagacttctaactttcaggtaaggattccgcgttttttattcaggacaggtccaaaaaatggcaagataacagcaaggggattcatttgcctgcaggcagtttggttaaaattctcccttagttctcatatacacattataatttgcattttaattttactgtcttcacaaccacgaaagcatatttaggtaaaagtgctaattagatctttgtaaacaaccatatgttattttggtttatgaaatttaaagagcaattaaaaacacatatatttactacttataggtgggagtgggaatgactttaatctgaaaagtgtaagtgaatctgaggaaaaagctaaattagagatgtgttgaatgatcttttggaagaaactaaaagaaatttgaaacttttcttcagaaaaccatagggccacacaatgctacacattgagcctcaccataattaaatcaaaatacttgaaaattatatttcaaacctcttttcaactactgtacttaccttagagaaatcttcaaaagaaatctgtggtatgtttattgttaatgaaagcatgtcattctttctctggtgacttatccgtctttatcagtttcactgtgaagagcagagtgatatatgagtgtgataacttaagatgacatcttatagtgcaatccattatctgaaagatttaaggaaaaagctctctgaaaaaacataattaagaaaataaatgtttttagaaatataataaagatcttttatggttttggttcaggaacatccatttctataatatgatacactaaggaaatagtctgccaatcatctaaataacacttgtattttgatttttattggtttggcttctccacaaagaaactaacaaatcattaacaaggattaagaacaaaaaagtgtctaaagtttttttagaaatggattgaggaagtagattaaaaggagactcagagaaaagagactgttttctaaaaatatggccacgttgtaaatgtgtgtttattttctcaccaataaaaataggcaatatgttgtttattgcctggatagttggacttgacttggtttttggctcctgatttttggtctgagtctaatgaaccaataaaaatctcttgatgtgccacataagtaactcccacttgaccccattccaggagctaaagaatctcatggcttcaacaaattctcctgaaccttgctttggaattatattgtttatttgtaatagttattttctctttgccttagttgatttaagaagtctagtatcacgtcaggatcataatatatagatacagaactccttaaaaataaaccccaaatctaaaatcaggattgaaaaaaggacagaagtgaaatcaaccaaagtaaatgtttaaaatatgcattcttagctgtgcttattcaaattggtcaactctgaatatcttcgtttctttttttttttaattccactggttacagattccaaatttcatccattccttcttgccttaaactgtgatctgtaacctgtgccttcactcaaattaccatttcagctcttttacaaacatcaaatagcaaagggcaatatggatattttattagacttgcacagatcagaaacaaaaaatgtgcacacaggttcaggggactatgtgcagcatttctgtaaggaaatagtgggtgtgaggtatagagagaaaactttcccatcatcaagttcctggacactatggtactgcacttgtcccactataattcctttaaagtatagcgactacttttcacctttgtaataactacggtacttctaaagggccactacaatagcaatgagaatatcatctgtttttcttggaggtggtagttttcatcaagcatatcaagacatatgagaagatggtatttaaaatattcagccaacaatatgtcctgggcatggaccagaatgaacactggccgaagtgctaaagcaatatattggggccccggctgtttctgagatgtggggacttttgtgaggtctaccctagtgtacacccggagtagattcaggaaacctaagccgttgatgtttaccagttatacaaaagtatttcaatacctgaactgctgtggctataccagggcatgttcactaaatatcagccatggactttgcaaatttaagcaagcagacataaaaataagtcatacagtcattctgatgttcttgccattgcacatgctctctctctctctgtctccctctctatatataatttattatacaatacattataataaatagtatgtataataaatagcataaactaatacctacaaaatatataataacatattagtcatattagacatattcttatacccaattaaatttttattaatagaatagacataaggctggagtgcaattaatgcaaaattaatatatacgttatataactcatgtataaagacagaatatttaacattagaatattttgttattcttgtttggcattgctttcaaagtccatttctgttccacataaagaaattcatttcaggttttcatagtcgtaacccacatatttgaaaggggaagtttcatgtgtatgagatcatagaccaaagagcatatttgtaaccatcattggttgtttttgtctgtttcatttagtttttatagaaatagaacggatttggaagcttactgtaaacactgtgaaatggtgaagacttaagaagcttttcttaaatctctaaactgctgagagcgtcctagtatgacaaaatggtgccgtcctttagtacttaaataaatatcattcttcctgaaacactacagttaaactcagtgggtcacttttgtgctttggggtgtaagaccccaaatattaacctgaggaacctaaaagcacaccagaactttctgaaactttttcccccatgctagatggggtttggtctaggagaaaagttttgcttctcttcccagtgggtcttgttttagaactctctaaagcaatgagcttctctggtttatcttccatcttgtttattgtacctagtctctgacatgcagaaatgacttaataaaggttttctgaattcgtgaaattcacctcctgaaaattaccaccttatgatctgaaaaaactatctgctcaacagaaagttactcatatatctgcttctatagatacagtagtctcccttacccatggtttagctttctgtactttcagttaactgcagccaactgtggtctgaaactatcacagtattttgcaagagagagagagagagagactacattcatgtaaattttattacagaaaacatggcatatatgggacttagtgctatctgtggtttcagcatccactggggtcttggaatgtgtcacccatggataaagggggaattactctgctagatttggtaaaaaggcagactagtggagagatcttctgaaaaaaggagataggaaatgttactgaagagaaatagaaaatattgtattaatttattaaaagtaaaggttattagaaggtattaaatttttgatataatgtaggtgacagtgtgagtggggaaagacctgtaagtgcaacaaggggatgaaattccctatcttctagccatactccagtacataaacggcttaaaaataatgtatatcaaagcaatgtaataaaggattaccgtgatgaattttatgagattaagctgcagttaatttccttatgcatttaagattaataaactgctaattagaatatgcaaataagggtttctgaagcctaaaatatattccctagcatcttacccataaatcttattcagtaactattttgttatataattggggaataacagattgatgagccaatctaattatgtgaaatttacatgtgtatggtattttataataaaggacatgaactaatgttaaagtagtggaaagtagttgtaacattcattatagttattaattacaaaatttaacttagtttgaaagtactttgtgccatataagctatcagccacaccaagtactcttactacacatctggtgcataattgtcgggtgagactgagcccatcagcaattacagcaattattgggactcttacatttacagctcacacacatcacacccaagcacacgtttctggaatattgctgatcatccagggacctagataacaactaattgcctcattatgcaaagtggggaaagatattcgtatttcttacatcttctgttctacattatacacatagagatgcctgtttgacagcaagcaacagataaaagaatattagaattatttttgtgcccagttaaggttttttgggtttggcttcgactttttcataaagaaagcatcttcatgaggctggaggacataaagcaatttgaaagctattatgggtaaaaaacatctaaagggtttacacacacacaaacacgatgaaggaattaggaagggctctaatgatcctactatttactactttggcaagataccaaatggaataagaattaaaattctattgaaaattaattcaactgagtggacagaatgctatgaagtattcggggcattttctttcatataatatataacatttactaatatgttcaagtaacaaaagttacctttatacagttcacctgtactctgtgtatttgtccaacattcccatgaaggacaaatgtaattaatcccaatttaaacaggtaaaaaatgaaactttgatatatgcaaactgcaatttgtaatcaatagtgagaaaatggaaactgcagcctttgcaatccagttctgtgttctttatacctgtgtattgccagatctatgtgtgtaaataaaattcaacaaagaaatacctgataagataagttttgtgggcatttatagcacacttagtgaaaatatataatatcaccaagcccgccatattagaccacttttaccttatttttcttactttaatcaatatttcattaaatttgacttaactttatgtgtaaagatactggtatgaacaacaattaccttgtccatattattatctcttccagctttttcagagcagtttgaacaaatgaataaaaacttgagaaacataaaagatgcctaactaatacatatggcacatgcattataatattaaaagggaagaattctcaacttgttatgtacacactcaagcttttttttttttttttgagtattcaattagcagaataaccctacagaatccgtcaatatcctgtcttcactgtgaacagaatagaaaattcctcttcttttttttttaatgactgccaaaatctagggcacttggtgttgatgcatgactaattactaatgtttcaacagagtaagtcagattcaaattgtaaaggcacacaagtgaatttaaaacctactttttcattctttgataatttctctaccaatggaggataagaagagatgatgccggtttgaaattcctgacaaaaacttaaaactgcttttaccctgtctggtatactattattttattctaactgtgagaaaagtagtaatgagatcatcctatttcaactaccgtgactttaaagagaacatgacagatacaatttttcaacaaattaggctgttttctgaaatactaacaaagtttgccttttcagaataaaatgttacaagagctgcttctggccctaatgtgcccttatcagcgtgtgtgtttttaatgtggttaaggtttaacattcattccagcttcacctatagcttgttggtatgctttatcaccatggattttaaacacactgaagaaaataatttctacccccaaaattattaaagcccctacaaggaactttacactttcaaaaaaataattattttcaaatataaacacctctttatatcttgacttttagatccctataaaagccaataagacaaatttgattcaatgggaattctttgtactggcaaaaaatattacatgaacgataatataggagaccctctgttatgtaaaattacgctatttattactttagcaagttccaatagaataatcgttgatggccctgaggtgtcacatgatcctgaattacttaattgttacatatattcaggaaaataataatgttaactgcatcatgctctagtctaagcttcaagaaattggtaatacaaatattctatataatctagcattctacctaaatatttgatcatttgtgacaactacattgaatgagagtttaccatacttttttaacaaaagaaaaaatatagcttagttagctattgatgagacctactagaagaaattaaaactcatatcttatgatttatcacaaagcatttgagcacaaagcatttgaatttgatgttaattcaccttggctgtgactcactgagaattctgggttttacagatgggtagatcacttccttttcatgtagctttttttaatattgttgacataagagaatctgaagtatcatttcttcacatcctatttcacctgtcattgtcatctcaaaaatctattttctcttgcataaaacctcagtgtttaaagctataaaagcaaacacagcagtgaggaaattttcccctgggtctatttgccatatgctttaaaacagaactatttgaacaccaaaatcagcattcctgaacttgcgtatagagacgtttgttttcttttcccacctgcataagggtaaagaattcaggcttgcagaatatcctttgaattctaaaaccttgctgaaaaatcatttttatactgcagagtgatgactcttgctaccttcttatgattggaagggtttccaagagaaacaagatggacttgacttctcttggaaatataactcagagtgtttgagagatttagaagttattcttctgttactttctagatattcacttttaattataagtaaaatatgtttcagatccaaacaatggtgacttcattcattcattcattcaaaaaatgagtgtattatgttttcactgtgtttccttcacagatattcttggcacatcagataacacagtgaaaaaaaaacagatgacaaatcgtcaccttctaaagcttatattctacagggggaataaaaaaacagaaacgtatacatacacgcatgcatatacacacacataaatttaatagcatgacagatggtaatactgctatggaaaaaataaagcaagaaaaaggaatagtgagtttaggatgaggtttggagggttaaaatttgaacagaaatttgaaggagatgagagtacagatatcatgctatctgtggggaagattgctccaggttctaggactagcaggtataaaaggaatttgctggggaagagcacggaggaccatgtgtccagaaagagaagttaagtaaccaggagtgaggggcagacttattgaggctgtgtgcaattaaaggggatgttgactttaagtgagagggagggccattagtggcatttgagcagagcaatgaaatattctacttaaaaaaaataataagctaactttagctgctatacacaaggaagcagaggtgccacttaggagattattgagtattttaggaagagatgagagtgtctcagacctgggtgatagtgatataggtgatgagaatcagacagattctggatatagtctgaagtttgagacatttggcttttgtattcaatatgaaatatgacagaaaggatgagttgaaggtatttgatttgagcaaggaagaagttgcatttattaagatacaaaagaatgcagaaaaagaaggcttgggggaaatgtcagaagttagctctagactcttgaagttttaaattcaaaataaatatccaagtgagtactactcaatctattgagtagatgattgcatatctaagtttgaatttcagagaagaggtgtatactataaatatatatgtggattttgtcagtgtggaattggtatttaaatccaggggtccaattaaaatcaccaagagagtaatgtagatagagaatgggagatgtttgaagactgagccttgggatatccaagactcatagtttgtagagatgagaaaaaccacaaaagaagactgagaaggaacagccagttaagtaagagtaaaatcagaagagtttaggctgtcctggaaggaggactgatgtttctgctaaagtgatgcaatgatattgcaaatgtaatatacttgaaagacaccaagaggagaggtattggaggcagtacatttttgcttaacaaaaaagcaagggaaaaggacagtagatagagagggatagtgtaaaaaaaaaaagctgtataatttttaaagagagggttattaatgggtacaaatttacaattagctagaactgtaaataagacccattcaatagctcagaagggtgactacagttaacatttatctattgtatatttcaaaataggtaggagagaataaatcaaatgttactagtataaataaaagataaatatttaaggcaatggatattctgattaacctgatttgacctttagagattatatacatgtatcaaattatcacttgtatcccaaaaatatgaacaactattatctatcaatttaaaaagttggctaaaatagcagtacttttgttggaatgaattcatagaaaaataaatgataatgtatgtgaatgaagaatttctggagaattaaatttctgcaagtaatgatggaatatagtatacaaatgggtgcattgccttgtatacaagtaaggatagtttatccagagtgataggagaggtctatgggctcattcacaggtcagtctgtgaatattgtgatgaaggctttgggatattttttctgattcttttattttcttaatgaagtaagaagctgagaatgagaaagtgtagaagcttaagaaggaaatgttaggcaatagtaatcaaggaaaagaaggagagtgaatgaaatagatgtcagtagtagaagggcagatggcaacagaggctcacatgggtttaagggtcatgaagaccatgcttcatattgttaatgtttttctagagccatatttgaccatgggtaggaggagtaatttaaccattgtatagagattctccaactgtatataaggcagcaacagagtagcaaacacaagtaaataaatgtaatgaccaattatgggggaggagcaaattaagagcatgaggaagagagagaaggcaaggggcagaatcagtacactgtaagttctaatgctgaagttagggtactaagagtgaactctcaccttctctatgataacatccatatttacataaaatctgtacacaaacattctgatacagtatagcatcttccattttccattgagaatgattctcatccatttgtgctattcccattttgcaaggaggaccttcttatgttgggaaattttaatgattataaatgctctgcatataatccctgctgacggaatctatgcttcattgatggatgaatgtactcaatcatgatgcggaagagggctacatggtaccttccaccaacagctactttttctattcctctctctctctctttaaatattttgcctttaaaaaatatatcttcttaccatttgacgcattcctgggaaggctgttcttatcagcagacattgctggaaataaagagagaaattgtagaaggaagaccagttattaaagaacaaaatgtcgatagccccaaagagaggtttaattttaaaaagcaaagctaaaaatagcaaaaatagaaaaaacacaaacaacaaaacctctaaaactctgaaatgcgtgaaagagtacttttcaaatgcaagcatgcatgctaacttcacatttccacccctacttatctctcccacacttgagcctcacagctcacatagccgcctttctcctgagtatgacagctcaactcccagaacagcctatcaggtcacaaaccataactgatcatttttgtgtgcttcttagattctgtttgcctggaagcagcttttcttttaacattatttttctcctacagatggaaatggaagagaggagaataaaaattcaagtctaagactgagaggttccataccagcgagcctggcaccaggttgagcatgtatcatagggaaaagttagagaccacacaagcctctgtggttatactatgctgcagagaagagggcaaattaaactggaggtccaccttacaagaattttgtgaacagctgaatgttataactgttatgaatacctgcatcacctaacttaaccacatgaaactcactcgtgaattccctactgtacacatgtcagcattctgaggttttagtgattttcttaaacaccagaatactaccaaggggtcactcaaaatgcagtgctgggaatgttgtaagaaacagttattccccttatttaaccaaattttctgtcacaagctgcataattccaagtttctggatcttatttaacccttggggaaaaaccagtccttgaattaaaattaaatataacattattcctgaagtattacaggattttttttttatttcttgaaagcggagtattcataattactacttttttttttttttttgagacagcgtcttgccctgttgcccaggctgaagttcagtggcacaatctcagctcactgcaagctccacctccctggttcaagtgattttcctgtgccagtcccctgagtagctgggattacagttacgcaccaccaagcccagttaattttttgatttttagtggagacagggtttcaccaagttggccaggcttgtttgaactcctgacctcaagtgatcctcccacctcagcctcccaaagtgctgggattacaggcgtgagccactatgcccggtctcataattactttgatctccctctcatataattaaagaaatcattctatcatcttttctatcacgttattctctttacacatttgtccgatttctttctgctcctctgtagtgacagttttaaaatcttcatttgttattgcgttattatatactgatcaaaacaccaaaatatactttgtgctaaacatttcattgtgcactatggatgattacaaaatcaagtaaaaacacagcttcagctctgaaggtatgatacagataaataccactgtgaaaattttgtgtgattaaagataagtgagattattgaagaaagtaggttttcctagagtcaggatttgaagtaggggttattcacagaaagaataaaaaaaaaatttcaaattgcaggagacagtatgcagaaaagctggatttgaccccgatgacttgtccccatcccttttatttcagcaatattttcctttcaactaaagcaccaatgcaaattataccagttttttctctctgtagattgtgtggcttgaggaactacggtgtaggaaccaatcagtgccaagcctccctccccaaattccgcctccagtctcccttccttcctttcttcctcattgtctacagagggtgcccagaaaagaatcttattgcctccttttccaatgatttacaggataaattccagatccttagcatggcccacacttttctctgtgttgtggccctgtttcactaacgttaccttgctcggctggcagtttcatttctccaaaatgacttttttccctgtccaccaggcaaactgcctaatatttcaagacgtaactctgataccaccttctatacaaagtcttcccttaggcaaaatgtctaatcttttctctacttctttaaaaccaaacaggtttctttcattttattgcatttctgtgtagctttcctctgagatttttgaagtcaggggctcttcactcagcattacatcaatacatcattaccgaccaatgactatatctcagacattgtaccaggcatttacgatgatggtgaccacaatcatacatagactcttgcttcatgaagtttatcgagtaacaaaaaaggtatccacaaataattacacaaataattaatcttaatatatcataaaggaaaattacacagcaatatgaaaacagatcaaggagagcaaatagattctggactgttggggtgggaggcaatattaggagtcacagtttttatgtatatatgcttttcttttgataaattagaatcatttataaaacttttaaagtttttctttcaattatcattgtatatttgaataatacaattaatcatccactttgagttgtattgaccttaaattgtgtattttgattctccactgtacagatgaaaaaattatattgtatttgcaatgtaattattgcttattatacttccccctactctgcctcaaaattttggttagttatattattatttcagcttttctagcagttatctttatatagcggtgaacttgtgactggcttttaagtccaaatccaaaataaattttggttgataatttgtgtctgttaatgagtaaaacaaagggaaaacattgaagatgaatgtcagaacttcactcattcatcaaagatataaatgacttaatcatagatcacattaattcaattggattaatttgattaattaattcaattatgattgcttgatcatagattaggttttaagttctgaaaaaagattttctcaattttttgtactattctatatgtaatgactgtaggcacaacacacttttaagtttcatctgtattattaacattttttccgttctctcttcagtttgacagtcaaaaaagcagtaagtcaaaccctgatttgcagcatttgtcaatttccatggtataaatattccctgtgtggcttatttaaagcttccagcctaccctcatggaatgcagagaagagcacagagagataatacatgttatttgaaagactcaatattatcacaatatctactcttcctaacttgatctacagattcaatgcaatccgaatcaaaatctgagtaagctattttatgaatgttgacaaagtgatcaccagcagcataccacaatgtaggatttcccccacacatttgcggtgtcaagagcatagatactagtaaagtgtagtaaaatccgttaacttatttacttgcaaatgtatatgcttaatattttcaataagctttattttattatcagagaagttttaggtttacagcaaaattaagcagaaaatatggagtttccatattccctcatcttcacacatactcagactcccctactatcaacatcccacaccagagtggcttgatttgttacaatcaataaacctacacagacacatcattatcaatccaactccacagtttacattagggttcacccttgctgttgtacatgcgtgggttttgacaaatgtataatgacatgtgtctactactgtagtatcacacagaatgttccactgccctaaaagtcctctgctctggttattcatcattccacttctccagattctgacaactattgatctttttactgtttccatggttttgccttttccagaatgtcatatagtctgaatcatacagtattgccttttcaaattggcttctttcatgtaataatatgcatttaagcttcctttgtgtcttttcaaggctcaatatctcatttcattttagcattgagtaatttgtcattgcaatgtaccacagtttatttatccacttacctactgaaggacatcttgattgcttccactggcaattatgaatgaagttactataaacatccttgcacagacttttgtgtgaacataagttttcacctcctttgggtaaataccaaacaacactattgctgtatcctatggcaagaggaagtacaggtttgtaacacactaccaaaaactatcttccaaagtggccataccattttgcattttcaccaacaataataagagctgtcattgcttcacattcttggcagcatttcgtgttgtcagtgttgcagattttggccattctaataggtgtgcagtagtatctaattgtcattttaatttgcatttctctgatgacatgagcattttttcttatgcttatctgccatctgtatatcttctttaatgaagtagctgttaagatacggaccatttttaattgagttgttttcttattattgtgttttaagagggcttttttcggtatagtttggatgacactcctctatcagatgtcttttgcgtaccttttcctctagtctttgacttgtctttttattctcttgacatgctccttcacagagcagaaaatttaattttaatgaagtctagcttgccattttttccctaaagtgtgccttagatgttgtatctaaaaagccattctgacaccataggtcgtctagattttctcccttgtcatttctaggagttttatagtttagcattttacatttaggtctataattcattttgagttcattgttgtgaggggttcaaggtgtatgtctagattatttatttagttagttagttattttgcttgtggatatccagttgttccagcctcctttgttgaagaaaactatcttttcttcattttagttccttcgtcaagatcacttggctatatttacacagatgtattcctgggttctttgttctgttcagctaatctatttgtctaatcttttgccaacaccacactgtcttattactttagttttatagtaagtttaaacttggatagtgtcagtcctccaactttagtcttctttaatattcttggctattttgggtatgttgcccctttacataatctttaaagatcactttgtcaacattcacaaaatagcttgctcagattttaattgggattgcactgaatctgtagatcaaagtaggaagagtagatattgtgataatattgagtctttcaaacaatacatatcagctgttcatttcgttctttgatttctctcatcagagttttatagttttcctgttatagctcttgtgcatattttgttagtttatttctaggtatatcattttcggggggcgctgatataaatagtattgtgctttgaatttcaaatcttacttatttattgctggtatatggtaaagtgattgactcttgtactttgaccttgtatcttgcaaccttactacaatttcttattaactcagatagtttttttgttgttgttgttgattctttcagattttctacatagacaatgatgtcatctgtgaacaagcacacagttttatttcttcctctccaatatgtataccttttcttttattttcttgtcttattgcattagctaggactttcagtacagtattgaaaagcagtggtgagaggggacatccttaccttgttcctgatcttagcaggagaacttcaggtttctaactattaaatacattagccgtagattttttgtgaatatattttatcaagtaggaagctcccctttattactactttattgagcattttgttatgctttgttttttaatcatgagtgggtactggattttgtcaaatgctttttctttatctcttgatatgatcatgtgatttctcttccttaacccattgatatgatggattacattaattgatttttaaatgttgtaccagtcttgcatatctttaataaatcacagttgttcatagtatacagttctttctatacattgctggattggatatgctaatattttgttgaggatttttacatctatattcatgagagataatgatctgtagttttcttttcttataatgtctttgtctggttttggtattcctcaaagtatgagttaggacatattctctctgcttctaccttctagataagattctagagaattgatataaatttcttctttaattacgtggtaaaatttaccaataagttgatctgggcctgctgtttcctgatttagaaggttattaattattgattcagtttctttaatagatacaggcctattcagattgtcaatttattctcatgtgagtttttcaaagaattggcccatttcatctaggtcatcaaaatagtggatttagaatttttcacagaattcatttgttattcctttaatgtccacagaatctgtagtgatggcacctctttcatttctgctagtagtagttgatgccttctctctccttttttgtcagttatcctggcaagaggcttatcaatgttactgatctttttgaagaacctgttttcagttttgttgattttctccatcaatttcctgtttccaattttattactttgtgctctaattttcattacttttttttctttgcctactttggaattaatttactcttctttctttagctttttaaaaaactaaggcagaagtttatatggctgattttagatctttttttctaatatatgcatttagtgttacaatttccctctaagcactcctttcactgcatcccacacattttgataagtttggttttcattttaatttagtgcaaaagatttttaaatttttcttgtaatttattttttctaaataacacatatcttctttagaagtgtgttatgtgatccccaaatattttgaaaatttccaactatctttcttttattgatttctcacttaattctattttggtctgagagcagacactgtatgatttgtattcttttaaatttgtatgtgttattacccagaacgtgatctatcttgttgaatattttatgtgagtctgagagcaatgtgccttttgtggctgttggatgaagtagtttataggtgtcgactgtacctagatgatctagtgtttttgagttcagctatggccttactgattttctgcctgctggatctgttaatttatggatgaagggtatcgaagttgccaactataacagtgggacttaatctaattctctgggcagttctatcaatttttgctttaagtatttttacattctggccggcaccgtggctcatgcctgtaatcccagcactttgggaggccaaggtgggtggatcacgaggtcaggagttcaagaccagcctgaccaacatggtgaatgaaacactgtctgtactgaaaatacaaaaaatagctaggcttggtggtgcatgcctgtaatcccagctactctggagactgaggcaggagaatctcttgaacccgggaggcgaaggttgcagtgagctgagattgtgccactgcactccagcctgggccacagagtgagactccatctcaaaaaaaataaaaaactaaaaaatttttaaaaagtatatttacattctgttgttagaaaacagacatatatattaagaattgttatgacttttggcagggaggattgacccctttatcattatgtaatgctccactttcctgacaaattttcttgctgtgaaatctgctctgtctgaaattaatacagctacttccactttcttttgattcatgttagcatgatctatgtttctctatccatttatttttaatccatatttgtctttacatttaaagtgaatttcatgtacaacacatattgttaggttttggttttttattcagtctgacaatctctgtcttttaattggggaatttagaccattgacatttaaggtaaatatcgatgtagttcaattaatatctataatacttgggtttggttttgattttttgcccttgttctttgttcctgttttcatctttcacacatttgctgctttttgtggttctgaggattttatatgactctatcctctctcttttcttagtgtctcaattatacttctttgtttttacttcttaagtggttgccctagggtttgcaataaatatttgcaactaattcaaatctgctttcaaataactgtcacaggtagtgcaaatactttataataacaaaatattttgaatccctcctccatatacatagagtacattattattattatcatgaacaacctgttgtctgttagataaattaagaataagaaaaataaaagtttttgttgtgtcttcccttaatcattctttagcgctctccctttatgtagatctagtttctgacctatatcatttttgtttcctctgaataacttcatttaacattttttttgcaagtcagatctactggcaacaaatttcctctatctttatttgtctgagaaagtccttatttttccttcacttttgaaggatagttttgcagagtgcagaattccaggttggctgattttttttttctcccaacaccttgaatatttaactctactctcttcttgcttgcatggtctctgaggagatgtcagacgtaattttataagtgaagtgtttttccctccctctggcttatttcaaaattttttctttatctgatttaatgaggtttgaatatgatgtgcctaagcatagtttttaaattttcattttttggcatttatcctgcttggtttcctttgagcttcctatttctgtagtttgatgtctgcaatagtgactgagaatttttccaaattaatgtgtggtttggaagtttctgttatcacgtcctcacactcagagattctctcttcaaccacattcagtctactaattaaatgtcagtcaccaaagccattcttcatttctgttaacagcgtttttattccttagcatttcttttttgttctttcttagaatagccatctctcagctgacattgtttattcgctctgacatgtcttttttttcctattaaagccttctagcatattaattatactttaaaaaaattccttttctgataattccaacgtccctaccatatctgactctggttctgatgctaattcgatcgatctcgccaactgtggttttttgtttgttgcctttattaatgcagcgataagtcatgaggatgattttctgataatttcaacatccctaccatatctgactctggttctgatgctaattcagtctccaactatggtttttgtttttttgcctttattaatatagtgatacgttgtgggggagcggggaagcattctatgattaggtctcagtcttttggtgagcttgtgcctctgggctatggacttcacaagtttccgccaacccctttacgtggcacagggtgactggaggagaccacagctgtgcatttcccctcccctaggtaagtgaggctctgatacaacctcagaagattcagctctggtaaaatagtttctcctctgggtaggccttgttaagaagaacggaaggctgtgatgtatttcaaaatggtaacatttcctttctccctactagaagcaaaagggactcttttccaatatttactgtgagaagctggcagactcctggagaggaaacttgtagaagtgtgaggaccccctatgactgagtgccctggagttttcatctttcaagcttgtccacactcaacctccagaagttcgttaattacagtttagggtttcctaccctggtactggctcataatgagttttctgctcatggatttctgtttggttattaagttgtaattttccgtgtccacctgtctatctctccaatgttgccctgtggtttgctctatgagtacccttctctgatagattcaagaagagttgtaatttttcattttgctcagatttttacttattgttaggccagactgaagatacctaatctccttacatgccagatcagaaatcaggagtttatactttatttttcagttatggctttatttaacaactggtttgcaaatttcctgaaaatttaacagttgcctcttgtgagtttggggtgggaaagagaaggggctccaacacaccactacctttataccattacatcacatatttaaacatctattattgatagatttgttttaaaataatgtcagttaccaactgtctattaaatatgaaaaaaaatcatttcttctttcttcttcccccatccacacttaagcttttcatttcactgctacattttattatttaagtccaaatgacaggacttttttttaagacatggtcttgctctattgtcaagtctagagtgcagtagcacagtcatgctcactgctgtcctgaaccccaggctcaagtgatttccccacctcagcctcccagttatctggggctagaggtgtgcaccaccacactcagctaatttttgtatcttattttgcagatatggggttttgccatgttacccaggctggtcgtgagctcctgggctcaagcagtaccctgcctcagcctcctaaaatgctgggattgctggtgtgagcacattattgaataatatcagaaatactaaccaaaataattagaaaaagtaaataaataaataaataccttagaggaaaaaatcaacaacaacctttcaagtgaaggagtgggacagatctttctaagaaggaaacagaaatcagacattataaagcaaagattgaccaatagaactaaagaagaacttgataaatttgactacatgtaaacactaattcatatgagaggaaaaggggtagtagtgcccttaatacatgcttataacttaatgtttagattataacgatttaaaaaaagaataaatatatataaagggttatctaggtgacttaagcaagctgaacgggttggagttcatgcctcatccccactaaaattctattaaaaaaaaaaaaaaacgctttttaaaagatggctttcataaaaaggaatgagttcatgtcctttgcagggacatggatgaagctggaaaccatcattctcagcaaactaacacaggagcagaaaaccaaacaccacatgctctcactcataagtgggagttggacaatgagaacacatggacacagggaagggaacattacacaccggggcctgtcgtggggtggggggcaaggggagagatagcattaggagaaatacctaatgtagatgacgggttgatgggtgcagcaaaccatcatggcatgtgtatacctatgtaacaaacctgcacgttctgcacatgtaccccagaacttaaaatataataaataaataaataaaaagatggctttaatattacagaaaaatcacgaaggtagtttttcattttatttttaattttgtattgatgtgaaagtcacaaaatataacattaaccattttaaaatgaacaattctggggcaattagtgcacgtatcatgttgtgcaataaccaaaactgtctagtcctaaacatttcatcactccccccaaaatttctagacccagcaagcagttactccccactcccagctccttcagttcccagcaactgtcagtctgtcttcctctctctgaatttacctattctgaatattttatataaatggaatcacacaatatgtggctttttatatctggcttcttgtacttagcataatgtttttgaggttcatccacccactcttcttaatggcttttcaagttctcacactgacaatgtggaaaatgtattattttcctgctttattcatagcctttctttgcttttcactctctgttggtaatgaccagaatcatacctagtcctaagtggggctgaaatttttcccttcgaaggctttttctttcagttccctagttgtattaaaaaagtaaacgtagatatgtagagtaggtactgatatcagtaaggatatgatgctataatttaccatggattaaaatgattcagaaaaattacccagggttaagtatgaattattaacatttagtgaaatacagcttggggccaccagtgcactgttccaggagggctgttcacatggaggcccacagtcatagaaggtgacccaggtgcgtgtaactgcaccagtccattcccctcatgattacaactattttactttattcaactaaattttatacctatccacttcaaattcattcccagaaattgtactcaccatttgccacttttattctcagaaggtaagaagtttaaaagccacaaaacgtatgcctaaaagatgaaagaatggagtcacagtatgagtgctaaattgaagaaatatcagaaggaagaaatgaaatcacaagtaaagtgattgaaacttggaaacttattggtgttttatgaggagacacaattgctcccacagtgctatactgaagaaagtgccagcctccaaatgaaaagctgatataagagtggtgtgaaaccagtgttaagtattttgcctggaagaaattgcttagaatgagagcagtccctaaactccttagtatcatttagtatgtttacttataactattactcatcatttggcccgctgggtctccttttgtactggaacagccctgccaagggactccctgtcgtggactaattctggagagtggaacaccgctgggcagggggtctctgtgctgtgaaatctgaagctaagaggatggatggcatttagttgagtgcattcctccacggatgctcatttaatttttaaaaatgtctctgaactgctgggacggttcttcctggattttttgtagttctcttcagttacacacataactccttagagatgcattttgctagtgaggtctttcaatatgtcaggctcttttcatttaagcttagacattttagatgttggaccattgtagctgaatatttctcttcccttgccttcatgtaaaatgaccctagtgtaaagtataaacctggtttgtttgcaaggaaaatgcactcttcagtttcatgtttctgggtgaaggagtctgtcaaagtgctgcctgtcattactgataactgcagtaggtcagtttgctttactgtaacattaatttatcatgtgacttgtatcatgtaagtgtaagaatacagccaataaaagccataaaaataagtcaactgctaagagatatttcaatttttttagaaattcgctgggtgacttgtcattgatacattttattaaattacatatccaaacagagtatactgtgaagatcaggcgagaaatttgtcttctaacggcttttttcataatttccattaatccatattgtatttggtttcttactggaggctattttaagtagtcttttatcagaatcagagattttatactaatcctaccttttagttatgagcatttagaatattcgttaacaggagttgtaagttctcccaactaaacagacgtggtatattcagtttaacacagagcacatatcagaaaacttcattctagttataaggccgaacttcccttaaacctcaatatcatttgatcctcaaactaaaatcttttgagactaccagctatgctatgctttcattacggtgcggaaggaaccctgttagagacacagtatacctaagttttgggtccagctctctctaactgcctgcatgaatataagcttgttattgaacctgtttccttaactgagggaaaaaggatttgaagtagaacagtagttcttaaccaggagaccatcaaatcactttggttggttttttttttttttttttttttccgaaatatacttgtccatatctctctggcatccttcaaccccattctgatgtaatgaagctggggtggttaatttccagttaagtttgtcttggagagatgacatctctcgtcggatccacctctacaagatatgactctgaaatcacaagagctggggttgcagaatttgcagcagcaattgtatcaatggcatcaatattcttataaaaagtgtttatatctagttctagcaatgaaagtcttgaacagactttctgattaaaatcagaaaaaaatacaactttctgattaaaataaatgggttagctgtttcccaatctgttatgacaacaaacctatttctggaccaaaaatcttgatgtgtaatgtaatgtaagatatggtcccacatatgtttcagtaagaataaagaatatttaaaagtatagtggtcctcactagacttcttctcggtgggaaaattgtacagaatgcgagttctgtaacctctgcttcctttagtaaccccacctgagagccagaagaccaacagttcagaccagaaaaagtaatagaagcagaacttccggaggcttgcagatggagtgttaattggtgatctgaaaaaaagtgcttcatctctcttgtcgttaatgtttgggtctgcaggaaaggctgacttcatgaacatgtggcctgtgtagccacagagggccccaagttcagaaaggcctcgtgctgttgtaatgctctgctgtgatggtcttgaaatccttaatgtttttaaacaagggtcctgcattttcattttgtactgggctttgcaaattaggtagttagtcctgcttgtagcaatgaaactaacaccccctgccccggtaaaaccaagcagttcctatcatttttctgcttctttacttttgcctttaaggatcacttgttatttacattgttcaagcaatggtaagaagtgtcactttccctggctgcctcccacacttgaggcgcatagcaagcctgtcctcttcagttctgatgacctgcccattctaaccactgcgcctgtttcctgaacccttctccatacaccaaccacattaccaacctccccttcccatcgagagaagacgatttgcttcttaattcccagatcactctaattagaacactgcaaaaactgacaactaaagcaagtggccacctactagttctcacacactggactctctaacagtaatgaatttctgtgattatttccttgctactaataaaatactagctggaaaagtggtcaagtgaggagccaccagaattttatttcttcttcaagcatttaatagccaactatagggccctgggcatttactgaaaggcaatttcagttatgttagtaaattgctgtttaggacaacagatcaataaaataaattattaggtctataatttaggtatttacagagtaaggacaaaaaatactttttcactctgtgtattcaaagcagttgatccatgatttttggatacataatagctgtatgtatttatgagatacacgtgatattttgttacatgcatagagggtataatgatcaagtcagagtatttagggtgtctgtcatctggagtatacatcatttctatgtgttgggaacatttcaagttctctcttcttgctgttttgaaatatacatttttgttaactgtagtcaccctactgtgctactgaatattagcatttattccttctacctaaatgtatgtttgcactctttacccaacttctcttcgtctcgctcccccatgcacacacccttcccagcctctggtaaccattattctactctctacctccatgaggtcgatttttcagctcccacatatgagtgagaacatgcaatatttgtctttccatgcctggcatatttcttttaagataataactccagttccatccatgttgctgtaaatgacataatttcattcttttttattgccaaatattaggttggcacagcagtaattgcggtttttgcaatgataatagtattccattgtgtacatacacaacttttttgctgtttttctcaatgactctagagaaacatttattcgctaatacattttctttgtgttctctaacttaatgtcatcttttcatctcgcttgattttcatgcagctaaatcggaaatttgtcgttttctccctaaaaaaatacaataaagttctttcttataaattatattctctgattttcttgtcagcctgcttcaagaaaatccatgtgtgcaaaatacttgctatcagtttgccccataccaaatggctgtttaatccaaatatctgaccagcaaaccaagcaattccttctgaagaaagggtggttggacagccaaagccactgggtagtggaagagaagaccacccatcctgagctccccagtctagtgtgaggggaggacagctgatagctggagatgcagcatttccagatgtcactggtcccaaaccattatcagagtaacactggcctcatagaatgagttagggataattccctcttcttcagtctttggacggtattttcgaggagagctcttgtccgttctttgaaagtttgttagaattcaacattgaaaccattcagttttggactttgctctgttgggagactttttttactgattcaatctcactgctcattattggttcgttcaggctttttatttcttgctgattcaatcttgataggttgtgtccagaattttagacatgttctctaggtttttggtttgttagtgtatagtttttcataatggtctttaattatgtttttatttttgtagtgtcagttgtaatgtctcttttctatttctcatttttttatttgggtcttctttatttcttggcttgtctagctaacagtttattgatttcatcttttaaaaaaccaacttttcattttgttgatcctttgtatttttttaagtctctgtttcgtttagttctactctaatttttattatgtatttccttctattaattggggctttggattgttcttgtttctctagtttcttgaggtgcattagattgtttattgaaatctttctacttttttttgacataggtgtttatggctataaattttccccttagttttgcttccatagttttggtatactacgttttgacttgcatttgtttcaagatatttcttgatttcttccttaatttcttccttgaatcaatgatcattcaagagcatgttggttaattttcatgtatttctgcagtttttaaagtgtcccttgttactgatttctagttttattccattgtgatctgagaagatacttgatataattttgatttttaaaagtttcttcagacttgttctgtttcctaacatatggtctatcctgggaaatgttccatgtactgatgggaagaaggtgcattctgtagctgctgaatgaagtgttctctagatgtctgttaggtccatttggtcaagtgtgcagtttaaatccttttaatttttttgataattatctgtctagatgatttgtctcatgctgagtgtaaggtgttgaagttcccaactattatcgtattggagtctatctctccctttaaatctaataatatttactttctatatccaggtgttccagtgttaggtgcatatgtgtttagaatttttatatccacttgctgagttgatcctttttcatcatataatgatctttcttgcttctgtttactgtttttgacttaaagtctgtgttttctcatacaagtttagctattccgtttgtttgtgatttccatttacatggaatctcttttttcacctctgctttcagtctgtgtctttataggtgagataaatttcttgtgggtggaagagagttggctcattttttttttgtcttttcagccagtccatatcttttaagtggaaggtttaacctatttacattcaaagttattgttaatatataaaagcttattcctgtcatcttgttaattggtttctagttattttgtaatgtcttttgattctctttctctcctattgtttattatagaaaaccttctgtagtggtaacatttgaggttttttttttttttttccttatttgtgtgtttgctctaccagtgggttttatcctttcatgtggtttttatgatggtagatatcatcctatcacttccaggtataggactccctttagcatttcttataggaccaggctaatggtaatgaattccttccactttcacttgtctgggagtttatttctccttcatttatgaatgacaacttttctgggtatgtaatccttgggtggcattttttttttctttcagcactttcaatatatcatctcattcttcctggcttgaaaggtttctgctgagagattcactgttagtctgataggggttcccttataagtgactagatgcttttctcttgctggttttagaattctctctttgtctttgacttttgacagtttgactataatgtgctgtggagaaggcctttaggaattgtatttgtatgggaacttctaagcttcctgtatctggatgtctaaacctcttcctagactttgaaagttttcagctattattttgttaaataggttttctatcccttttgttttctcttcaccttctacagcacccagaattcaaacatttgatcacctgattgtgttccatatgccacaaggctttgttcattctttttaattttttaaaattatttttgtctggctgggttatttcaaaagaccgctcttaaagttcggaaattctttcttctctttcatctaatatattgttgaagctttcaaatgtattttttatttcatttaaggaattattcagtttcacaatttctgtttggtccttttctgtgatatctatctctttggtaaatttctcattcatattctgaattttttttctgatttctttgtattctcttgcatttcactgagtttccttaatatcaatattttgaattcttttttcaaggatttcataaacttacttttgattagaatatattgccagaaaattcttgtgtttctttgaaagtatccttgtttttccatgtttcttttgtccttacattgacatctatgtatctggtgtaaacatttcttcttccgggtttttgaatttgctttcctaaggaaggactctgttaaagatgaatctgtggtttaggttgggtaggacactttggctttgattctggatgcttgcagtagtgtaatcactgtgtgatttatttggctgtaaatagtatcagtggtgtcagtgatttcctcagtgactgcagtgtctgtgatttcctcagtgatttatgatacagtggaggctgtgatgaagattttctggggacagggacaacaggtgggcctgtcctcaaaccccactggtggccagtcacaggccaaacatgcctttccttgggccccagggcaacatatgctaatatacctgtgttagcaggctcaggcaggccattcttgggcctctaggtggcttgcccaggtgctggtagtggcaatggtgggccaggtgggtgggtaggttatcagacctctgggcagcagcatggaatgggtgatggcagtagcaatagtgagacaatcatctagctctgaagtgatttgcattgtttgttggcattggctacaatgggctgggaaggccagtctccagtcccacctgtggtatgtgtacgtgggtacccagtatggtgattgcattgttgtgggcattggctagaatgagctgggcaggcgtgaactcaggaccacagaaggagtaccctggtgctgatggtggtcaacttgggtaggtggtttccaggcccttggatgtcatgtctggacatagagtgggggagagagccaggactggtggacctgtcctcagacctcccagtggtatgagcaggtgccagttgtggtagacaggggtggagtgatccacatgtccccaaagaaatgtttgagagaaggcagcagctgcaaccctgctactggggaaggcaaggttgctttcagtggcagcagctgtatacatgtgtttagggaacacacattttcttcaagcttgaccctgggaacagcagtcacttgcagtgacagcagctgtgggcaggagagtttgttcatggggcacatgaaaatgcatggcagctttgttcctggggatattggggtcacagtcaatggcttgcacttgaatattggctgcaactagctgccagccatgacatgcattggctgcaggtgaggaatgtcaataggacaccagggatgtggtgatgcaggtaccgttggacctcccaggcaggatggtaggggctaggctttcaatatggtgacttgctgtagctgcctagggcttgggggcagagggtgtgactcagcttgagctctctctggagcaatgccttcacttggtctccttgcagcttcctatgttagtcttggggcccactaggtcctagggactctcctgtgtctaggattgcatgagttcatggtgggaacctggactgttgggggtcactcacttacccttttcctccactggggagccagcctctccaggttctcagccaatgctagccaagcaggcagcctcacttccccttccttttttgttttggttgtgtcctgtcacttatctgttgaattctaatgttctttcataaatgatctattcaaagtgtgatcatctattcactgtttttgttcttctctgtgtaagagacacgtagcagatgcctctagtcagccaccttgcaacccctctgccatgcagttaatacatgattttttctacttttggatggaattagataaggcccaagctaagaactccatacagcccattttgtaatatgatccagacacagagatgcactgttcagatcctcgttcaaaaaacgacccaccgcatagctgagagggatgtggtcagctgatgcctccagctgttagatccttcaggatctgtctcagttttcaaaccaaggttacgctcttctctcagtgatctccaggcaatggccgagcagaatgatggtacaagggccaggtcatcaacatcccctacaggacttctccatcaggttatctttactccagaactcccctttgagctggtaaagaattttagatctgcactgagatctgtcagcttcctatgcccaatcccgcatcttacttttttctttaattggttttacttccaataaaactcttgcaatcctaactccatctcagcatctgtttcccagacaacccaacttgcacaatgtccttacagtaatgcaaaaatgaatttcacagagctctttttgtaaagatgctgatacatgaagtctcaaatttcatggacgtgacataaggaaggcaacagcttgggaagaaaatatgagaaatagcacttagattgggtttattctagaagaaaggacacctcatctaactttctagtagtcctctataaacactgttcctctggactgggcgtttgatacataccgagcagccttgttttcaaggttagagtccctagaaaatagatgatgttcagagacaaacctgtctaggtactgagaactctttctacttgatgtctgattgccatctccaacagattatattttgggatgaattattcatctttagcacataagtaatctttcttattttcttattatctttacaaatcagtgtaatgcccagaaagcccagtgtacaatcaaaattttagttgcttatttttttcttttgctcctttatgtccaactagttactaaattatgtttatgtgtctttgaaatcttttgccttttgcttgtcataagatgcccaaaagatctgtcttttggccaaactccatggcagagataggctacagttgtacaccagtttgtacagtgtacaaaattgtacaccaactttgttttctttttctcctgtgcaagataaccagctggcatcctacaaaacacacatgaattttaaatagaatttgtgaggaggtattgtttctgcatgttggagttcctgtaaattacatttacaactctttattggtatcataatgttgatggagaaatagatctcctaggaatatgtgcactgaccattcaactatccccatagctaacattttggatgcattttaagcttcttagcttagcacataaatcccatcataatttatcctctgtttcccaccatcaccactcctgaaacacagcctcacagactatttactctagctataaccagttataatgcttcatgcttcatatatgctatttatcttttcaagaatcctttcttttttgccttctgcttaaagacaacttctacaagccttcaaacctcagcttaagcattacttcctatgtaaactcttttgtgatctcctaatttgactctttttccctaatgcatttatttccattggatctcttttatacttttatcataacattgactataccgttccctaaatgttgctcttttagaactataatcctatattatttgacttcatatataaatgtgctctaaaaatgttgaatgaatatggtgagttttccactttgatatcttcatgctgtcttttaccccagggcctcaaattagccatcagaacagatggcttataagaactggtatgctaaaaagtaggtttaactgtggttgtggacatgcttctttctcaggggttccatttctgaagtggaaattaatttgatgcttctctagagtgatgttcagattaatgttatgccatttgtaaaggcctctaggactctcagatgaagggcatttgatattagcctcattgttactcgaagctgttgtagggttcatctatttgctactcagcaagacatttgacattctcgtaatacagcacatcccaggattaattaagagatttccggaagtctcaggaatacacctactttgacatcaatgtgctgtgaatgttgatcttggtagccttactttgaatagctatagggtatttaaatagtaacctaacttacaattaagactgcttagtccctgtaaggattctgagtggaatttagcaatggataatgaatatattctccggagtcttatactgaatttgaaaagaaacccaaattcctgagctttagtcacttaactacaacatctttctacataaagaccataagctaagaccatagaagagagagctcatgcatacatgagtacagatggttaccaaagtaaggatctaaaattggactctgctgtactcacatcgaagctcccaatgtacgaagggatgaccttccttcaatggctttatgcaagggtcaaaatgtatttgaactctggagcagaaaagcactgctctataggatttccaagtgttcattatttaggaggtcaggaacgatgggagcatgtggcaatccagacagctgcagtccccacagacctaaaagaaaacagctgccagagcagccatttctatacaaaatgtctcatgaccagaagctatggaaataaacggctagaggcagctgtgcttccctcttgctaaacactcaaagattccatttttaacacaggatgtctattattaagacaatcagctaagatgtcaattcaaaagccacaaagttctgcaacataaatactgtactgacttctctcttctgttgtgtgggaccatggcttctttccctgtatgctggggacactacttcagaataatcaagtgaaaatactgcttttttatggtaactctccattcaagaacttattataatagtgttataaaaagactgtaatcttatcataggctgtatttgaaaattaagatcctccacaatctggctctatcctctttctcaaatcaatttctcattactctcaatacaaatgctatccttcaggtaggtaagactcttcattcttgctccacgtttcttactcacgttccttcaggcaaaaatgccctgtcagacacatgaaaaaaatgctcatcatcgctggccatcagagaaatgcaaatcaaaaccacaatgagataccatctcacaccagttagaatggcggtcattaaaaagtcaggaaacaacaggtgctggagaggatgtggagaaataggaacacttttacactgttggtgggactgtaaactggttcaaccattgtggaagacagtgtggcaattcctcaaggaggtagaactagaaataccatttgacccagccatcccatgactggacatataccgaaaggattataaatcatactgctgtaaagacacatgcacatgtatgtttattgcggcactattcacaatagcaaagacttggaaccaatccaaatgcccatcaatgatagactggattaagcaaacgtggcacatatacaccgtggaataccacgcagccataaaaaggatgagttcatgtcctttgtagaacatggatgaagctggaaaccatcattctgagcaaactatcgcaaggacaaaaaaccaaacaccgcatgttctcactcataggtgggaattgaacaataagaacacttggacacaggaaggggaacatcacacaccggggcctgtcatggggtggtgggaggagggagggatagcattaggagatatacctaatgtaaatgaccagttaacgggtgcagcacaccaacatggcacatgtatacatatgtaaccaacctgcacgttgtgcacatgtaccctaaaacttaaagtataataataaaaaaatttttaaaaatcccctgtcagtcctctctgcccacccttttgacatttgatggtaaagcccaatctttcctctgcccacattagtcagtgatttctttaaatttcatttataacgatccctaaacctcataattccgcaaccaattacatgctagtacacgtgattctctaatctgtgtattttaatctcatctcctaagaacacggtggcaagatctgtgttatttactttgaggctgcatcccatttttttcttttgtgtttttttaattgaagtgaaatttgcatgtaataaaattcacccttttcagtgtacatttctatgagttctaagaaatgcatgcagttgtataatcaccactacaattaagggatagaacagttcgaacaccctaaatattttccttgtgactttgtagtcaaacctctcccacctgcagccactgataacctgatccatttcctgcctctatagttttccatctatgaaaccatgcagtatataggcctgtgtgtctagatccttttacttagcataatgcatttgtgatcattcatgttttatgtatcagtagtacattcctttgtattttgggtaataattcattgtatggatacacctagcatgtttatacatttaccggttggagaacgtttgggtaatttccaatgtgggaccataaagccactataaacattctcacacagatttttgtttgaacatacgttttcatttcacttggaaaaatgcctgggagtgggattgctggattgtatggtaagtgaatgtttaaattgatgagaaactgctaaactgttttctatggtggtgtagcgttttgtttttagaccagcaatgaatgacagatccagttgctcagcatcttagtcattctaataggtgtatagtggtatcacataatggttttaattagcatttccctaatgactaatgatattgagcatcttttaagtgctcctttatgttctatattttttggttatttcatagtactagcaaagtactaacaatgtattagatgcttaacgaatatttgcagattgttaaattgcagatcattaatactactctcttttgcatgccatttgcatcccattactagctgttaccatttattgagtacctactgtatgccaagcgctgtagtaagtgctttatatatggcatcttattaatacacataagaaccctatgaatgtgctgggtggtattgttcccatttgataaggaaaagggacaaacagtgctgacttgtgactctccaaatccttctctttccccaggaattttgggtttgcttgttcaggttctggaaggtttttatactactgctaaggatgagtgaagaggtaaatttaaataatccaaaacaggctgaaatgatccacatgataaagagataatttagaggttagtggggccatgaggaagaaagggaaaagtacttgggagaggcaagggaagtatagttgtggaggtagaagagagagaaagaggttctttgtttgtgtgtttgtttttgtttcagtttttgttcaaaaaaaaaagacaagagggagcaagaattgtgaagaagactgaggggttagagggatgaagagagtgtttagtatgctaattatgaaatattctctttttggagtttttttgagtgaataagattaaaacaaggtttttagggaaaaggaattggatttttttatattgatactagtataagccatagagcttattaatatttcaacagttatacacacccttacttgtgcacgtgtgtgtgtactcatgtgtatgtatatgtagttttatgcagtttattaaatgtgtagatatgtgtaaccactaatcaagatatttaactgtaccattaccagaagacttcattcttcattgtgctacttatttacagcggaatctacaccctcatcccttacccctggaaaccattaattgttttctccatatctataatgatgttatttcacaaatgctatatttataaaagtatgaagtatgtattcttttaagatttttttcacccagcaaatttttttgaggttcacgcaagatgttgtgtgtatcaagttcttcctttttcttcctgagtagtattccctgatatgcatataccacagtttgattaattgttcacacattaaagaagatttgagtagtttatgttttggactattaataaaactgctataaaccttggtttatcaatttctgcatgaaattaagtcttcctttatctaggacaaatgtccacatgtataattcctggatcacatagtaagtccatttttatttttattttaaaagaaactatcaaactattttacagagtgactgtactattttagattcccatcaggaatgtatgagtgattccgcttatccacatccttgccagcatttgatgttatcactatttttatcctagtcattctgataggtgtgtagtaatattttgttgtggtttccattttaatttctctgatgactaatgatgccaagagagttgtcatgggctaatctgccatctgtatagtctctttgtatacacgtcttttgtccattttctaatttcatgtcttttgcccattttctaattttatggggtttttttagtattgaaattgagaattatttatatgttctagatactagtactgtgtgagatagatgatttgcaaatattttctcccagtctgcaatttgtcttttcacccttaacaggctcttttacagaatactttttttttattttgatgaggtccaatttatcaacttttcttttaatcatctatgatttttggtgttaagtctaagaactctttccttgtcctgtatcttgaagattttctcctatttctttttctagacattttatagttttgtaagctgcgcacttacatctatggtccatttttagttgatttttgtataaggtgcaaggtttagatcaaggttcatttttatttagctagttagctatttgcctataaatcattgcatcgtcatttattgaagacttttcttcctccatcagattgcttttgctctatttaagaaaactaattgggtataattaggtttttatttctgtgagatgcaacttgtaccaacactggtcacaagagagccagttcttactctggttaaatatggatcaggaaactgaaactcagtttaagtaacataatatagcatgtatccacctactacttggctgtcctttttacaaagtttgtaaatgccatgttgaagttaccttgttttctggggtaatacccaaggtttgttgtcttatgtcacagatatcgaggatgcagacacacagagtgaggttaacagtgaacgtttaataagcgaaagaaagataataggtctctgctacagagaacggttctggaaaaatgggttgccagtccacagtgaaatgccaggggctttataggtgagctggtggtgaggcagagtctgatctacatagggcacaaaaaaactggttaggactaagtgtgccattggcatagggcgcaaatttctggcagctcccaccctaagcttttattatgcaggcgagttctctgcctgagctgagccatgttgccaatttctttctttctgtacatgtgctaaccaaaaagggaagatggagcttccatggtggacatgcctggcccccaggtagcccttttctattgacgcagctaccggcatcccccgtgcaagcttccagcttccttatctatgtttgcagctcgatttttcaggctgctgtttgtcaggaaaagaataatttcttgggctgctttttgttagaagggaagttctgccgaggactctgttgccctcactatctgccgaaataatttctttctacattctgtatcagtattgctaggatcatgagttggacagtgtgttacacaattttttagatatcaaagtagtatttatatgctttattaccacagcaaaactaacccggtgctcagcttgaggtgaactttacattgatacctttcccttctctaataaagcaagtagattgggagctacatgcttggcaaatacataacaatcttcttggtatgtttccaaaatattttgacaacaatatcagtggaattcttggagcttatcaccaaaatctgggtgaagtaggcctttctatttctaaagaaaaaaaaaggagagtcaatcacctttcctttaggtcctatggctggtatttaaaaggctgagtaactatgatttaaatgaaatgtcgtatttttaaaacactgaaagctgcagtgactacaggcctggggaggttcactctgatttgctgcccatcagatctgcagaaggcacacactaattcccgaggcgcagcattgtaagacttaacacggccaacactaataattaggcctggttgaaaagtggcagagaaatgctcaatttaccagcagtatcctcacctaatttcatatatattttctaatttgactttgagttaggcagtatcccatttcatggaaatgggaaccagattcagaggagggaaatagcagagtaaaatggcagatctgtatctgactccatagctaatgctccaccttggggttttatttcttccaatttagaatttacggtgagttatagaacttacactgcaacttaagttaatatcaaatcacagaatatttatcctggaagtaactccagggtctcactggagagtcttaatgttaaaatatactttcatactattgatgaaaaaaattttgaggagaatttaaaaaagcaaacagccagacatgggcagggcggggcacatgcttatagttttagctgctcaagaggcggaggtgggaggggtgcttgagtccaggagttcatagtgagttatgatggtgccactgcactccagcctgggcaacagagtgaaaacccgtctcaaatacataaatacatagcaatgtaaaggtagcgcaaatagcctaatttcctctgttttttttttctgaattcactcatattactataatagtaccaattatatactttattatatctaattgtactcatgtcccttgtaactaaataactccttgaaatcaaggataaattcatagtcatctttgtaatcatattgcttgatatagtatctgatgtatgaatgttaacgtcagcatgattaattgtaattaaatgtgcctagccaagttaatttatttattttactttgaccgtggaagcacagttgtattagccatggaatgctgcctcaaatacctttcatatataggtataggtagggtaaaaagctacacagaacattactaaactccagctttcatagtcatttgtatgagcacgtactacacaggcaattaatgtaactgtagctatttttatacatggaaacactcttaagggaaatgatcagtttcttaattaacttgtgatgaaatgcatgatgttgttggaaaatatgtattctgcctggttttaactgactctataatattattaatttattaatatttccagtttttgcataagaatcactagtactttttaaagtgaacctcttacaaaacaaaatatatttcagtctttagagagttaagtcattagacatagcaagttcaaaaagcaggatttgagatcatttttggtaagacctgttttgctgactcttcttgttatgcaaatggcattttctcagttttgtatcctgggtaccatgtaaatggatagagaatgatgagggttgctcactgttggttcctataaaaagtaattactaaaaaacataccacatagccatttacaaatatgactgctaagtttatattgcagagcagcacttcctgagcccaatgtaataatggcttaatctaattacatacacatatgcttgttaacacatgtaagtttccagtacacaataatagtgctctatatctcaagagctttagtattactattgcactgagacataaacactttttaataactgtcctttaaggattttcaaagaaaaaacaatctatgaaaaactctgttaacagggagttcttaggaagaaaataaggaataatgggcataaagagatgctaatattttgtgattgtcttgcagcaaaatgttattaaaagggatagttaaagaggttattatttcacctttgcaaatactaatgggtgctcttgcctccttcattgaacttttagctctccaaaggaattgcagtggtcagtttgttgcagaagctgggtacctaagcactgccaaatgccccacccacagatctctactccaactgcaaacaagcccaggaaggaatgttttttctctctctctcacattcgatacaactgctcaatctacttctctctggtagacatagctccaaaaaccaatgactgattgaacaaattaaagggaatcctgccactagaataaaaattattctaatctggctggtatttttattaattatattcttacataacaatctggcagaatttgagtgaatctgccagcttctgtacacagacctcattgtctctaaatgattcacctaactgccagtggtcataaatacaataataacaacagcaaccaccggagcaaattaaaatgttttacactggtaaacagcgtaactgtttggctgaaactgtcacttaaaatcttaaattatctcactaggtaggggtatgaaatttcaacacaactagggaactaagtctaagctatttaatatttgaataatattaaaaacaagagtaaaatacttaaccatgctgtaatttcccagcattcctcttgtagccacccgcactgtgacttttgcctttctctcttttttcacttccattacctcctctgtaattgaagcatccacctctttatatttccttcaacagacaaggttttattttccatgtcctttaccactactgtgattgaagatttcctactttctctattcccatcattcacatcaaagttaatatgttcccgccttgtaacacacccaccttgtacattttaattaagacaggcactcctgtattctgtgtgttcatcacctgatcttcactcatattcttctctttctgtttttttcttatactcaatgactattttcactcttccccaagattcacgttttataaattccaattttcccaaagcgaagtgacacacatgttccttttgtctaaactgacctgtatgctaatgactcttaatttcattctaagaaaagaagaaaagagaggaaaaagagcatttatggtatacaaactgtataagcatgcccactagacatactgttatgtctgtgggagataagctgttctaaaaataattcctcaaaagcaaatagcagactctgaaggttaatgtaatatgtacagcattcccatttcctttctttctgttgtgttgaggatcaccaaacaagctaatagccctcaagtgtgggatcacgttaaacaaaaacaggacattttgattcatggatgtgccaagttacaaagtttatcctttcaaaagtttaatgctgagtgatatggttaggctttgtgtccccacacaaatctcatcttgaattgtaaccccgtaatccccacgtgtgaaggaagagaccaggtggaggtaattgaatcatggggacagtttcccccatgctgttctcacgatagtaagttctcaggagatccgatggttttataaggggccctccccacttcactaggcacttctccttcctgccgccttgcgaagaaagtacctcgcttccctttcaccttctgccatgatgaggcctccccagccatgctgaactgtgagttagttaaacctctttcctttataaattatcagtgtcaggcagttatttatagcagtatgaaaaaaagactaataccctgggtatcaaggtctttatggttttcatcaggataccaagttctagcccacagcctgtgagttatagggtggcttggtggcttggtcatgatgacaaaccccatcaattcccaaatatgttgaattaattaattaacacattaattcaacaagtatttatgcagtgccttgtctatgctcagcattctgtgagatactgtctggtaaacaaaatacacctaagacatagtgtcttacctgaaatagaatcctagggaattaggtgggcaggcatacctaatctgtaattgagttggtactaaaatcagtgctggtttctatgttgttgttgttgttgttattgtttggggtttgggcttgggttttgggttttcctgtatatttccacttgagtagtaatgttacagtatgtttgtttatttgtcttgtttgtttttggttttggacttggttgacaaaatcagaatatatatgttatgggtttgcagttttcaatcactttttaaccctgttaactttagtctcaagtaaacaaaaaattactgagacttctataaatctaagcaatgtcaggttcagaaaaagggtggcatttgtggtgtatgccttttcactcccctttgctctagtatctcaggctttcctgtgtcctccaggctgacatttagtcccatggaaacaagacttataaggagcattactctttttcattccattaaaatttaccttaacgttgtgccatttcttccaggagttccctttacatatttctgtcatctaaaaaataaatcagtttctctttaaattaaaccttcctggctcctttgccccattgaatcctggaggaaaacaggaaattaagtatgaaattcaggtattaattaaaataaatgctcatagtgccctattaaattggctgcattttgacaggaacactggttcaagagttacctactctcaactgctgtaatctatatacctccatcatttccaagcatcagtcaagttctgaaacacggacttctaacttcataggcaattgtttaccagcgtttcagtttattactaaacactggaaattataccagacatcttagtcctggatggggcatgcccttctgatcagcaagtctgttcagttataacccaaaacgccatacagtttaaggagaatgaaaacagaggtaccaaaccttttgaggaattgtcttttccacttttagctgtttctatctaaagaactggggctagccccaaaccatcagcgtgccctttcctcatggacagtgtgggagaaatacagaccaatcccttctctttgtggatttcatgcagtcccactcttctaattttatttgtcagtaacatgttccagtttctgagatcacaattaatcttacattaattacattttaaattaaccacaatatgctctttcagcagcacttaaaatgtcatcagcaagacattgcataaatcattgttgagcgtggtttacttgtgaggagatttatgtagatgataattccttaaaaggcacatggattttttaaaactcttatcaaagtatgatatttctggggttcgaccacagttacaggaaggtcatagtgtatccggcagtttgcacagcccttcacctaattttgccaacaagcatatgaagggaaatatattttcttctgtgattatccattttgtgttttgtcagtttcaatgacttctcttccagatttatgaagtttatatggcactgttatgagagacctattccaactctgccttttagtacctccagacccctaatgacacaattatgagctttctcaagtaatgttattgcttaaacctttaaagtctcccaaagctcggagcactatttgcaaatatgtagtaaattaaactgcaacacctgctactgtgtagttgtgtcacaggtcatttcatctctctgggtatcagtttcctcaaatgtcaaaataaagggaagctagaatcactgtaagatcttctgcaagtctaaaattctggtattctctgaacaatgctatagatagttgactttcactttcctcatatcacactgactgattgatgttgattcttatctcaaaaagtaagatttctagctctagagagaccttcaagattgtcagctctaacacctccattttgcagataaaggaaacttagggcttgagaaatgaagtgacttctcaaactttccacagtcagcaagtggctggcactaaatgccaactctcctgctactgataaagttctctctcctctactccatgaaaaaaaaaattcttgcatttttatttaagttgaagatatttcaaagtaaacctgatcaatgaaattcaactgtgaacacgtatgtcagaatattacagtcaggaaacaggaaagggggatgaaaaatggcatgtgtagtaggacccagacagccaaattaatattgattcaaagaaccagaactgcaatgaaataaggacagaactaaagaaattcagaggtttggggaaaagaaaaaatttaataaaaatggaaataagactcagacaagcacagctatgcttttgtcattgacattcagtactattaagttcatcttcatcgggacattggtaaggaaaggcgtgtgatctctttgcagactgatagactttttggccctgtaatgatagactttgtctttttttttttagaactctagttgcaaaactctgcttatacgtgaaaaaaagatcagtctgcatctgtccctgttgctaatagtaaccatctttcaaatattgccagcttttcatatcacaagcattttggtccaactcacttcacctcattcagtcttcgctactcaggacttccttttaattgacacacaataattatacatatttatggggtacaatgtgatgtttcagtacacatatgcattgcctaacgatcaagtcagggtatttagcaaacccgtgacctcaaatatttattatttctttgtggtaaacacttttagaatcctctcttttaggaattctttgtatagtttcaaggcttctgccacctccacagaatgctttttggttctctctgtgatctgcacagtgtattttttctcatttcatctactgcttgtcctacactttcatttcttcatagcactcctgatgtatttcaaaatctttaaaagcattactggtaatcatcataataataataatgaggctataacattttccataccacagtcttagaaatcatctagtttattacgttcaaaaaatttcccaaaagaaggcctaccaaacatgtaataaacctaaaaatgtatcaggcactagttcagaggctgcatacaccaatctgatgctcataaactcattctagctatttgtacaatacaggctttcttctccaaggtttccatagagtcctagaggaattattagaatcctgagccggaattaaatgaaatgagtgttaaactgtgatctggtaaattgaggtagatggtgcaaacagctgattgttaaaggaaagtatcctcaagcctcacagttgcagggtctgttttataatctcatatcctagttttgcctatttggccattgaaaaccaatccaaacagcctctttaagtgacagctagattcaattcctgttgaggtgttgttgtttaaaccctctctccagagagcttcagtgggattgaaaaatacttgttccctggaagctacagtaggaatgctctatgatttgtgcataatacatatgataatctgagctttaaattaatccctaacccttctggataatacgctgcaggtaatttctccttcctatattacactgcggaagctagaattcagaagtatagtcttgctcaccttttaaggataatagagcttcaaaacagtattgcaggaagcaaagtggaataaacagaaaactgtcaaactagatgccactactgtgagttgttgaaaaggttaaatgtcagaagcaaatataattggatgactggaatgaatgactaagtgctttttacactaagttgcttgtttcacaagcaaccctagacccttagaaacagggttgatgaagtcaaagggacggccattctgtcttgtctttccccttctcagatcagcagaaaagcagcagaaaaacatggtgttggattgtagtccctacagatttggtacttccaagactctcccactccagcaaaaagaaaggacactcataacctttcctttttttctactccatggtaaaaatctagagatgggtatagtgcaaaatattcagattttggagaattattatccattttgtacttaaaaaaaagaaatcttttgagaatttaaacccattgtttaataggatctcaaataaagcaattgcactaaaattcaagccaaagaagccattaagaactgatcatttatttggaggaattaatgttattttcctttaaggaaacaaagataagaagcatagatgttttaaatgcagttcttaaaacaatcttttcttcttaatgcttcagaaattgtttatgatcaaaagatgcttctgcgtttttatattaaagccctgccttgggcagggagcaaggagaatatatcattattagtgggaagctcgcaagaaagatgagtgtcccccactctctctcctcctctctggagtccaactgcagctgtaactttggctctgaaatttgaacaagggaggaagaaggctggatctggtgtcaactgtgaacgtgatttcccccaaggcaagagccaccccaaacagggcatgtactttaaattgcttttcgggtaaaggtccgaggtttccattgaaccagtagcctaaagttgtgaacccaacacgagacttcctgtattcccactctgcttctaccacaaaccagttttaggagcttgaaaagatcacagagctgctataggcctcttttctcccctctgtcaagtgaggaactaggaggaggtggcttttagtctttttcagtttctgactgtgtgaaagctatattcttcctgactggtgaaagctttgtatattatccctcacaagggatgttttctttttaacaagaaaacaacaggagataggtaatatcagcaaatactgcatgatttctcgtataaaaaggcatctaaaataatcaacagtatggcgatagagaatagaatggtggaagggcatggaatcagggggataacgagagctgttactcaataaatataaatttattcaagatgaataagttccagagatctcctgtacaacgtgatacctatagtgaacagtaaagtattatatacttaaaaatttattgagagagatcttgtgttaagtatccttgtcacacacacacacaaagaggacacaagaagacttttggcggtgtggatacgtttattacccaggttgtggggatgataatgtaactgaacccaggactggccacttgctacttaaaagccagacatgacagacgagggttggtaggaggaaaatgaggtttatccatagagccagtacaccgcaaagagggtggactatagcctcaaagaccatcttaagtcagcacaggtgttaggctgtctttatgttaagggcagggggaagagaaggggaatctagatcaagagctgaccaataactgcagacatctgggcagcagcaagggtccgagaaggttgagaacgtctttgtcctgggtcaggtcacaatgctcctataaatccttaacaaaacagagttgtttacatacttccccctttaatcccagatttagttgtaaatctgatttacaactaaatacatgatttaatgtaacatcacatacatttctgttacattaggattagagacaagttctatttagaaataacttcaacagtttttatattttattttcacattgaaaatcggtcagacttgcttcagcctcaaagagcatgtttatattataattaaatgagcactggtggtgagctgtagtttctgtttctaaatgggaaatgggttaaaccaaaatgaagttaattatattagtttttttgctgtttcactgttacagtaatgctagtgtgtagacatacatatgcgtatatgtatatgtgtgtatatatatatatatgtccaacctcaacaaaattgtatacattaattatgtgcagtttttagtataccaattagacctcaataaagctggaaaaatgacaaaagaagacagatagcatcctgagtgcctccccaacctacctgaaccccagtagattggtgtgtaggtaggaactggacctttcatctctgtcttcccaatgtccagtacactgggcacttagtaggtattacataaatgtgtgttactggtcggtttaaatcaacaacctgatacctttctgagagtagaatatgagacctagtttaggtaccaggtaaagagattctaacctgctttctctacgtaagactaacctcaccctggccatgttaattccaatccttaatcttttaatctaatgagttaactatcagttgtataatttttatctgattattccaattcatcacatttaattatcttactgtttctgccttccattagtgaggaggagaaaacatttgctaataattttattatgtagtagggactgtagtaagtactttatatatcccatcatattttatttaacagcattctcaaaaacactgaggtagaaattatgacacttattttacaggtgaggaagcagctcgtagcattttagtaacatgtccagattctcatcactaagcagcatcatagctaggactggaaacaagcctgtttccaaagcctgctttttttttttttttcctgcgctcactgcactggagttttcttcccctaccaaataaatcaacattatttctgagattgcataatgggagtatgagggacttggataggaagcagagaactgtctgaaatgacattttctaatattggtggtagattgcattgatccagtgagatgaacatctccatctcactagccacccctatggtcatcaatgtgcatcttgttatgtattttggtgcacctagtggtacaaatgagaccacaaatcttattcttgtgtaaagcatcagattgttttgggctcgccatccatgtcttttgcctcattagagccatattctactcaatccagtgagaaaattgccatagacgacttttcagataacaatgatgaatactactttatatatgtatacacacacaatgtgtgtgtgtgtgtgtgtgtgtgatcaattctttcagcttagtaaaacaaaagtgttagcagaatttttacattcaagttttctgacagtcataatggtaaataaataactctaattctgtttctcaggtgaagcgaagttcggaagttgtcaggctactgaccactctgatggaactagcaaggaaatgtgtgtcatatattattttggaaaaagaggatttttaaactgaattcttaaagttgtgaagagaaaaactgaaacctattttctcctcttggttaccagtgtccatttagcgcccagaaatatcaaatggggatcagagtagccctaaaatgatgccataacacaccttgcaagtttctttcattgtgaaatttgtgagtctgataatacatcttttttcatgtttctagttagcccctttattgcatgattaataaaagcaaagggatgaaggactggggaactcagtgggcaatgtatgcgataataatatctaatcaatttccttctgcaagtttgattacattaagacttctggagaagaaaattgattggactcattcacttgggaacctttcaggaaacaaagtgatttcttttagttttctattgcaactgatattatgggcctagagccaaggaaaaatgaattgtcctatcctaatcaattacttaaatctggtttttataccaagtgttcataaaattggcaaagcattgaatgggtggaaaaatgctaaacaggaaatagaaaaagaacaaatcaaatttaagtaaacaaggatgaaaggaaaattatatgtataatatatattatgtataatgtatataatatataaatatatatttatatattttttgagacagggtcttgccctattgctaggactacagatacacactaccatatctggcttattttgttcattttttgtagagatgaggtctcactatgttgtacaggctgatcttgaactccagagctcaagtgatcctcctgcctcagcctcccaaagtgctgggatgacagttgtaagccactgcacccgggaggaagaatgcgtattaaaggaagtaatttagccttatctcacctcaggtgtccagacatttattgagcacctactatgtgtccggcctttaactagatgttagaagtctaaaggtgaataaatcatcatatctctaactttaagggcctcccgctctaataagaaaacatgcacacacacgcacacacacacgcacacacacacacacacacagagttgtgaaactactagatggatcaatggcaaagatgaggatagggaacaattatagcacaagaaaaggctcctaattcatagaattaggtaaaaaggtatttgctttgaggcaaaaaaaatacatcagagtgtacaaaaaagaaaaagaaaaactgtgtggaccacaggattttgtaattgctgagcatgctgtgtgagacatggaagcttacaacatgaggagcagtgagggtaatagagaagatggattgtagaaaatcataggtgctgctctttgtgaagcaggttgtacttcaggcagtagaaaaccactgaatgtttttaaatggtggacaatatggtcagatttaggtgttgaagggatgattctggcaccattatagaacatgacttttactaggaaaagatgagagaaaaaagaccagtgaggatatagagattttccttgtatgctgcaaatggaattcctctttcaattttattttgaaggatctccactggatttaagtagtcaatgaattaaaaaataagggagtgaataagaaaggaggaattatagctatagccaacaattaatatctatggctatgaagatggaagttgacttcattgagcaaacaggaacacacttttagtatttaggctaatgagttagcacatctgatcatttatcttcaatctgtccacagaagatcttttgaggtaaaggatttccaaagaagtgggcttatgtcaaatgttccaagatcttgaacaattacggtcctttcagaagggcagataaaatccaatcacaggcataattgttttattgggttttgctttattgagcttcgcagatactgcacttttcacaaattgaaggtttgtgacaaccctgttttaagccaaccctattggcgccattttcttgcagcatttgctcacttcatacctcagtgtcacattttgataattctcccaacaattcaaaatttctcattattattatatctgttatggtgatttgtgatcagtgacctttgataatactattataattgttttggggaaccatgaactctgcccgtacaagacaatgaatttaatcaataaatgttctgtgtgttctaactgctccaccgaccagccattaccccatctctccctctcctcaagaccccctattcccaaagacacaatactgaacttaggccagttaatgacagtacagcggcctctaagtgttcaagtgaaaaaaagagtcacacatctgtcactttaaatcaaaagctagaaatcattaagcttagtgaagaaggcatgtcaaaagcaaagataggcccaaaactatatctcttataccaaacagccaaggtgtgaatgcaaagaaaaagttcttaaggacattgaaagtgctactccagtgaaaacatgaacgatagaaaagtgaaacagctttattgctgatatggagaaagttttgatggtctgcatagaaccaaccacaacattcccttaagccacagcctattccagagcaaggccctaactctcttcaactctgtgaaggctcagagaagtgagaaagctgcagaagaaaaatttgaagctagcagagttggttcatgagatttaaggaaagaagccttctctataacgtgaaagtgcaaggtgaaacagcaaatgctgatgtagaagctgcaacaagttatctagaaggtctagctaacgtaattgatgaaggcagctatactaaacaacagagtttcaatctagatgaaacatctttctattggaagaagatgccatctaggacttctatagctagaaagaaaaagtggatgtctggcttcaggacttcaaaggacagaccttgttaggttacttgaagttgaagccaatattcacttactgttctgaaaatcctgagactcttaagagttctactatctctactctgcctgtcccctagaaatggaataacaaagcccggaagacagcacatctgtttatgcatggcttactaaatattttaagcccactattgagacatacatagaaaaaaaaaagatttctttcaaactgttagtgttcattgaccttgcacctcatcacccaagagctctgatggagatatacaagaagattaatgttgttttcatgcatgctaacacaacgtctattctgaagcctgtgaatcaaggagtaatcctgactttcaaatcttattatttaagaaatacaattcatagggctagagctgccaaacagagtgatttctctagtaggtctgggcaaaataaattttgaaactactggaaaggacccaccattttagatgtcattaagagcatttgtgattaatgagagggagtcaaaaggttaacattaacaggagtttagaagaagttgattccaacccttatggatgacttcgaggggttcaagactccagtggtggaagtaactgcagatgtggtagaaataacaggagaagtagaattaaattttgagcctgaaggtgtgactgaattgctgtaatttcatgataaaactttaatggatgagatgttgcttcttccagatgagcaaagaaattggtttctttttttttattattatactttaagttctagtgtacatgtgcacagtgagcaggtttgttacatatgtatacatgtgccatgttggtgtgctgcacccgttaactggtcatttacattaggtatatctcctaatgctatccctcccccccccaccacccccatgacaggccccagtgtgtgatgttccccttcctgtgtccaagtgttctcattgttcaattcccacctataaatgagaatatgtggtgtttggttttctgtcattgcgatagtttgctcagaatgatggtttgcagcttcatccatgtccctacaaaggacatgaactcatcctttttatggctgcatagtattccatggtgtatatgtgccacattttcttaatccagtctatcattgttggacatttgggttggttccaagtctttgctattgtgaatagtgccacaataaacatacatgtgcatgtgtctttatagcagcatgatttataatcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcttctccagcacctgctgtttcctgactttttaatgaccaccattctaactggtgtgagatggtatctcattgtggttttgatttgcatttctctgatggccagtgatgatgagcattttttcatcatcttggctgcataaatgtcttcttttgagaagtgtctgttcatatccttcgcccacttgttgatggggttgtttgttgttttcttgtaaatttgtttgagttctttgtagattctggatattaaccctttgtcagatgagtggattgcaaaaattttctcccattgtgtaggttgccagttcactctgatggtagtttcttttttgtgcagaagctctttagtttaattagatcccatttgtcaattttggctttgttgccattgcttttggtgttttagacatgaagtccttgcccatgcctatgtcctgaatggtattgcctaggttttcttctaaggcttttatggttttaggtctaacatttaagtctttaatccatcttgaattcatttttgtataaggtgtaaggaagggatccagtttcagctttctacatatggctagtcagttttgttaaatagggaatcctttccccatttcttgtttttgtcaggtttgtcaaagatcagatagttgtagatgtgtggtattatttctgaggactctgttttgttcccttggtctatatctctgttttggtaccagtaccatgctgttttggttactgtagccttgtagtatagtttgaagtcaggtagcatgatgcctccagctttgttcttttggcttaggattgacttgccaatgtgggctctttttggttccatatgaactttaaagtagttttttccaattctgtgaagaaagtcattggttgcttgatggggatggcattgaatctataaattaccttgggcaatatggccattttcatgatattgattcttcctacccatgagcatggaatgttcttccatttgtttgtatcctcttttatttcattgaacaatggtttgtagttctccttgaagaggtccttcacatcctttgtaagttggattcctaggtattttattctctttgaagcaattgtgaatgggaatttacttgtgatttggctctctgtctgttattggtgtataagaatgcttgtgatttttgcacattgattttgtatcctgagactttgctgaaattgcttatcagcttaaggagattttgggctgagacgatggggttttctagatatacaatcatttcatctgcaaacaaggacaatttgacttcctcttttcctaattgaatgccctttatttctttctcctgcctgactgccctggccagaacttccaacactatgttcaatagtagtggtgagagagggcatcctggtcttgtgcctgttttcgaagggaatgcttccagtttttgcccattcagtatgatattggctgtgggtttgtcataaatagcctttattattttgagatacatcccatcaatacctaatttattgagagtttttagcatgaagggctattgaattttgtcaaaggccttttctgcatctattgagataatcatgtggtttttgtcgttggttctgtttatatgctggattacatttattgatttgcatatgttgaaccagccttgcatcccagggatgaagcccacttgatcatggtggataagctttttgatgtgctgctggagtcaatttgccagtattttattggggatttttgcatcaatgttcatcagggatattggtctaaaattctctttttttgttgtgtctctgccaggcttcggtatcaggatgatgctggcctcataaaatgagttagggaggattccctctttttctattgattggaatagtttcagaaggaatggtaccaactcctccttgtacctctggtagaatttggctgtgaatctgtctggtcctgcacattttttggttggtaagctattaattattgcctcactttcagaacctgttattggtctattcagagattcaacttcttcctggtttagtcttggaagggtgtatgtgtccaggaatttatccatgtcttctggattttctagtttgtttgcatagaggtgtttatagtattctctgatggtagtttgtatttctgtgggatcagtggtgatatcccctttatcattttttattgtgtctatttgattcttctctcttttcttctttattagtcttgctagcggtctatcaatattgttgatcttttcaaaaaaccagctcctggattcattgatttttttttttgaagggttttttgtgtctttgtctcttccagttctgctctgatcttagttattttttgccttctgctagcttttgaatgtgtttgctcttgcttctctagttcttttaattgtgatgttagggtgtcaattttagatctttcctgctttctcttgtgggcatttagtgctataaatttccctctacacactgatttaaatgtgtcccagagattctgatatgttgtgtcttcattctcattggtttcaaagaacatctttatttctgtcttcattttattatgtacttagtagtcattcaggagcaggtcgttcagtttccatgtagttgagtggttttgagtgagtttcttaatcctgagttctagtttgattgcactgtggtctgagagacagtttattataatttctgttcttttacatttgctgaggggtgctttacttccaactatgtggtcaattttggagtaagtgcagtgtggtgctgagaagaatgtatattctgttgatttggggtggagagttctgtagatgtctattaggtccacttggtgcagagccgagttcaattcctggatatccttgataactttctgtcttgttgatctgtctaatgttgacagtggcgtgttgaagtctcccattattattgtgtgggagtctaagtctctttgtaggtgtcgaaagacttgctttatcaatctgggtgctcctgtattgggtgcatatatatttaagatagttagttcttcttgttgaattgatccctttaccattatgtaatggccttctttgtctcttttgatctttgttggtttaaagtttgttttatcagagactaggattgcaacccctgcctttttttgttttccatttgcctggtagatcttcccccatccctttattttgagcctatgtgtgtctctgcacatgagatgggtttcctgaatacagcacactgatgggtcttgactctttatccaatttgccagtctgtgtcttttaattggagcattagcccatttacatttaaggtttatattgttatgtgtgaacttgatcctgtcattatgatattagctggttattttgctcgttagttgatgcagtttcttcctagccttgatggtctttacaatttggcatgttttttcagtggctgttactggttgttcctttccatgtttagtgcttccttcaggagctcttttagggcaggcctggtggtgacaaaatctctcagcatttgcttgtctataaagtattttatttctccttcacttatgaagcttagtttgtctggatgtgaaattctgggttgaaaattcttttctttaagaatgttgaatattggcccccactctcttctggcttgtagagtttctgccaagagatcagctgttagtctgatgggcttccctttgtgggtaacccgacctttctctctggctgcccttaacatttttttcttcatttcaactttggtgaatctgacaattatgtgtcttggagttgctcttcttgaggagtatctttgtgatgttctctgtatttcctgaatttgaatgttgacctgctttgctagattggggaagttctcctgaataatattctgcagagtgttttccaacttggttccattcttcccgtcactttcaggtacaccaatcagacgtagatttggtcttttcacatagtgccatatttcttggaggctttgttcgtttctttttattcttttttctctaaacttctcttcttgcttcatttcattcatttgatcttcagtcactgataccctttcttccagttgattgaatcggctactgaagcttgtgcattcgtcacgtagttctcgtgctatggttttcagctccatcaggtcctttaaggacttctctgcattggttattctagttagccgtttgtcaaatctttgttcaagatttttaacttctttgccatgggttcgaacttcttcctttagctcagacaagtttgatcatctgaagccttcttctctcaactcatcaaagtcattctctgtccagctttgttgaattgctggtgaggagctgcattcctttggaggtggagaggcgctctgatttcatagaattttcagtttttctgctctgttttttccccatctttgtggttttatctacctttggtgtttgatgatggtgacgtacaggtggggttttggtgttgatgtcctttctgtttattagatttccttctaacagccaggaccctcagctgcaggtctgttggagtttgctggaggtccactccagaccctgtttgcctgggtatcagcagcagaggctgcagaacagtgaatattggtgaacagcaaatgttgctgcctgatcgttcctctggaagtttcatctcagaggggtacccggccgggtgaggtgtcagtctgcccctactggggggtgcctcccagtttggctactcctgggtcagggacccacttgaggcagtctgtccgttcgcagatctcaagctccgtgctgggagaaccactactcttccaagctgtcagacagggacatttaagtctgcagaggtttctgctgccttttgttcggctatgccctgcccccagaggtggagtctacagaggcaggcaggccttcttgagctgcagtgggctccacccagtttgagtttcccggccactttgtttacctactcaagcctcagcaatggcgggcacccctcccccagcctcgctgctgccttgcggtttgatctcagacacgctgtgctagcaatgagcgaggctctgtgggcataggaccctctgagccaggtgcgggatgtaatctcctagtgtgccatttgctaagaccattggaaaagtacaatattagggtgggagtgacccgattttccaggtgccatttgtcgccccttcccttggctagaaagggaattccctgaccccttgcacttcccgggtgaggcgatgccttgccctgcttcggctcatgctcggtgccctgcacccactgtcctgcacccactgtccaacaatccccagtgagatgaacccagtacctcagttggaaatgcagacatcacccgtcttttgtgtcacttacgctgggagctgtagactggagctgttcctattcagccatcttggaatcgccccccgaaattggtttcttgagatggaaactactcatgctgaagatgctgtgaacattgttgaaatggtaacaacggattaagaatattacataaacttaattaataaagcaacaacgggatttgagaggactgactccaattttgaaagaagttctactctgagtaaaatgctttcaaacagcatcacacattacagaaaaatatttcatgaaaggaagtcaattgatgtggcaaacatcattgttgccttattttaagacactgccatggccaccccagctttcaacaacaactgccctcatcaattggaagtcatcaaaatagaggcaagacccttcactaggaaaatgtttccaactttttgaaggctcaaataatcattggcatttttttagcaatgaagcattttttaaattaaggtatgtacattttcttggtcataatgcttttgcacactaactagacacagtataatgtaaacataactttttttttttatttttttttttaggtggagtcttgctctgttgcccaaactggagtgcagtggtgcaatcttgggtcactgcaacttctgcctcctgggttcaggtgattctcctgccttagcctcctgagtagctgggattacaggcatgtgccaccgtgcacagctaatttttgtatttttagtacagacagggtttcgccatgatggccaggctggtcttgaactcctgacctcaactggtccatctgccttggcctcccaaagtgctggaattacaggtgtgagccactgcgcccgggcaaaacaaaacttttatatatactaggaaaccaaaaaattcctgtgactgttttgtagtattcactttattctggcagtcttgaaccaagtgtacgatatctccaagatatgcctgtacctgtcagagttctactttgcattcaattacagctattaatctcctgcaagtcattttgtctctctgaagttttttttttttttttcttaaataggagaatactatttatcaactcatttcatgggattattgtgatagtgaaataagaaactgtaagagaaaaccttatacttttacaaatctaattgcttttattatcattattgtgtatgtgtgtgtttgtgtgtgttcactgttaatctcaatgcccttcttactatttttctcccccttaaagcaaccttgttcattctcactttcccttcaggtatcagttttctaataccttcccctcatcaaagtctaagtagaaaaataagatataagctattgacatgttgaataaaaacagtgagtttctactgctaggaattccatatcttgtcttggccctatcagccttgaaactaaaataggaattttcagggttcttatggaaaggtgagtctaatggtttgaggcacacacacatatacccccattatatgatttatttcagagaaaatcatcctagatacagtcccaatacagtcagaagccttgagaagctgaaaattggaaggaaaatgtggatagtgtgtgttcctatgagaatttccatttcatcatacagtaaaagtctatgctggctctcatacatttctataataaaatgtatcatcaatatcatcaatgaaatatatatatgtatttcatgtatttatatatttcatatatatataaatgctgaattaaatataaaacttaagtatattacatatctattgaatactgatttcagcatttttggatttgaggcctgctgggagcactgtgttgactcaatctaccacattgcccaaggctggccatccttcacatagtcttacagctttctctgcccacaactccaggtgtctgtgtagctttgactggcatctctgcagagctgagggggctgtgggaatgctgtctttctccaggcatccacagaggggctggcttcaggtttagtttagtcccatagtccacttgtgggtcagagaaatacattaattaggttagctcctatgtgagttattgcttcgcaggttaaaatcattctgattctactttggtaatatgcaaggattttcaaaacattttctaagagtgtgatatgtgcagcaagcatttaaatttagatatcaaattgtttttattgaatttcaaactcaaaagtgtttctaaatattgtcattttggaattgggcccccaaaaatagtaaaaatagatgtttaggtagagaaacacatttgtgtagcaatgcctcaccctgctacagctcgttcgctgacactgcccaacaaacccactgaggcttggtgcgagaaattacctcattaaataatcttataaaaaaattgtcagatgtaacaaagactggactctctgagcttttctctataaagaatgcattgttaagttgatcgggttaaggttcagttagtccaaggtagggtttatgaataggaagaaacttgtcattcactttgtagatgagtaaagcatgtgaatttaggggaaaatatcatcagtcacttcctcaaattgtttttggaagtagcaaaatgtcaaccatattattaaataaggaaaccatacttcttaaataaacttccctagaagcagatctagagatgaggatttgatttgtgtgcaaggaatttatgaaagggagtgtgctaaggaaacaatggaagcaggacagggaaggagtcgaaggggagcaagagggagggcccaggcagaagtcctcaagctcagggcgtagatctcagccagtccctcaggtgtcctcaggagtgtcagagttttcccaactggaggagaaaaagctagactgccattttcccacccccaatggtcattggttaccagcatgtgtggaagatggcagtcctcaggcacttctggctcctggaggctctggaaggcaaagagaagtctgccaaagaatatcacagatgatggccattggaagctttccaagggttcaggttttcagaactgtttagaagagatgggaagagatttgggtcattacagcactggccgcagcactgtctgctatgtaagtgcatgactagatggaccttgagctattcttcaggtccagataagggatctatgtgtcattttaaacactggcttcatgtacttgcctgaccacaaagggcaatgtcaccaggaatataaagtcaaataaaatgggtcctgtaaaagacaatttgctgctgggttgcagtttaatccatgacctcttttgcttacatgagatcttgaaagaatattaaattaagagttatcttctatgctggcataagaagcaaataattttccataatatggaaataaaatatgtgaaaaatgttaagtttcttgaaacaagagtttaaccagaagttaataaacaactctttcttcaggaaacctttgactcatggtttatacatacttttgtattaagttgtgtagcataaaaataaaagtatagcagtagtatactaccactggagtgtcattcctgagatagccagatgttcagttattttgaaataaccctggagtataacagtaaagctaccccctcaaaaaagttttttgttattagaattcatgatattaatctaagttaatctctccattcctttgtgctcctcataacatgttgtttaaatgtctctacagtactgattccatcctattttatgttattattatcttgatggctgtattagtccattctcatgctgctgataaagacgtaccagagactgggcaatttacaaaggaaagatatttattggacttacaatttcacgtggctggggaggcctcacaatcatggtggaaggcaaggaggagcaagtcacatcttacatggatggtgcaggcaaagagaggagagcttatgcagggaaactcccctttataaacccatcagatctcgtgagacttattcactatcacaaaaatagcccaggaaaggcctgcccccctgattcaattaccttccactgggtccctctcacaacacatgggaattcaaggtgagatttggttagggacacagccaaaccatatcaatggcaaaaccgtataaggttcatctttagatcatccaaaacatttgtcactgttccagctcatgatagatgtttgaaaacatttgaatgcatgaattggcctacaatttcccttctttgaaacatcttgtcttttattataatagccaagtacatttgctctttgaataatgattcaccatacactctcctagctgcttgttaattcttaactttctctcccttgttcctttggaatctgttatcagtgtttcgacaggatgtgcacaagtgtcagagcatatgttgtctgcatatgtaccaaagaaggcatatctttctttccttttctctgcaatattcttctctttaatgcaactataaattcccagaacatacctcctattttgagccaagaatcaggctttgaataaggtttcgctcatgtagagtaggattctggatattcagcttcaatagtgaagctaagaattctacgtatcttttcctactagcttggaaaatatatcttaaactagtccttggctatgactttgccccttctcaggaatagacacagtgtgtttatgcaaaacaaacacagcgttttcaaagatagagcaagagaaaaaagagacttctctaataggctttaatacaagaatgaatttcatggatttatttcagagcaaatcatcctcgatgtggtcccaatacagtcagaagcctcgagaaactgaaaattgggaggacaatgtggacagtgtgtgctcctatgagaatttcagtttcatcacacagtaaaagtctatgctggctgtcataattttttataataaaatttatcatcaaaaatactaacaaaatgttgcaaacccaacacattcacagtcttctatagttttaaacatacactaaggtcaaagccaataggatagtcagctgctttaatttaggagtaacacgagaatgggccagcccctagtagctcctccattacctggtcatatgcgatgtccactatgattgcatcgtagttacactcctgggaaaacacacctgtatccgaaatctcccaaatagcaaatggtagctggaatagggaaataggtggctatcactgagtggaattaagatccctaagtaagtgaattgtagagaagctcatctttgatcagggtcataaaaaatctggtgctggaaggcagggattaggtgaggctgtaaaaccggatgccccaaagcaaatttgctttgtctttctttctcctcacagactcattccttatcttcccaattaatgctatcactgttctcccctggtaccaaagcttaagacctatgggttgtttggacgcctaactcttaccctgcttgtccagtcacgctctggtaattgcgtttctgctttattccggttgccttgatttaggatttcatcttctcccacttagttgagtgccattttctccttcctgacctctcatattttttgtgactttttttttccatctgagcagctagactgacctctcgtgtgttttaacgtcagtcctctcttccactgccagccatctcttcagtcccaggtttatctccatccctatctcctcccccagctccgtggcttctccccactgtctcctcctgtctttgccatggtgatggctactgtggagtggagtgttggttaggggccctggagccccacccttctagtttcgaaacccacctctgccttattacctgtgtgaccttgggcaagttatgtaatctctccaactgtcattctccttatttgaaaaattatactaattaatgcctaactcaaaagattattttgaatattaaatgagataatgcccataaagagtttagcacagggcgtgttatacagtgaagtattcacaattaccattgaagaaatttgatgattagcatttgatatcactgaggctaggagatgcagcaagaacttcagtgggtaaatttctaggcagacaaacaatattactaaaatagaaggtatatgagccatctgcccctttttacaaggtatatgagccatctgcccctttttacaaactacagaacatttaaaattaattcaataagcagaattcctggtattattattaaatatcaacttttcaattgacctggccataaaccatctgttggttgataaagacacacatcctaaacttacagaaatagtaccattattcaactttatatgccagtggttcatttctttaacaaatatgtagcgctctccttcatgctatgctagactgaactaattgttcaggacgtcagaggacaagtttagttcttgctctgagaaaacatcatctgtatgagtttgcaagggtttccataataaaataacaaagattggatggcataagcaacagaaatttattttctcacagttttagaggctagaagcccaagatcaaagtaccctcagggttgttttctggtgagggctctcttcctggcttgctgacggctgccttcttgttgtatcctcatatggcctttcctctgtgcacacctgctagacagagctctctttctcttctaaggacaccaatactatcctatcagggagcatgccccaccctccaacctcatttaactgtaattgcctccttaaaggcccatctccaaatacagacctccaaattggggagtagggctttaacgtgtgaattttgggggacataatcctgttcataacactatctaaccaaagaaccagaaaaatagaagatcaagggacacctagttcaagtttttaggtgaaccataacctacataagttaacataaaaacatttctgagagaaaaaaaagaatactatgttggtactctaactcaaagatcttggactgagaatcaggttgtttgtgttctaatcttccttctgcagtgaaattgcagtttaggcaaatcaatttctcaagtcattctgcctctctgtgactgaatcaaatgaagcctaatgatgcttataaagttgttttaagacataaaagagctctacaaggataagatgctgtcattttcatcactggctttcagctaaaagctcagcctgatatatttttaccatttcagggaaggcaatcttcctctccagttcaagtatgtagcataatatcaaagaatattgatgttaaaatgtggacttcatgatcaacatattgattagacactattttgaatatgttaagagagaaagcttcaacctacacatccctgtcaaccatcaaccaaccccaatcataaacatctttagcagaagactgaattctccttttcttgaaattccatagtgtgtgttgctttattccaattacacgatgtcttaacatgaaactgtaatgcgattttcattcagttcttaatttcagatagccagaatatatttctttataaccaatcgagaaatgtgactataatgaagtcagcattacttggtaaaaagatttaaaacaaaatgctctttctctactagtcgaactaaaacttgtctgcatagaggacatctgtaacgtaaaggaggtcaggggcatgcaatgaatcaattcaggagtcttcacaagcgcaatcattcttttctactaaactaaaattgttaagatccttttcattttgaacataatcacttttatagtttccaagtacaggaatctttaaaatctatagctagagatgtgtagataagaataatatattcaatgaacttctttttcatggggtgtaatctgtataattgtttaacacaaggaaaaccacaataaagaaatcatgcccattctctggggaaacagaataaaagcacacagggtcaaatatgcaggttctgtgtgtaaatagcactgatgaagtgcatatcttgcacattttacctttacgtgcttccttctgtgggagaataacaaactccctgcaggtctatagtagtgacaatgattaaaacttgggataaagcagaagaggatctgaaattgttagaaaaactctctgatccccaatctgtttgctctactgattgaaagataccagatttaccaacagctgaaactgatgctgggcttgaacacaggggagaatcaagcagcaaaactcagctttttctttcttgtgccccttctagtagagacagtccataaatatttactgaaggaacgaatgaatcacacagacggagcacagttgggcaagccagtctcacacgtcttccgctgggacgaggacgaaatatttataagtcgtgatcaataaaatcttccctacctgctacctttctcccttctaccccatcacgacacaaaaacctgctcccagttcctctgcttgtaccacctacaaggttttcctagttatcccatgctacttccctggggaagctttcttggccaccaaaggaaagaataaggcaggagttctcattgacaccaatgggaccaattgttttctcccatcactgctgtggttaccaccccaaccctgactgctgccttaaaatacacgcattttggtaagggtgagagaactccgttctacaaactgcttatagaccagacacatgaaatgtgcacagttttaccacactctctgagaataacataatatgccatgaagatcttcaaagcccacactattttattttccttctagttaatgatgccttgggctttagggccacagatctctcttttattttgctagttcagtttagtttccacctcaggccctagctgagatataaaggtatgcaagtagagctgtggagaaattgtgctgtgtgttctacaagaaagggtcacatttggcttttggttgcaaatatcctatttacttccaactgaaactcaataatacagcattctgttaattctatccacatgaactcaccgaccgcctcttatctatgtcagaaatacaaagtcctcctcagttcctctgaaactaattttttcatctcgattagcacatctaggagtcttcctccttcaatcatgtcctcctttgtgtcttggttttgatgatttttctcatcagtcctttccttccactctcaatcacatcagactggcatctcttcatctttcttctttctttttgtgtttgaaaccacaagtgtttttaggattccaagttgattgaactctactccatacatactccaaaattttcttaccaaattgtatttctattctttttttatggctgagtaatattctcttgcatatatacactacatttttgttatccattcatccattgatggacacttaggttacttccatatctttgctattgtgaacagtgctgcaataaacatgggagtacagatatctcttcaatatactgatttcttttcttttgcatgtatacccagcagtgagattgctggatcctatgatagttctagttttagttttttgagaaacttccattctattttccataatggctgtactactttccattcccactaacactgtttgatcgtttccccttgcccatatccccatcagtatttgtccccatacaaatttatttcttgtgtgattgacaacttaattacaatattatgacccttttctaatcagtctgggacaacttaaagtctgcagtggctttaaggagatttccttgagagcaattaattactgtgttgagccatcctgcccattttgagatgaagcttatcttgcactgtgtgaccctggccttgccagtgcattcctaaaatggaagaacagcaagtgaggcgtcagcagtcaatcacccgcctagcatgctcccatgctgaatgcttttccttttaagaaccataatcagatctaatgatttgcaagatagaaaagaacactctcatttatcttgcagagtgcatcaaggtatgtgggaaggatggagatataaatgcaaatgaccttgacaacaagctaagaaaaactagtcagaactttgaactcaatgatgtttaagaaagattcatgggttaagttgtacattagaagttttttgaagtaaagatatacaaaatagagtcttaagtcactccaaggtcaatggagtgagatacttactgaacatgagttaaaattgtttttttttctgatcatgcacattaagatgtgatgaatgaaaagtgtgctgcatagcatatgagagttgaaaggtaagtccaagacaccccctttgattggaccctttattggtacacttaatgataagtgacagaaccgcaactcaaacttgcttaaagaaaaaggaaattttaggtttcataaaattaagaagtctttagactggcactagtttcaggcacgagtatatccaaggattcacaagatgccattaggagcatgtttttctccctgcacctcaggtctacctgtctttcttgtctttatgctacattcttgtgcaaacatgttaccagcatgcctcccttgaactcagggctcctgaacctaaatttctctacatccaaagggctctgatgggcccatcttgggtcccatgccacttcctggactaaatagtgtgtctacaagatggaatattctgtgtgatggcaggcaggctcacctgatgagaagttctactagaattagggggaatagggaaaggtgctaggcagactgaaacaaaaaggaaggggaccagaggaaacatttcctacagatctgcatgtagggatctgaacaagacataagtcatctacgtggtttataggactgacaatgagtgagaattaagtggaaccttttaggttctgagatctctgtcaacgattggacaaagatgaaatatgaagtaggtttttagtttttgcataaaacaaatgcaattggttatacaatatttggggggaaagaatgataaaagtcaaaagaataaaataaaaatatgtaatctaaccaccataaatgtgtttggcaaatttttcttgcattgtatacaaatatgtgtttatgaatcagaattattcagtatctatactgtatttttgtttaaaatattgagaacattttggcatatgattaaagcagtctacaaaagttacaaaagttttaatggctaaataacagctcatctaatggatgtgtcgtagtccataatcaatgtctgttttacatatttaagtttcccattttttactttcataggtaatattaaaataaatattttgacagcacatctcgtcattttctgaaaattgaatccaactagttaaattactgagtcatagatatgaacatataaaagattttggtgtgtgttgtagcatttctatccataatattactatttttaccagcaatatgtggaacgatccttactgtttcccaaaaatgatgatttttcagctattatattgtgagatatatgaagcaagcattcttgtttcccccacaatatctactcttaaaatcacctagtaaacatttattaaattttaaagaatgggccatagcaagtatatgtttttaattctgcattacaaagccaaaagagagagtctgtgttaatgaagtaaatctctgcttattttaatatcagtaacactcattgttgaggatgtagagaaatgactcttctataaaagcatagtatttcatctggcaattgaagagatgtacatcttaaccccaaaattatttatttggaattatatccaaggagatgtttgatcaaatacacacaaatatatttgatatttatcaatgagatctttatagtatcagaaatcttaaagttatttcattacccatctctatttatttaaaatagatcctagatattcattcagtggatgcaatacagccattataaaggaatgccttgagttaaagttggctgtattgaaatcttgttccaccccagcccaccaaataccagccttgtgcccttgcacaaatatcttgtctgtgactgagttccgtaaaatttattttgagcattaagttggattttacatagaaaaaccttaccaagttctaatgtcaaaatttttataatttttattaaatggaaaaaatgttgatgtgaacaagctatcaaatagcatggctaagaatatcccatttacataaaattatatatgtgtatgtctgcatagagatccagaataacattaatcaaaatatgaattggattatttctcatttggagaacattgggtggtttttgctttcctctttatatttttctctattgcttgaattttctctataagtatttattatctgtatgatcataaaaaagttaataattgcatttactttttaaaaaagtcaaattatgtaagaacttctttagaaaggtctgtacttcataggtgactttcccaaagccatgatgccagattgcttcaggatagcatgagaacaaggtctactaatttttgttcatatatttttgttttactaatttttgttcaagtgcctgctatcagctaaaatgatcctgggcaaaaggaaccagcaatgagcttaggctacaacaattagaaaattccaggctttggctgggtgcggcggctcatgcctgtaatcctggcagtttgggaggccaaggcgggtagatcacgaggtcaggagatccagaccatcctggctaacatggtgaaaccctgtctctactaaaaatacaaaaacatttggctgggcatggtggtgggcgcctgaagtcccagctactcaggaggctgaggcagcagaatggcgtgaacccgagaggcggagcttgcagtgagccgagatcgcaccactgcactccagcccgggggacacagcgagactccgtctcaaaaataaaaaataaaaataataataataaataaaataaattaaaaaaaatttccaggctttgaagaaaaaggctagaagttctgccacaattagctgtgtgaccttgggcaaacctcatgatctcccagatcctgtcttttattttctttttatttccaattataaaataattatctgaaaccttctgtacttttaagaacataaaatgatccgaaaactgatgtatttatttatttagttgctagtaggtggttttaaccaaatctcaaaatactagccttggactaagtatttattcagagataagtggaggaattaggtggttgacgtgaatcttcaaaggatgaatttagttaaaaaaaaaaaaaggaaattagtctttaaaattatagagaatttatgatctggaaagtttgttcaagctcaagatataaatagatttcataaagtttcagataagtatgccataggttactgagattttattgctataactcttaaatttgaatcatgagaggcaatcatcgtcccttaacaccaagatcaagagccagaataaaaggggatgaaatgtgtgcaaacacgagctgtccattttgtgctacacaatagctgagtatgtgttgattctttaataagttcgaatgacgacatcaaaaatatacacagcctatgataatcacagccccgaacttggatatttctctaattatttttccttttctcattttactacaaaaatactaagaaaaatacatcctcttaggtacctgcattatactagttactatgcttaggggttacctgtattacctcatttaatccttacacttgactgctgggatgatgttattcctatttacttacaggagaaaatcaagaccagagaggttaagtgcatatacaaatccacggttggaagcaatcgagctggaatctacacacaggttcttctgattagcaatatgtcatccacagttcctgacatattgagctattgctatgtaatgaaggtcacagtgactactgtggagcatgtgagaaaatataaaattacttatctaactgatgagtctaatgaacaccagacgatgttctctacaatcggtttctttgatacagatacgtaactgacttcctttttaattgaacagaaggaacatattattgactcacataacaagggatactttcagaatgtatagtaatttgttctgtgcaagaaaacctgtttggggccacactttttttctgaagggtaaccttcaaggtattttccctgaaccattttttttctctacagattatagaggatctgaaagactaagataaagcactcccattagaagctgtgatgacagacgaacgagttgaatagtgacaggcagtgttgggtccttttcctatttctttcatgaaaatggaaccgtcgttcattcaaccaggagcctggtcaatacggtgagctcctgtgtgtgtacaggaaggggcctttgataattgcataaggcagacaattcatctggaagctctagaaaataagaggtggaaaaatgagctctcaatgtccacctgggttttgaaaaggtagatatttgaagttgtggcaggctgctttgtaattaaactggtcgctgaggtcagttttcatagcagtccaattccagatgtgatcatagcgtcatgagccatgcctttataaatgttacatttcctgggatcaaattatttgccagaatttacttcctaatttaaagagtttaaatgccacattattttgaatagtattttgctatactggtgtttttgtgtcatggaaaacagtcagagggcatggcatggaatagcaaaaaaaggaaaacctccttccaatttctgtagagcagaattcactgcattcgtatcctgctgtccagttttgattcaactggaccaatttctcttttagctactatgataaatgtagtgtttactgaaaaaagctgatcctattttctactctcttatatacctatcttgaagcgtcagaatgctcctgttatctggaaacataatccattatacatagaggttctttctcttctgtgatttgaacctagtctttaatttatttctattttgaactgaatgtaaagctgattacccatcagagaagaagactggcataatcaagtaagacaagggcaggctccttggaatttttcttggatagcttttctaatagactgaaactaattctgagactctacctgtcactatgcacagcgcctaattcccatgcagctgaattagtttgtgtgaaatactctctttctgaggccctagtcacttagaatttatctcagctctgaagcaatgactgttaataacctgaataattgtggaggcattcccctgtactaaaaattatacgcagactaaatcaccacaactcgattatgatggatgcaattaaaataaattatgtaaatgtactataagaataattagaactagaaatgttgatgagttaattgccatgtctatgtacttatgacacagaaatcgaagaaatttggaaaaaatttagattatcttaaagataaaacagatcaaaaagcatgaaaaataattcggtaatggggacaagagaagtctcttcttgacattcactcaggactttgcaaaagagatgaaggtcgcacaattcactacatggaatttagggacttgacaacctgaaggctgagtgacaaagaggcttcgtacaaactaaaggatgaattaggagacagaagtggctttactgctcaataattagaactttgagggaaatctaaggtcagaaagtaatggttaacgtggattaatatatattcaaaaaacaaacttttaaaagaataggaaacataacatcagtgtgaactcaggcttttgtccctcacttttaagctgtgtccgttgtctgaaagcattggcaaccctgcagccctaagtaccactgcagccctcgtttcagctctaaatacaatactgaggcaaatggtgtcatctaaaaaaaataaaaataaaagacctagaagccagattaaagaggctcctgcagacacaggatgagacaaattgaaaatcaaaaagaataatggctgcaactgattaaaacaaattatcgctccatcatttcataataacactcaaaaaaggttttaaaaatttggagcaatgaagcaaaatgtactagacacttttggaagctgctaaggcaccaattcatcatcatcttaaacttgatagttacagggaagagtaagcttgtattctgtccttttagtagaaattgttctttggactaaccaaaagaacttaagatatcagtgaagttttcaaacaggagaaatggtagaaataggaaagcatcattttgtaacttgcagtgaaacaaatttttaaaaacaaattaaaaggtaaaggtgtagttctgttactgctttcaagaaacaagggatatgtaaaaactaatgcaatgagggaaacatttttggatcctgattcaaacaaactattaaaaatattgtttagacattaggggatgtttgaatatgaatcatgtattagatgagaatatgggtttttaaaactaattttagtaaaagaaataatgcattgtattacataagaaaaaaaattttaattcatattgaagaatttgagtaaataacttgatatttgaagttttattgaaggtatcccagccaaaataaaatgggagcagggagaatagacaggaataaatgaaaaaaaatggcaaaacaaataatgtttatgaggcttagtgacggatccatgtggactatattttcaactcttttgcatgcttagaaattttcgtaataaaaagttttttaaaaatcaaaacactgtttaggcataaacacagagagacagacaatagaaggtaataaattaacgtcaattgccattatctattgatttttatgttccctgagatctttacataaaattcaaggttgtaaactctaaatagatgcctacacatgtagtaaatcgggtgaaaaatgagaagtagcagggagttgtgacctcaggcagaaaaattaaccctgctaacttggatggtgacagcttaagtgtatgagtgataagaagtgtcagggagactttagcatagtgacttggggcactgatcttcctgggcatcacctctgtaggggtgtcagacatgaggtagatttgaagaacaaaaacaaaaaagcatattcctagataatttgtcacatttcaaatgtttactgttcggttctgttctcaaaagatccaccagcgttaatagcagccaggcgcagtggctcatgcctgtaatcccagcactttgggatgccaaggcaggcggatcacttgaagccaggagtttgagaccaacctgctcaatatggaaaacccatgtctactgaaaatacaaaaattagccaggcatgatggcacaagtctgtagtctcagctacttggaaggcagaggcaggagaattgctgaacccgagaggtggaggttgcagagagccaaaatcatgccactgcaccccagcctgggcgacagagagagaccctgtctcaaaataataattaatcataataatattgatagcaaacagtagtattacggttaaagccagggccagcttcgtagccatccagttcgcactggttcctatgcttagaaagatcccacatctggtttagtgctgtgctgttgccatcttgggatttctagaaattttaaacaaggagcctcacgttttcattttccactcgacccttcaaattatgtcaaaagtcctggttagagtggcttatatacaaagtttgtagggagtagatttagtgaacttgatgaagttttatagttcattctcccgaaggagacttgttagtcactgaagagtcgcttcacagtatttatttttctttttaacttcccaactcttttggggacagctaagtaaacacagcctctagcagtatggtattacttgggacaatattagcttcataacaatgacacacaaaagcaacatccaatttcaaaacgtgattgttctctagatcaagaattttgttctgaaatataattttcagatataggtgtgcttgctgatagttctaaaatattgagcttgatataaaggcaaacctgtctaaacatatggaattcttttggtagtcttagccatgctaacaaatatgttttctgactacagcttttttttccccactgataaaggaatattttcaataaggaaatgatagcaagtcttgtagttactctttggtatttgcaaggtaataaccagctaacagcaatgtatcaatgattgcatttgtgtagacatcttgaccaaagtcacacagacagtagcagaaagtcacttgtcactgtgcagctggcactcttgcataataaggattaggatagccgatgttttgtcacagtgccaaagttaatcatggtctaaggacattgaaaaaaagctgagaagtgagtgaattaatcatcattaaaaacagatttaaaaagtaatcctgaaggggaacttttaagaaaaaaatactactttgaataatacaaagttctttcaatattaaaaaaatgaaagatgcttctagaagggactccttcctctaagacatcagtattataactgtaggcaggaaatcattttctagaaattaacctttcagggcaattccatcaaatcatgagtttttattgctccaaagaaataaacccttcatcagaataggattctggatccaagtctctttggcatcctccctttagtgtctttatcagagttagctacagaacattaaagttccagaatacttaagtcagtctgtctgttagacttggagggaggaagatgattatttaaatagtcagatagttgtagcatgaaaacaagttattaaacctctggttgaataacctctgaaaaaatgcaaatgttaactttgagaccgatggaataatgtcaccctacctgtttttaatatttgagaatggacacaagcaaggggacataagggtaccttcctcttgccccctgcaaactggctgccaagggacttgtaatgatggcagctgctttgggacagtcaggcaccaatcctctgcccaaatagtcatttgttcttccactcctaactctttgcttgcctgacattttctgagagattgcactatttttcttttcttatgtttttcactcattttaaagaacgcttttttctgaataagctgtttccttaaagtattcaaagaaacaaaattccaggcagaaggaaatttgcattctgatgttgtttagagttccaaagcctgatggatggctgccttctctgtagctcctccaagtcatttcagatctacaggtgcttcatggcctgtcctaaacctgtaagacttgaagtcttataggcttgacttgtaccttaatttccacctccttccatgtaaataaaataaaaaactaatgcctacattagcactggataatcatgaattgttgtttttgttctttttttttaacgtaagcaaatttaaattttctactcttatttctctcagttggctcttgtgtttctagacatactccatagttggtttccttagagcttcaggtaaaaatcttagcctggatcttaataattatacctgatggaccaagagctgggttcagtcacatattgtaaacaatcaaaagctaacttatgaacatatggcaaatgtaattctttgataagaaacaagacagcaagttgccgtcttgattacatagatgtaataggattattgtctttagctatctgttcttgaagtacatacgtagcactttatcaggaaggcccactgaaaaacaaacatgcaactctggaaagatagatttgcttcaaataattaggaaatagaaaaactgtgatgaaagaaaaatagggaatttatttacaccttcaaagtctcttagaatatgtcaagtaaaattgaaaacgaatcaaacacggaaaagaagcaaaattcttcgctgtaagatttcaggaaatacctagctgctaagattcagcaatttaattacaaaactggcacaaaggcacaatttagttgtggtgaggaaatttaattctcctaacatcagctaaaagtctgtttctcgaaaaattgggacacctgttaactgttttacttatctcaccgaaaatgtatctcttaaaagattactgataatgtcacactctcttttctttagttccaagaagttcatggcagccatcatgccaggcaatgagaggacattcctactgctttctctcccctaagctctggtttagtttctgatgccctgaacatcaaggaagagccaaatatcctggccaaagctagttcagctgtgacagttggggtagggagaggtgacgtagtaaggatccttgaccttggttttcagtaagttaattaaatatcttatgactggacatggtggctcaggcctgtaataccagcactttgggaggctgaggcaggcagatagcttgagctcaggagttctagaccagcctgggcaacatggtgaaaccccatctctacaaaaaaatacaaaaattagctgggcatggtggtgtatgactgtgggcccagctacttgcggggctgaggtgagaggatcacttgagcccaggaggcagagattgcagtgagcccagattgctccactgtactccagcctgggtaacagagtgagacactgtctcaaaaaataagtaagtaagtaaataaataaataaaattttacttctagcagccatgggcatttgcttcaggttattctgaagaacaatgctattctttttctttagatttccttccagaaaggaattcttcttagtttcccgttcaatctctcaaggtaataaggtatattttattaccttatttattgttttctatataataagcttttcatgaaggcttaaagagaaagtacaaattattattgtttttctttgacatttacatccacttactgttcctaaggacaattcagtccctcctcccatgcgtaaacctttctatctgattagatccaggttgttactgatagacataaaattattttataaaaagaaattatgttcaatgtaaaaatagtaatccattttaaattcccttcatttctgcagcctgtttctccagacaactcaaaattgtctgaatcccataagacagtttctctgagcatattgtttaatgagagaaactttagacattctgaataaaacaagggaattactgatgtcccaatgctctttgcaatgagtacctccggtttaccattgtggaggaaatattgcattgactttctaccaaaatccatgtcttatctggaagaatgcctactattcattgaaaatcatttccagacctcagataacacaaggaaccagactgccatatcagactcacaaaaatcagagctcttacaaagtatccagctttcctaataattcaaaggatgcagatgatgataaaggcaattcacaaaaatgtctgcgatcactagtgcagctcctcacatcctgtgccacacgaggatgtgggctggtccagatttaatgtttgaggtttctaagtgatgcatgtaggccatcgtttccacaaggaagccattgtggttacgaaacagctccatttgtttgctccataattatatctttgacctaacattttccactgggccatatcccacaaccccaggagttcttcattcatttgctgtaagcaacctagacagactagatacaccccgtaaaaaggatgccacagaaaagggtctcattacctttctgctagtaaataccttcaggaggcctgattagtatgtttccaaggattctttactgggtcatttctctctctctcttcctctcccttctcttcttggacgtcctcagagaagacacgatgggttactaaataagcccaaaccctttccttctcaagaaccatttctatagcaaatgttattacattatgaccttttttaaaaatgtgtgtgcccctctccatatgatgatttatcatttgtaacacactcagagtgcacaaaccatcagaaatccttatctactatggtaaaatttgagcttcacgggaaaaaaaaaaaagaattgaagaacttccaaagagttttcccctcgtctttgtgactggttgcttttactaccctaggaattaaatgtgatttttccctttaaacgtcagatttgggagtattgctccctcttctgctctcagcattcttactcaatgattagtcttcaacattctcacatactctcagccactttgagtaaacgaagatacatcattcaggagtgagaattaattgtaaacaaaatatttagatttaggaagattaaacatttttaccagagttatacattacagtttagaacattaataaatcattgtggctgagttttacaactgtttcagtttcatgtcaagccatgtagataatttttcctggccttctgctccttagaatgaccaagtcctttgaggctgaatctcaaggcaaatggagaaatttcttggttgaagtcaaaccagctgacttaggtagttcttgttcatcaatccattaattcaacaagttgccattaaaccttgtgctctgtggacagtattatcttagattttgggaatactgtaggaagcaaggcaatcatggttctggtcctcatgattctgacctctttataaagacctatagaagaaatcaagaaaacaaattcaactaaagtaattacaaattgtgataagccaaaggatctttgaactgggctttttatagcagttatattcttatgaggttattcaacaaagataactagcacacagaagaagattgcattatggattccggctgctggcattatagtatatggcttagattaattttcatgagattcccaaagaatgaaattaatcatccagtaccagagaaaatcaataaacttcaagctgctttgaaaatactaacataagaaggttaataccttaattgtaaagttatctgaaatggtattaatgacaaatgttttgtctcttagaatacacattggaaacttcctgaatgctgctgaaactgacgtgaattttttcctttgcataatttaatctttagatagtagattccaatcaagattttctgttccaggtacatctttaagcctaatcactttcctctttcctgcttttctcttcccaactccaagcacatgcctgtgcttataaaaaatgacattcaagttctgttttgaatagagtaaggctttagaggtttccttcaaaacagaaagccccgaagtgcctgtttctgtatattcctcctgtacatcctcctgtgcttcaacaatcaccattttaagtacctgccattaattcatccaacccttaggtatcaagccccagtgctgtagaaggctcaaactaggtggttgggggattattgtcacagatgctgtactcgaggaggatataacttcatggggaatatataaataataatagcaccataagttatatcttatcaggcattgagctgtaagattggagaggatggtaataattgtgtatattcaaagtaacacctgaagatcttttaattaatccacaaagcacagaatatacagttctactcacagattaatgatgatctaatgaatccattaaggctagattttcctctgtcgctggaacaaagaacagattcttcagtcaagcaccaaatagagtgggtggctatgtttatgggctatggcatatgaaaaaaaatacatgcatgttaatgcaaaagtcagtcttagtatattaatacagtattagtatattcatatactaactccatgagagacacagggagctacgatgaagacaaaagtaaacttagaatttccatcatagtctcactaatatttgaagtgtatatactcactgagtagatcatgaacacatttatttttctctaatatgtttctctctctctctctctctgtctcacacacacacacacacacacacacacacacaccattcgggtcaacagaaacaacataagaaaagtttcagaaagcataaattaagtgacatcaatggagcaaggaatatatgcaattagtaatagaaaatagtaacaaagtatagctgaaaattcatatagaagaccatgaatattaagcaaaatttggactatattcagtagtttatgtaaagccactgaagatttttgaaacagatagtgacattatgagtttgctgaaaggcaaacaggatgagttcagttgtaagcctactgaatctgagctgctgcggaggcaattagatgcactcatatctagctactgggaagtcctaactagagatgaaggctgatgagccatttccagatgcttttttttttcaatctcttcagtgcctagaacagttccaggcaattaattaactggaattaactgttaattaactgtgctcagtaattaactactgaattaatagtatttatgatattaaggatatgatgcatacataactaaacactgaatggaagaatagatggatgtataagtggggggagggagggagggaggaaggaaggaggaaggaagaaaaggaaggaaggaaggggaaggggaagaggaggaagggaaggaagggaaggaaaggaagaaggaagtttgcctcttgaatttttctagtctgaacctttctactaaatatctattgtgttgttcgacagttatttgtaaacatgaggtcagattctgggcaactttaggcatctcaaaagtttgttgtatgtgcaatcaagagtaaagatccggctgggtgcgatggctcatgcctgtaatcctagcattttgggaggccaatgtgagcagatcacctgaagtcgggagttcgagaccagcctgactaacatggagaagcccccgtctctactaaaaatacaaaattagccaagcatggaggcgcatgcctgtaatcccagctactcgggaggctgagacaggagaatcacttgaacccgggaggcggaggttgtggtgagccaagatcatgccattgcactccagcctgggcaacaagagcagaaactcagtcaaaaaaaaaaaaagaaaaaaaaaaagaataaagatccatgagcagccaatgattgcagctgtgattgaatcactttagttatgagatgcaggctgtttggtggtgaaagctgtggtgttgggagaaatgagagggagaatacgatactttacaaatttttctttttttttttttggagacggaagtggcagtaggaattagaagagcatcttagcagggcatgccttctgacagttgcaaagaagagaagcagctaaaagaagactaaaggtagaacagctctcctctctggggaggcaaagagccgttaaaagttgtcagtcacttctaaggctagcactgtgtttgtgtttctctgaagacttattacatatggcaagttctacgaactggaaagggggtcagaaaggcattgactataagggcaagccaagcccttcttgcttcagtagtttcctggggcatgactgttttgagacagctgaacacttcagtcttcactctcactacccaacacagagcagcagtgtggggagctaagtcaagttgagaagaatattcttgcttgctggactgagagcacaagcctcaaaacagagttcagaggatgttagcaagtatctggcatccctgccttctaacctgcaggctcatcttgctgataaggtgcgtgccattccagttcctgggatcagtccagtgctgagtcaaaacagaaggagctcaaatttactcttggttgcaccctgacactgtgatttctgggttccagcctttattctgtggccgtaccttatactttacctttgctgtgtccatagctttttcccttgttctcaaatctctatctcgtgtattccaaccctgtttgctatgggttattttcttaggtacttggtgtcttgccctacaccatagctcacaggtggttcttggcacctgccatctcagccaccagagcccagcctctacagtgtagagtccctccatctaggagggtcaactgctcctcagtggcccttttatttggctattctattactccaactaaaactctcctgctcagctacacctcatgtctaattttgcttccactccaaatacctaattttcagctataagctgaaagcacactccaaatacctaatttcactcttgaggcattttcaatcctccctgattttatcttctctgttatcacctggattcccagattgacatggagaaagctatgatatggctccctcctatttcctagtggaaggcaaagggtgcctgaatcacaaagttatgttaaccttaaaattgaacatagaattgtctacataaattcaaaaggttgaatgtaggaaaaaaaatggtgagtcaatataatcttggtttatctctgtaatataccattaaaactcactgagaaagatcactagttaaacatattgtaaattctggaaacaaaagctgctgagttctgctgaaatagcccaagagtaaatcacaacacctacaagatgttttatgactaagttaatttttttaaaaatcagaagtcatcatatctctgcttggtgctaactaaaaagccagaagttttggtcagaacaaatgtagttcacaaacactaaggttttggttgttcaaaataaatcacaacaccagaaacttagaaataataaatataaacatagagccctcttttgtggcttttctaaacaacttatttctgataacttcataatgctgctgaagctggtcgaatttaattatgcttgtaaagtctactcatttgtacatgggtaagtcaaacattctggttttaaacagagtaagaatagttttctaaaatatgtagtcagtcatgtcaaacctctggctaaagtactgttattttggtgcacatattctgagtttccatgaaacaaaacattcaacacctatgatattttatcatactcagcagttcaaaagtgccattcatttctgaagagcttgcagagtataagctccatgagagagtggagagagtgcttcaagatatattctctctgtacccctaccagtgcccatctagaagacattcagtaatcacatggtgaataaatacatggaaataaagtttcatatcaattaatcattgggcaagagaatgttttctggctgctttgtccattgttaaatctactatgagaaatttaaaggtaacaattaagatgagacccagaaaagcactcagtgtcatgagtcagcagaggaatgtttttgaaaaccacagtgatataccatgatgcatcccagaatgcctaaaattaaacatatcaacagcagcaagtgctggccagggtgagaaatagcgagttatacatcgccgtttgggatgtaaaatgttatgaacactttgagaaaccatttatgattgcgtataaagtaaaaaaaacatgtggttatcattatgatacatctattttattttcaggtgtttacccaaaagaaatgaagacatatagccacataagaacttgcttaatttgaaatatctcctaattataactaattcagcagtttattctaaatcaacatggaaatgaataaacaagggatgatatactcgtacaatggaatactacccagccaaaaaagggaggaaagaacaaactgctgacattggttacaatatggatgaatctctacaacaccatgaatgaaagaagcaaactcaatgtagttgacactacgattttatttatatgaaattctagaacaagtgaacctcatctatagcgatggaaatgagatcggtggtaggctggggccaagggtagacagaattgaccacaaagaggcacaggaagtttttggggttgatggcaatattaaatgtcttgattgaggaggtgacacagatgtatgcatttatcaaaactaattgaactgtacactttaaatgagtatctcttatggtatgtaaattacacttcaataaagctgattatacactaaataaaactaagacaaatttggaaagttggtacctatgtttataattatagacttttaaaatatattctattatgaataatgcttttagcctatggaatcaattcttcataaaaactcattacataattttttgatattgcttgtaaaatcattcctttagacctattgagtaataacggtgtaggtgaagtagaagaaaggttatatgttaacaagatgtgtccaggttgatcagtatcatgatttatagtcctcctctggtatccgtgagggagagggagagaagggggtagatattgagtctgattcatttattgacatcattggaactttctggattgtttagtgtgcctatggtcagtcttaatcctagccttaatcctgaacttttcaagtacttgaagcaataaattctatttttgcttaagctaattcgtattaggtctctgttcattaattcttttgtacaaaatttcgaaggaacggaaaatttaatgcattaaactacacataaagtttggtagatattttcccccaaaatactatatcttgttctttctcctgtatccctcatctgttctaggtaatcaactaatagttttttatgaataagaattaaatgtttctactttttattgaaagatttcagattactgaaaatgtgacaaaaaatttctaaaataagcatagatgttccttctatgaaaaaagtactgacaatttatctgttgttaaatcatcaatatattgtaccagataccattatttactccctattgacttgttgaagtttaactaaattaactatacttaatccatttctaccctaaacatttatttgaaatcattactacattttaaaacagttgcttgatacaaaagtattttctccatataaataagggatacctttaaattgtttacatttgtaaagtacaatatgtaaacagaattttgaataaattaagaatattttcactgtactacctaaaagcaaacaaacaaacaaaacaaaacaaaacaaaaaacctcaaacgcttctcagacttgcagtttgagctaaataaaccttctttattttggtgtatcactgacagctctgagttgactccaggacaattagaaagaaatttccgtaatacatataatttcctaaggtacaaattttgaagtaaataatggatgccacaaatgtaagttggtcacttatttcttttttctcttgtccattatcttcagatgtgtaatcatttgcaaatatatttactttcaagaaaagccctttttattttactgcttattattactgccactaaataatattattgtttatagggctgtgttctatgctttaaatgcattattatacttaattttccaaacatacatgtaagacagatggaggagattgggagtaccgagagaatgaaaggtgaggctgaatccatagtgtttgcagtatccagataggtgaagtaagaggtgaagtgtcttcatgtgagaaagaattggtgtacttttcagagaaacaaaggctttcttacaggaaaaataagccacagttatagttgcatcatttgtcaagagatttctaaagaatctttcaagataggaaatgagagaaagagaaagaaaggagattatgttttttctatgggagcctgtaaattgaactgaaatgaacagtccataaacagaatggaatatctagggtctggatcctagttccaggcagcttatcacctgctcccaggcagcagaagaacctgaactattccagtgaggaaacaatgctttcactcttgacagtcttccctaaacagtagcaaaaacttcctttcagaaattgaccatgatatcctcaaagttttggtatcaaaaggttttttatctaatgtctcatctgaaaaggttgaagatcacagaaaaatttgagtacagaaatatgtttacaatattactcatcagaaaacatatctatagaggctaaaggggttatgttctgctgctttgcaaaactcagagaagctgagtgggaaggcaaagagttcagatcctaaaatgaaaatttgtaaatcgggaggaagtgtatggctgaacaattcatattaaaatgtatcatgaggccaaactttttaatagtaatctattcatgtcctatatgtaaactctttactatattagtgcttagagcataatttgggcttaatgcatatagattgattgagtgactgaaaagataaatgggaaaaatagaagaatacttttttattctctttctgaacttttgtcattaaaatgtgtatttatttcttatgttcccactgtctttaaaatagcatttctttaaagatgattcatttgaggccacttgtaataggacaaaataagcaattgatgactgatgtgcttattaatggcctcgggtgtcacagaaaacaactgaggcttcaggcaattcatctttaatggcattaatgataccttttgaaggtgtgattactactataaaccagagtcagttgtttatttcaatttattcttcagtatgagctacaaaaaattatgaactgaaaacaatactttagaaaggcagatactcttaaaattagcaaatagctttgctaaattataatataggtcattactgaaaaacacagatgtaaaattccacttcaaagaaggtactttattttccttttccttctagtttaataggagaaataagagattcttgcatcattttaacaaatcaaaatgcaattattcatagaagaaaagcaacatgttaatctttcttaaatttcttaaatgagtacttttggaaatgaaaatgaaattatattagcaaaaatttaattagcacatgtggtgaaagattttatatgattcagttagtagatttggtcaatttatgctaattggcaagtaatacaatagaatcaaattatgtatcatcagaataaagaggaataaacattacaataacatttttcaagtatactttccaaaaggtcatttttaaagaattcgccccttctgaacagcacatactatgttcgctgggagctgaaagagtgtgtcagaattatctggcacttaaacaccagcaaggtgtctggaataactttctcacaagaacacggtgtaaatatcatttttcttctgtttgattattttgaaaaacatgcatacttcatgtgaactatagtgaagtgtctgattatccaaagaaaaagccaatatttgaaaaggtgttattcacaatagagccaaaatagaaacagggtaaaattttgatggaataagtggtagggatgaaggaagagcacagagactatgcttgcatttaaaggcaaagcatacagtaattataactatatttctaggtgaagaagctgtggatgactagtatatttttctccacaagatatctataaagaccattgtttggcttgtattaacatttttgtttgcataatctgacttgggcaagatatgtataagaaatgcttagctataaaacaatagactaacactgggagagtatgggtgatggagtcctctgggttacacggcatgctgtggcatagtgtcctcagctgcaaattagagatgatgatcgtaaccaatttctaggagtgttgagattaaataagctagtacacgtaaatcacttagtatagactcaggaaatgttagctcttaatattttgactctactgacttttttcgtttatttttcctcaacaaagaggacatctttaaagatttgttcattgtccttatgtgtgtgtgtgtgagagacacgatatacacctgtccttttgagcaagagtcaaattctcattgaggtcaaggtgtaatttgtagttcaattccttattcgtaaccattgaatgtggctctgccacaccaaggtaaacgtcttgctgtctccattatgtgcttgggttacaggttgattacacgtgatctatgataatctacaatctatagtctacactactatagtgttgttgtttttttaaaattatttccttgcctaaaagttctatttcaaagttgcaatactgcaccataggtttccctctactttctgtgtaacaagatgagaaaaaacaaaagagggaggagtggggaaatggataagataaacaaggatttttagtttccaaagaaactaaaaaagtcattatagaattaaaatatgcgctaatggcgataaagagtagaatggaactgtttgtgtatttgctttgtggctttctatattttccaaatgttttgatttactatctcagaatagacttagataataaaagtaacaaaaagaaaatgagatttttttaaaatatcttcacaatgatataaaaatatcaagtaattctgcataatctaatggatgtgttagttctctaggggaaaaagtataaaacttaatgagagatataaaagatcgaaataaatagatgaagtgtgatcatggattggaaaactgaacattttaatgatgttactcttccaaaattgatctgtagagtaaatgaaatagcagtctaaattctaacaggcttttctttggtgaaaataaataagctggttctaaactgtagatggaaaagcctagggccaagactagccaaaacattctagaagaagaacatggaagaaatctttctaccatacataaaagcttattgtaaagaaagaatcataatgaaagtgtaatttggcgtaagaataaacacataaattaatggaatagaatagaggactcaaaaattgatatatgcatttataaatgctagatttataaccaaggtagtgacaaagagtagctacagtaaaaataactatgttttaataaatgaggctgagatgaatcggtgtacatttgaaaaaatgaaattggcctgttgcatcacaccatatacaaaaagcaattcttggttgatgacagattgatgtgaaaagtgaaaccataaagcttttagaagataatataggaaaaatcttaataacctcaggttagaacatacttttacacacaaaaaagcacacatcataaggaaaagaactgaagaactgtgcatgaaaagatgctacaaataaagtagagaggaaagctatagaattaaagatattagcaacatataactctgacaaagaactctcatccctaagggggctgaatgagcctttgtggttgattcgtgggtgacatttctaaggcagggaggctacagctgcaagaacaaagtgcctttctattttgttaggccagtggatttgctttgcttcttgttggccttccacatagaggccacaggggcattgtacatagttgaaatttcgttcacattctgacattatatagggtttcatttctcctttgcagtgctgtggttttcattttttctttgtgtcttcatatgtgttttaggcaggatttgaagttgtctggctcaaacttcaagtcagatgcggtcttaaccctttttttttctgttcctaaaatctttttgtaatctttactgtagaattcttaatgttgacataaatttatgaatttgatatattttgtgttttcctatattctctgaaaattatatcacaatattcttctgtattgaaagatagtcctatataatatttctaattgaataattacaatttctttgttcaggttgtaagctaactaatttaccattcccttatcctggggcattttagattccctttttcataaagacaaaaaaaatttcagtgagagacttcttgaataaaacttacaagccataaaattatattttagataagttctctggagtaagataactaggtcaatgtgtataagtaattgtatgcttttaaaatatcttgtaattggccaggcatggtggctcacacctgtaatcccagcactttgggaggccaaggcgggtggatcacgaggtcaggaattcaagaccagcctgaccaacatagtgaaattgcgtctctactaaaaatacaaaaaccagcctggcatggcgcctgtaatcccagctactcgggaggctgaggcaggagaatcacttaaacccgggagttggaggttgcagtgagccgagatcgtgccacagcagagtgacactttgtctaaaaaaaaaaatatatatatataatatatatattattctctctctcgctatatatatatatatatatatatatatatatatatatacacacacaaaaaaaaaaccacaaaagaggtgatttttttccttttgccttgtttctcaactcacagagttgcacagctgcacagttccagtacgtgaattgacttctactttaatttatcatacctgattcagtaagtgattctgtaacctttactttcaaacatctctgacaccattgccttctttcttctccattgtcaccttcctccccagtgaacagaggcagcagtaacctaactggactctagccttgcactgaatccttcttctagcctcagactacttcacattgcctttagagacatctcccacatacagtcataaccatgtcattccacaccctaaaaactccaacggttctcacacaaaatagagccagtccttagcatgtcagaacttccacacttgattcagccacctcatcagagtcatatccacaccctctttgacctgtgatcacacaagtgaattagccattcccctaaaatgacttaattacaaaccatatcccaccacttatgagactgtgcacagtctctaccagattttcagactttctttaagaaagttatatcttaatcatatatgaataccctcatcttcaccaccccatgcctagcagaaggcctagcatgcataggatctttttagctataactaaaggactgaattgaactcaactggattgacggatgaacaatccttactcaaaagatattgaatgttcagtatttttttaatggaagtaatttatgctggtgcagaggtctctttatgacaagagcccatctgagattttgtaggaacacttagaaaaggatagaagtcttgttcattacagaaactgataacacaaactagttagttataactagaggtggtgacttacacctatagccctagcactttgggaggccaaggcggtcgatcacctgaggtcaggagtttgagaccagcccagccaacatggtgaaaccctgtctctagtaaaacaaaaacaaaaacaaaacaaaacaaaacaaaccttgaaattaaagataaatgtgctagaactagtcatcaacatatagtccaaaacaacaactaattctgctctctcaattttcaaactataaagaaactggactaccttctagaaacttccaatcccacataaattcaagccctaatctcttacctggactgtggcagtatactacctcttaactgatccccttccttcttctttgtactctccaaaatattttcagtgccccagtcagagtgatcctgttaaaacattagccagatcttgccccactctcttccagtctaaacttcctaatagcttcccattacactcagagtaataaacaaaaaattttttttaataatcaaccagaacctaaatgacttgattctcactacctcttaaacttcatctcctactaccttaactttcatttactgtgttccaatcatattgacctctttgctgttccctgaaaaatcacccacttccctacctcagcctctttgatttttgttgttttctctgcttggtacgttctcttctcagatatacacacaaccacttccttacttccttttgccatctaaaatttcgactcctcctgccacagtagttaataatgcccttttctgctttattttggtctcttggcacttaatgctatctggcagggtatagattttactcttatgcattgtctgcctcaccaatggagagtaagctccatgtggaaatgaatttttgtcatttttgtttattaatgatttcctgaaacctaggacagaacttaaggaatagcagggaattgattatgaagtcaataatgagcaaataagaaattccatggagaagaatttgctttttggttcactacatgacatagaatgagacagatatgacaacatggtttaaaatgtttaaaaactgagagggttaaaacaatagaatttcttgatggaaattgttatggactgaatgtttgtcccaccccacctccaaattcatgcattaaagcctagctctgtatttggagataaggcctttatggaggtaattaaggttaaatgaggtcataagggtagggacctgatctgctaggattagtcctcataagcagaaatgccggagagctcactggctccctgccatgtgaggacacagcaagaaggtggccatctgcacataagggagagagccctcaccaggaaccagattggatggcaccttgatgttggactttccagtctccagaactagaagaaataaatttccgttaagacacccaggttgtggtatcttgttacagcacctgaaggggactaagatagaaatgtaccttaaaactaatctaacctaagtctcttacttaaaggataagaaaactgaagccagagaagttaagtggctttctaaaggtcacaaagtcagtatataccagaactaaacccattaaccacgtggcagttcagtgctttctctacttactatgctgactcttataccactctatgtagtatatgattaacataaggcagacattcttaaaccttattctcatggaactctgttcttccaaaggctgtagcaggcattttgctattaaaagttaagggtgatggtcttttcacaatatcttatgggggtatttaactgatttttttcactacagttttcactacagttttgtgttttttgccaataaatttttcttttcctataaatacaaaagaaatatatatatatatttatatatatatttataaatatatttatatatatatttataaatatatatatttatatatatttataaatatatatatatttatatatatttataaatatatatatttatatatatttataaatatatatatatttatatatatttataaatatatatatttatatatatatttatatatatatatctgaagaaattctgaaccataattctctaaaagtaattctgtcctttggagatgtagtaggatggatacattaaatatgggtaaattttctgctggtacaattgatcctaattcaaatgacagaattaatgctactcagaattttattgtggggatcagaaaagtcaaaaagagtcccttgacttttcagagccctgcttcctggacttgtttgaaaggcactgatgtaacagcatgacacagctgctcaaaagctattatgagcctaggctgaatcaatagaagataagtgtgcaaatcacagagatctcagtccctctggacttggcactattagaacatgtgcatgttattatatctatctgttgtctattcctggatcctatctttaaggtgttactgactggcattcatgggtaatgttaaaggaatagggaatagtttgggaagtgatgacttaggggaataagaagctgttttcagaactttgaagggctgaaataatgagggaatggatttgttttgtattgtttcatgtgcaaaatcaagctctgtgcacaaacactgcagagaagtagtttttcactcaatataagaccaattagagttgttatccctggaactgttccctagtaaaagtaataaaatgtgttgaaaagtactagaaatgtaccagccatcaatccagaatatacagaggaaatcctgtttaggaagtgatttaaaacagttgatctcaaaaggctattacaacacaaagattctgcccttctatgaatacaaagaactggattatttattataacgaatatgttacaagcaagtgcaatggctgggttttttttttttttttcatgccttgtaaaggggaagagggtaaaggtagaaaggccctggatgactaaaatgaatgtaaaaggaaaaagaaaaaaaatgaatgaagaggaaaaaggaaaagaaactgtaaatgcacaatttgcctaagtcttggcctgtttttcaatgagaaactctgcactgagataaattctattcctggtggctgcccatgcacacacgtggattaatgccttggctgtcttaaaaagtcagctacagtctctgagaccctcaatttttacttagctgctgagatattcatgaatgctatataaaaggagaaagaaaaccattagaagaaatattttcaaggatgatatttcaaattattgcttatttaaataaatattgctaccttacattaaagagataataagatactaaaagcttgaaaattttttttgattctaagagcaggtagaacatacttatccttaaataacaccttttccttttaataacatctaagcaatgagatttttacctttttttcttggtggtttcttctttagtcatttgtttctttctttaatgagtccttcctaatgatgttttatttttcacacttttatctgttttctctttttattaatgcttatagtattcatttttatttttgtagtatattttattctttttctcttttgaaaagtcatacttgaataaagtacatgtctcaaaaaaagacaaggacttttgcattttatattgattccttaattttaaaatttttaggttaagaataattctgtactatccataagtattgctttatgatgactatgcttaagttgttggtatatgttataatatagcatttcaaccccaaatacagatttctgttctgtactcttgggaatttatggaggaggagaagacaaaatttaccttcttcaagtctaaaaattatcacatttgggacacataaatccccatgtatctctttaaggacagcatattatttttaaaattaaaatataaatgtctaaagtagagaaaaaataagttcaccttgtccttatatggaaattaaagatggttgcttaaagaataatttagaatggcaaatgtctgaaggtttgctgtaaattccctgagatcttatatgatgttcacaccgactcagacacatacaaatgtcatctctacagaacggccctgaagagagcaatcctgggagcccggttcccctgttgaggcccctacttgggtcagccctatagggcagcagcttgtacactgggccctgctccccttccctctcctactgacttcaattccattgttttttcaagacctttctaagtggcaggaataaaactgatgatttaatctataccaagacattaatgattaatagtggccccatatattttcccttacatttaatgtttgtattataagggctttttatgccttagctgaaagtggtggtaggaattttaggcccacatcatacacacatctgcaaataaccaatctttttctcatagctataattatgcattggcattttatttacttcctgcaatttctctaagtgcatcattttgttctatatatagtattttaaataatacatctttagcctgatgtatttttgaaatatttgtggatgctaatcctatctctgtcacagagcttatttatacacacacatctttctcctcctgccttaaaccccttggtttattcttcccttgttccagtttactctcctatggaactttttaccatttgatgagatatttttaaggaatttgcagataataggagcttccagaataccttcacctgactcatgcttcggcataaagtccccatattatcccaaaactcatctacatgtttagttttcaattttcttatagccttttgattacagtgccactgaaaatatgtcatatttattgctttatccactgctttctgaacatagacagagacactgtaatatttttctaatactttggaataaaaagaagatagattatttgttgaataaatatgtaaatactaaaacacaagttactttcttgtcatcatgctatagtcttcatatgctttacacagagtatgatttggggtaaaccctagtaaagctgaggaacatataaaatgttcaggaatcacattctggaataatcatttaatgtttatgccatgctaaaagagttgggactattatctgtggaattaaaatttggagaaaagaaatggtaagattagcccactgattgataagccagaggtagcacctgtagtttcatggaggccacagctcagtgatacctcggtccctgaactggaaaataaagctaagcttccatttgcagatgttccagaaaaaaataaattttatatttgtgtttttactgtatttttggtagagacggggtttcaccatgttggccaggctggtcttgaactcctgacctcataatctgcctgccttggtctcccaaagtgctgggattacaggcctgagccaccgcgcccggcctggaaagaaagaaattttatgaaatcaaaggagctgctatatctttttcttttgtaacaaacataggaattttcttactggaacaaacccatagttgacctcttatagtactctatgtgtggaagggagaaaacattggtacttctacaaatgggtttcaccaccttttataataaaaacagaagatattcacaaaaatagctaaaaataaggctagcatgagaaatacacaaattactctttttctattatgaaattagcatgcaatctttttttttgtaagcaatccaaccatttcaaagagggtgtaccctccagataatagtgaataaaaaattcagtgaaagaaagtaagcttatagctgctataattttcagaaccattatgcatcctcttgcagctggttttgttggtgctgctaagcgcatcctcctgggcccatccacttagtatttatgggcatcaactaaggattgaagacgggagattagaataaatgtaaatcttagtggatataagatttttgatgaaaatgtttaaacggtacttgtatgccacacaagaccaatggcaattttcatgttggtcgtaatgtttataaatttaggtatataaatgaaggagaaacgtagagtagaagaaaaaaagatctctgtctttacatataaaagggctgaaacaaataattactctttatgctttgtcagatggtttatagtttattatgatcaatgtaatctcattttttcaagctgttttttagcaatcccgaagtgcaggaagatacacgctgttgcaaaactgttaaatgactgaatcaggactccaagccatgttttctgacttcaagacctgtatttaaattcctatagtattcttggaaaatactagactcagggatgttttcacagagtaatatgttttgaaaaatgtgtctgcgaaactgccttaaaacttgctatctcctgcaagtcatctggagttcaccagaagtctaccttttcaactagtttccttatataggaattttaaaaagtgagcagaaaagcatcacactttacttttgagaaatgtgaggcctccttgaaagcataatctattcccttttaacaaatacatagctcacagtaatgcagagtatgagactaggtagagtgattttagatgtagttatttttcctatttccttatgccacaaaatcattttttcacataccttgtgtaattcctgtgaatgattttcaagggatcttttggcatgtacaattatttatcatcaaatatttgtaaatgaaagttctagaggatgagacagaatatagacagctaatcttacgactgctctgaatgacaggcacagaggcaacacagacatttctgaaggagcaaaatgtcagtctgcaaaattgcctttcctagtttgatattggtcctcactgctcagaaatgaaaacggaaaacattcacgaggcattctagtataattgccagtggctgcttcactatatacagttaattagtatatgcatccatacttttaaaaagcaatacttttacattaacaaaccaattgttaatttaaaaattaacaggttttttttaaagttttaatattataagaatatttctgaggtcagtatttatacctctacagatctacatctagccacagaaaatccaaaatataatttactttggaaataaagtttcccatctgctggtccttaagagtaattgctggtttcactttgaattatcaaaatgacattcaggaccaaaaaataagaggcatgaaactactttcattgctactgtcagcaagtgaatgattcactttgaatttgcctgaagttgtcttacagaacacctgtccaagctcattccggttccccttttgacgcttttcttcactcctctcctagcaaataaatagggtttcttagtctaacacaaggaatagaagtataagaagtggggtctgctagtaataaggcttcaggtatgtgccttaggaagtgttttgtttgtttgttgaatgtgaaagacttagccaggaagggagaataccatttgcatgtataattttccaggttctgtttaaaacaggtattcttttttctacttccaagtgaggagacaggttcctctgaatagagaaatcctacactctgcttaatatcactttctgggacaaatttggttcttatagttctccagtggttacagaatatcaaatgcagcaaggaccctggagcttcagtaactattggtaacttattagttgcctcttttgccaagataatggcaaaaaggaaataatgaaaatgacatatttttatatttctgtatggcagtgctgatattttcttagatcatttttctaatattagaggagctctttatgttgccttatgactgctgacatttcatttacttaataaaatcaagttagcagtagactgttgtagaaaggtagctggacactaagtagaagaactgggctcaagtctcagatttgtcccttttgcctgtggtaatggcaaataagtcacctaactccctggggcttacactgctcacccttgagaaaaagagattggacttgcagcttttacagtggcagtggacatggctagagcttggatagtgctgacggggttcaggaaatactaaggaggatgaagctttgcagatggtaaaattattaatctatgcaatcttcagttatggcatcacctgaagactctcagaatctccagttctatacttaatgaatgactttgaagaggaggatctatcaaaagactggatccctctgcatattgtttacaatcaggttagaacttagattaaatctcaaggaaaacaagactcctaaaagcttactagtcaaggaagcctttcatgcacctgatagaatcctccattcaggccgggcgcggtggctcacgccggtaatcccagcactttgggaggctgaggcgggcggatcacgaggtcaggagatcgagaccatcctggctaacacggtgaaaccccgtctctactacaaatacaaaaaattagctgggcgtggcggcgggcgcctgtagtcccagctactcgggaggctgaggcaggagaatggcgtgaacccaggaggcgaagcttgcagtgagcggagacagcgccactgcactccagcctgggcgacagagcaagattccgtttaaaaaaaaaaaaaaaaaatcctccatcaaagttggggtgactatgaagtagaatctctaaagggggccaggatgttgattttgttccagtgcgtgtctaatacccaatcagaagattatagacatctatctcaccatttgagtaaatgcaaaataaaaataaattactacgaaacatttgaaagttagtgaataaaataggttgaattcagtaagtgctaaggtcatttctaggttcaaatatttttgcaaaatcaggaaggtgcaaaggcaaagcacaagcgtgctaacagcaaatgtgaaaagtatgtcttgcagccaaggcattctatttgtattttgcctgtgtcttagtccattagggctgctacaacaaaataccttaaaatgggtaatttataaataatagaaatgtattgctcattgtttgggaggctgggaagtccaaaagcaaggtgccagcagattgggtgtctggtgggaagccactctctactttacagatagttccttcttgcagcatcctcacatagcggaagtggtaaagaagctctctcaggcctcttatataaaataagcactaatcgcattcttgagggtggaatcctaatgaccaaattacctctgaaaggtcccaacacttaataccattgcattaggggttcagtctcaatgtataaattttgaggggacacaaaaatttagaccacagcagcctgtttatgtcatttcctctgaaccataatcattgctccacccgctaattttactctctctctcctctgccttctcagctatctacaatcaggttgtatagtaactatttatgtgctaatcatctgtgattgtcaccttagggtataatcaagaaaatgatgcataatgttgggaaataatactgcagtttaaatcatatccatattatatttttaagcaaattaagaaatttgaaaccatgtaattagaagcagtatcttcttatctctaaatattcaaagtatggacagtgccaggtacattcacagccattctaatatttgccaaatgaagcaagcctttttcaaatgaaataacgtagttttcacttaaacaatccctagtgtgaaatcaagaaaataatgcataatgttggaaattaatactgaaatctaaattatatcaatattgtatgttttaggtaagttgggaattgtgtgcccatgtaattagcgagttcataaaattatattttaactgcttttccttcaaattgtaggcttttctgagagtttagttgctattgttgttttgtcttcattgttgtttgtgaatttgcaagcacattttaagttttccatttaagaataagttgtatagaaatttaatagacttactacaggtgtccatattacccaagcctctgggctgtttggttctctccaaatagaatgttgagatcaaaatcctttttggtgcttatattagttttctaggactgatgccacaaagtgccacaaactgggtgccttaaacaacagaagtttgtcacctcacagttctggaggccagaaatttgagatcaagatgaccacaagtttcgtttattgctatagacaaaatgtgtcatcccaaaatttgcatgttaaaatcttaacattcaatgtgatgatattaagaagttgggctttgggaggtgattaggtcttgagagtgaagccctcataaatgggattagtgcccttataaaagagaccccagagagttccttctcccctttttgccatgaaaagacacagcaagaaggctgctgtctgtgcaacagtaagcatgccttcaccagacactgaatttactagcagctgtaacttcaacttcccagcctccaaaactgtaagaaataaatttctatagtttgcaagccacccagtttatggtatctttctacagcaacatgaatggactaagacattcctcctgagactaagagaggatctgttccatgcctctctcctggctcctggtttgctgggagcccttagagttccttgatttgtagatgcatcacttcaatctctgcctttgtgttcacatggaattctctctttgtgcatgtctctgggtccagatatcccctttttataaggacagcagccatattggattatagctcaccctgaagggctcgtcctaactacatttgcaatgacctgatttccaaacaaggtcatattttgagatatttgggattagaacttcaacgtaaaaatttttggaagacactattcaacccataacaatgctcatttgttaagataaaaccaaacaaaaaagaacattttaaaacacaaagattatcttcatagccctctacaaactaaaaacatatatatatatatatatatatatatgtaacatataataacatataaaagcataaaaatatatacaggtttctcagacatacacattctcttaatattctgggctctggactaatatatatatatatatatatatatatatatatatatatatatatatatatatatatgagtttttttgagtgcaaagagcttgggtgagcagagtgggaaatgagatgaaagaggtaaaagggtcttggttttaggaggatgggaaaccactgaaggttttccagtaattgaaggttttccagtagacatttgacatcatcggatttgtgtttttttatatatataaatatatatgctgattgcaatgttagaactgataaaagccaggcttaagtgattggcagactgtggtagaagacagctgggagctggcagctggactgtgctgcagtggtggtggtggttgttgataaaaaccatcaccttcagtagctatgtgttgggtaaaatgaacacgatattgtgatgcagtggctgtgggaagagggcaggggaaacaccagggacgattcccactttcttatccacaatgccaagagagaaaacactggatacagaccagttttgtggagaaaaccatgattttatatttgcaaatataacactggagttggatgtggctttgtgagactccagtgcacatagcaagtaggcaattgtatgcttccatctggagctcaagaggaggtcttgatgagacataaattttgaggttgtctatgtacagttgatggaaacctgggtgtgggaaagttgtcaccttcagagagaaaatagaatgaaacaggaagagtggctaaaaataatctttaagacacttcaacatctagcttctaggcagaataacacacttcaaactcaggaagctctggactcaggaaagccaagagaagaggatggctcaggagggaagggggagctgagtgttgctgagaggcccaataagatgagagccaaaggagccagtgaactttgtaatatggagcttcttggtgccctaaaacttactatttggtagaataataggtgggaaagccagaacaaagtaggttgaagagggaccaggaaggacaaaaatggtgaaagcaagaatagggtaaataagcgaaccagctagaaaatataggaggctgtgataagagttggggatgcttgaattagagattttggagctggaaaaaagtgtaataacaatgacatatagtaaagatatacagatgaagatggattaagcagctgaagttaaaaaaagattattaaaaacaataagctacagactgggtgcagtggctcatgcctgtaatcccagcactttgggagtccaaggcatatggatcacctgaggtcaggagtttgagaccagcctagccaacatggtgaaaccccatctctactaaaaatacaaaaattagccaggtgtagtggtgcagggctgtagtcctagctacttggaaggctgaggcaggagaatcacctgaacccaggatggggaggttgcaatgagccaagatcgtgccaccgcactccacccttggtgatagagtgagactctgtctcaaaaagaaagaaaagaaaggccaggcacggtggctcatgcctgtaatccccacactttggaaggctgaggcgggtggatcatgaggtcaagaggtcgagaccatcctggccaacatggtgaaaccccgtctctactaaaaatacaaaaattagctggcgcatgcccagctactcgggaggctgaggcagaagaatcacttgaacccagaggtggaggttgcagtgagccaagattgcaccactgcactccagcctgggcgacacagtgagaaaatgcaatgagatacaaaattagaaatcatattctcagatgagtggcatgcatactctaggatgggcaggtcctcaccagacccaaagactctcaacagtgaggagggggtctgggaggttggagatgacagcaagatggagactgagaggatgatgtgccggatggcatgagcctcacaactgtgacctttatacaagggcttgaggagatcaggcatgactagaaacttaagcctcagttccacccacaaacctggactgctggggatggcagagagaggcagccaccctttgaaaagcctgcagaggaagcagcagcgtggggagtgcagttagtacagagtgggagggaagacttgcaagggagatatttgagagaactcttaagatttttggaatggatttcagaaagcactgtggaggcctggcacattggcacatgcctgtaatcacaacactttgggaggctgaggctggaggatcacttgaggccaggagttcaagaccagcctgggccacactgcaagacctccatctatacataaaatttaaaaattagccaggcatggtagcatgtaactgtagtccctgctactcatgaaactgaggtgggaggatatgtggagcccaggatttcaaggctgcagtgagctatgatcatgccactgaactccaggctggacaacaggccactatcctgtctcgaagaaggaaagaagggagggagggaggaagggagggaaaaagagagagagagagagaagacaagacaagacaagacagtagaaagatttcaagagttgttgggcatcagagaagtacagggctgatgatgggaatagtgatgcatatggtagagaatgaatacctgaatacctgcaggtgtgcgctttcacttcagtattacaccatgaaaatgggattgcaaagcatgtaaacatcagcactggtactgcagatggctggagaatgcatcccactcagctggggtggatgtggtcccaggagtcccaggcaatttggtatgatgtgggtgcttcagtatcagccaggtacagctcacaggatatgtctaaaggagcaactgaatttttcagacagatttgtagacccaattttgtaaatatcactttcatggaaaagtggggagaggtgacacaaagtcaaatcaaatattaattctgtttgaagcgattccaaaatagtcattgtataccacatggttagaatcattaattaatggcttaaattattcattatttttagctgtttttgtattctgtagttatagcctagagctgtactttaacaaaaagcaacaatatttacctatgtgaagtagttatgagtatgaggaggtaattttttaaggtgcttagaaaacaggtttgtaaaatagcagacttttaacaagcaaagaaaatcagtgctgagaaagctagttagtaacatctcattagtaagacttttttcattttataataattaattaggcagccacattaggcaataatgagagctagtaatcacttttttattatggaaattagactggactcattttaaaacaacacttaatgcatatgctgtaatgaatatggaaaagtataagttgcttaagcaaaatgtataagattttgtactcctcccacaaaaataagtgactaaagatgggttgaaaagcagagttacttttctcaacttgtggattgtggaagtacattctctttgtattcttgaaggactgagtttataaggtggactgattttgtattctttgggatagtattattctggacaggatgcatttcattttcttaatcctttgccactagaaatgcaacagaggttattaactcttgttatttgtgcagaatcttggatcacttaaattatttgctgcatatttaagagactcacaactaaatgtagagttttaaacatctactggagtatagattgctctcaagttgtcaatttgatgaatcctaaactgtcctagtcaaattttgcactcctctgaagaccttaaagaggtaacttttgtaagaagcagaatgtataactttaccttctgagaaattagacaattgcaatatgaccttttcaggcatagtggggtgtggcttgaatgcttgaatgtttgttcttaccacttattttccagataagctaacaaatacttagagaaatcaagatgctcaaccagagtcccacacagagaccatacttcagtgatgtttatgctctttgttgctcaaagtcatgccagaatatcttcactgttaatggcactgtaggtccttatcttcattccctaggccttacataccttctatatgcaaatgacatcaaaatttatctctcacaccatcctctttcctgagctgaagacttgtattttcaacttgctatttaatagctcccttcagaaacctcatcagcatctcgatactggcatggcctgacctgcctccaacccccctcatcatcttggtggatgcagcggtgacgcagccagttgctgatgcaaaaaatcccaaaaatcccaggaacctctttccgttctcttactcccacacctcatggagaccctcatgaatcatccagtaggatatactttttttttctttttcttttttttttttttttttttttgagacagtgtcttgctctgtcagccaggctggagtaaagtggtgtgatcttggctcactgcaacctctgcctcctgggctcaagaaattctcctgcctcagcctcccaagtagctgggattacaggcatgcatcaccatgcctggctaatttttttatatttttagtagggaaggggtttcaccatgttggccaggctggtctcaaactcctgacctcaagtgatctgcccgcctcggcctcccaaagtgctgggattacaggcgtgagccaccacgcccggcccaatagagtacactttaacattagaaacgaagtcctatcgttgccaactttaagacctaccctatatctaacttctcaccactatccaaaccacaaacaacctttcacttcctccactgcagtcacttcttggctggtcgttctatttactacatggcagaatattttattttctaaaatacaaatccagtctccccactgctcacaattctctggcatcttcttatcactcttaggatgaaactgtgactcctccccagtcttacccatgactcctctgctttgcccagacatccagccacacaggtgaatgtactgacagcttccaagctcttacctttgccccttgtgatggttaatattgagtgtcaacttgattggattgaagtatgcaaagtattgcttctgggtgtttctagaagagattaacatttgagtcagtggactgggagcgaaagtctcccagtgtgtgggcaccatctattggctgctagcagggcaagaaaaagcaggcggaaggaggtggaaggtgttgacttgctgagtcttctggtcttcatctttctcccatgctggatgcttcctgcccttgaacatcagattccaagttcttcagcttttgcactcttggacttacatcagcagtttgccaggctctcgggcctttagccacaaaccgaaggctgttctgtcggctttcctacttttgaagtctgggactgggactgagccactattggcttccttgctcctcagcttgcagaaagcctattgtgggacttcaccttgtgattgtgtgagtcaatactccttaataaactctttttcatatatacatatatcctattagttctgtccctctagagaaccctgacctactatacccttatttctgcctagaaggttctttccccaaatctttagttgtcatgtctgtttatcattcagcttcccgcttaaatgtcacctactaggaagagccttcctcaactgtcctgtgtcagaaagtccaccacccaccccagcacccctccagccctgctcactttcttcaacatatatatcactatccgaaagtattgattcatttccctatttattttctgtctttctttccaaaatgtgggcaggaggagcttggctttgcttactactgtctccttaatgcctgcatagaggaacagagttcagtaagtatttgtcgaatgaagaatagtgatacacttcttcctataatttgatttttaacctctggagattatcaattggctcacctccctgctaaaaggaaacctgatttattgtaataaccctacgttctctacgctactctatccccaaaactctgctaatcatattatttccatgttgttataattaatgttacttttatcccattttataacttgaatttcacagttgtttagatgctattctatgtttgcatggattcaatattcgccatcatttctctactgtgtcttccttatccatctcatggttgactgtagtttactatttaataactttttaaagaaatgctcgtgagagttaaagtccgagaacacttgtttgttgggtaatataaaccctccacctatgtggcagtttttatgggcatggtcattattggatcataacttccacctctgagcattttgcagacgttccacatctcctaggactgatctctggatacccacagaaatatttgctcttctttttcgataaatttcctgtaatattctcatttttaccaaagcctacaagtattccttggaagtttctactttcagcaaattcagttctctcttgtaaagttacttttctattacattattatttttaaaatgtcatctgttatttctagttgcacgttttgtctttcattatttttgtctctttactaatattaatcaactttttgtccttttccattttattttgttcatttttttctcatttgtcctagatgcctctgatgacattttcagtaaagccagtttctcctcttgctgattttcatttctgtgttgattttttcccttccatttctttccaaaatctatcagttcacttttcaactacctccattgtcctataatatcttacctgggagcttctagaccttctttgggctcctgttacttacatgacatatagtcatacattttatctgatttgtcatacctcttgtttgatatatatagtctttctctggccttctgtttgctgtctctctctctctttttttttttttttttcatttaggtagtatctttgcataggtctcatgctttctttttggtatttactcatcactgaataagggaactaattcggttatgaagataaaaaccagctatttgcactaggagagtataaggaagggacaaggatagtaacccaggacaatgcaacacagtttgcactgtactctgatgtcttcagcatactcatgcatcctctgccccagacataaatgtgccctcagctagcaggaaaactccctgtgaagctgtgagatgcccattgtgggtttcctctgtactcattgagctcttacttctcttcagttggcaaaaagaggtaacttcaggaacatgcgccatacacatgttcttctctacgtggccacatggacaagtcaggcttcagcgaaaggacacggatgtcatttcctcatcaagtctcctcttccccactgctccgtgttgcctgccattccgggcatagagcggcttggcccagaaaccacacaaatgggccttgttgttccaaggtgggtctcctagtgtttcccctaagggcaccacctaattagaagcattctttgcttggtcagctctgcctaagttctacaggggatgtggtcctctctctgtgccccttcacctgcagccttgctctcagaatctttctccacgtattatagtatattattcaggcatttccaaataaagacagagtttcttttttaataacaactttatgaagatacaattcaccactgttaattataccatttaatgctgttagtatagtcacggtgttgtgcaactatcaccacaatcaattttagaatcgtttcagtaaccgaaaagaaaccccatacccatgaataaccattttctatctccgccaacttctcagccctaagcaaccactttctgtatctatggatttacctatcttagactttgcatataaatggaatcattgcaatatgtggcattttgtgtcttgcttctttcacttagcataatgtttttgaagtcaatccacgttgtagtgtgtgtgtgtgtgtgtatatatatatatcttagtacttcattccttttattgctgaataatatatctcattgtatgactatgccacgttttatttataatttatcaactgaaggacaattgagtttacatttttgcctgttattaataatgcttctatgaccattcatctacaagtatttctgtagatatatgcttttaattttcttcatatatattgatgagttgaattgctgggctatattgtaacagtatgtgtagcctttgaggaactgccagactgtttttcaaagcagctgcaccattttacatccccatcaacagtgtataaaggtttccatttcctcatattcttggcaacatatgttattgtccatcttttttattatggccatcctactccaggtgaagtaataattcagggttttgatgttaatttccctgatgactaatgatgggcatcttttcatgtgtttatcggccatttgtttatcttacttggagcaagtcttattttgattttttgcccacattttaattgaattattaatcttctttattaatgagttgtaagagttatttacatattctggttttatcaggtatatggttttcaaaaaatttatcatctgtgtgttgtctttttacattattaacagtatcttttgacgcccaaatattttaattttgataatattcaatttatttattttcttactttgttgcttgtgcttaagtatcatatctaagaaaccatttctaattcaaagacatgaagacttactacacctatgttttcatctaagaatttaatagttttagcagttatgttcatgtctttaatccacttgaattaattttgtatatggtgtgagataggggtcaaactttatacttttgcatgtgtataccaggtgtagcagcttcatttattgaaaaatactgctttttccccattgaattgtttggcactctggctgaaaatcagttgaccataactctgagagtatatttctatttaattgatctatatatctatttttatgccaataccacactgccttgattactatagctttgcagtttttgaaattggaaagtgtgagtcctccaactgtgtttttctattttaagatgcttttggctgttctgagtcccttgaattttcacatgaaatttaagatcagcttgtcaatttctacaaagaaatcaggtggggatttaatacaggttgcattaaatcagacctcaagttagggagaagtcccatataaacaatattaagtcttttgatctatgaatatgtgatgtgttttcattcattcagatttttgctttctttcaacaatgtttgacagtttttaaagtataggtttgtgccctttttgctatatttagtcctcagtattttattatctttgatgctgttgtaaatggaattttctcttagttttatatttagattatttattgcaagtgtatacaaataaaattggttattctatatggatcttttattctgcaactttgctaatttttagttataatagtttttagtggattccttatgatgttttatatacaagatcctgttatctttagataaataattttaattcttcttttataatctggatgtatttaatttatttttcttgcctaattgccatgactagaacctcctataaaattttaaattgaagtgataagcacatacatccttgtcttgttcctgattttagggggaaggtattcagtctttcaccattaagtatgatattagctgtggttattttctaggtgtccttcaccaggatgaagacatttccttctatttctaacttgttgagtgtttctatcattaaagggtgttgaatttagtcaaatgctttttctgtatttattgagatgttcatatggttttagttctattccatgaatatggtatattagagtcaccggttttcagatgttaaaccaatcttatacattcattttattcatgagatatgatccttttcatatattcctgggtttgatttgctagcatttcattgaagttttttataccacaattcataagagatttcagtatgatttttttctggtgatgtctttttctcgtttcagcatgagggtaataatagcctcatagaatgaatagggatacctccttttctatgttacgagtttgttttgcagaaatcaccagtgaagcttgtacttttctttatgggtagttttttttttaaaaacaattaattcaatcttatttgttaaaggccgttaatatattctatttctttctgggtcagttttggtagtttgtatttttttaggaatttgtcctttgcatcttgtttaatttgttggcatatattagttcatagtttcccttatcatcttttttatttctgtaaagttcgtagtaataccccatatttcatttttgattttagtagtttgagtcttttccattttgttttcttggtgagtctagttcacagtttgtccattttattgatcttttcaaagaattagttttgattatgttaactatctctgttattttctataatttattttgtatatctccactctagcttttattattttcttccctattcttgcctagcatttagtttgctcctctttttttaatgacttcagatgctgtttgcatgacatgtgtttttccatcctgtcactttcaatctatctggtttctttgaatctaaagtgtatctcctgtaaacagcaaatagttgaatcttgttttttattttatccagtctcacaatttctgccttttaattagattgtttaatctattcacttttaatgtttttattgacatatttgtacttatatttgccattttactttttgtttcctatgtctcatgtcttttgtttctcaattgttttattactgctttcactgcattaactaaatattttctcctgtttgtcttttcatttctaattttatttgtcagctttcgttggtttcaggtgttcaggtggtaaggagaagcagagaagacattgctcttccattttaaattagaagttatctgtctaaggtcttcaagggcaaatatttcataatacttttctacccccatagtagatatgtgtgaggttcatcacaaatcctcctctcccaaacatcttttcagtttggttcagtgactgagtcattaggtgctagtaaagaaatctgggttttaattctagctctgttattaactagttgaatgatcatggaatattcatataacctctcttggacttattttctgacatataaaatgagagggttgaatttgattttatttaatttcccttttagcactgatatgctaaatttccagtaatactgtgatcatatggatctaaatacataagcacataagccaggcagagttaggcattttgcttcttgcaataggcaatcttatctacaactgattttgaagcataggatttaactagatccacaatatagtaaaataattatttggcccaaactactcactggccagtagcccacagattatccccttatgtgtaagagaccatgatttgagaatagaaggaaatacagactttgaagtgattacaaatataagctagtccaagatgcctcatgagaataaaagctttatgtggagtcctatatctatgtccaataatttgtttaaaggtattttgttagcaaatccattatccattgactgtctacagtgtgcatacctctcaagagtggcttatgtactataacaaaaacacaggagacccgctctaattggcctcattttaaaatgaaagggagaataaacacagtggcacctttaattattaatgacaattgaaggaagccttagcacaaataatcccaaagacatttctatttggcttggaattttaatattgtttttgacagatctatttacctaattatattttatctaggatagtgtttaaatgaggttctgtttgctaagcacttaccaacagagcagtagaagacatggctacaaagtgtattgcttatagcaggaagctggtccaggatttattaaaaaaaaaaaacataaaacatgttttgtgaattatccataacaaggaataccctcatgcagataatcaacaattgaatacgcataaaacacagatgacaaaaaaacaaggaagcttctctataaccaagcacagctgggcaaggatgcacagagatgctgcaggggattcatggggtgactggagtcgagacaattagtctgtaaaagcttcgtgctgatgccctcctgcagcacatttccttaacatctttaaaaatgcaccagtccagctgtttcatggagcatctcaggcttttaagacctccgtttttttgtctcattcattctctttattaccattaacaaagagtgggtcttagacagctgaatgttctacttacttaatgatcaagatcgtggagatagtttcaataatctaatggataaagaatccagaaatatcttaaagtttgtgttttcaggcttattctctgagtgtcagtccctctcaactagttcttacttagtcccaccctgataccatgctgtcaaattacttgctattaacttacaaatcacattctcctgttataattctcgttgagggaacatcagtgtcccccctaatttcacctacatggttacctttgtaaaaaaaactatctgagacacctgtgcttattcatgatactgtattatattgaatggttttagactttagtcttcctttagaaaaaattctcaacttaactttgtttcatgaatacctgtttacttctatatgttgcattttagattcccttcagaccaactaaatatgttcttattgaccatcaatgaaaaaaaaaggtatctaaaaatgggaagtatttaagacttgtactcagtcaaaccctacgtttgagggtttttaagctgtttgataacaaccatcctctgccagcatccccccaatatgtttcataaaatattacttacatggaattttaacagatattttgtcaaaataagttttagaaacacaaagtaaaataatttttttttacactttaggactcttggagctctggatagtataatgtgccttatgaatcttgaatagaggaatgtaatgtaatgcaatctcccaacatttttaatgcatatccattctgagaaatatcttttgtgtgatgttccagcataaattactaaaggtgaagagatacatatttgagctataaagactagatctttttttcctactttcattcccaaataatacaaaaactattcatcaaaatgttaacactaaaacaaatagattaaaaatttcaacataaactgaagaatatggtaatgacaccaagaagttatttaaatcttcagtatcaataattacccttcaaataacactatgttgctactctgagtacttttatattcgtgtctctatcgtggtaatacagccgtaacttgtcttcccacttagaccgaagaaaattaaactaaaaatgcgttagtagggcatatagataatgaataatgtgctcctttagaaaatattaaccatacttctgccaaatacattgttgtcacagtgcacggagaacttcatttcacaaggctttttgcaagattgatggtgtaacttgagtaggtttggcaaaaggagcatgcaaatttcagcaatataattacatcattttcccttatggataccacccaaccgagaaatagatccaatagtcagatgagaaattaaatacagtaccagctttattagtaggtcaattagcatagttttggctacaaggaacaaaaatcaccaaataaaactgacttaaaagtagggtaatttctcatctcaaataaaaagctgttcagaggtaagtttactccaggatgtcagggctctagagatacaactcagtgattctctgggtttttgtcctgtacgtaatggcttcatccttgcactggaagtgagatggctgtgttagctacagatgtaacatctagacatataaacattcagaggaaaaacagaaactccactcttacttaggagtaagaaaaccaaacctttccagtaaggctttcatgaatttccctctcattttattggctagaattgggtcacacactcattcctaaatcctgacaagggaaatggatttaccatgattgatttagacaaatcagactatcctggatgtagggataaaggtatcctctcttcagctactttagaggagtcgattttgggggaaggaaaaaggagagcagagaatgaacactgaacatagtaactgagagtgttcacactattacccagcacacagggtctctgatgaagtctaaccgtgttttcctccttgtttccctccatattgaatttatccaactagatcgcaggcaaagaagatggatgatggtaagcttgctgaagctcaccttctctcacctgcctacacatgcaaaagcagccagtgtaaaaccccaggccttcccataacccatgtgctacacagcaagagaaagaaggagagtttcaggcatgaaaataataagagaattctgcccttatctcagcagttctgtgagtcacttctcctcagggaagagcaattagaaggatagaaagaatggtagacatttacttcccagaatatattagcagagtttcctttttcttggtggaaactccaggaggaaagatgaagtttttctttttgggtaaaagatgaggtgaggggtagaggggaaagcacactagttttaggtgccatcaataatcctgtaggcattcatcctgcaatcatgtagtaaatcataacatttgtcatgcagggaggtaggtactggatgagcattgggaagaagacgtggtcccagctatggaactccaaattctgtgtctccaatgtgatatgggaagtaattataatatgtaagctatttgttatgtctacaaagcattgtaaaaatgtatattaaatttaaaaaaaaggcaagaaatctttttcctgttcagtagttccaaaaagactttaccaaataaatgaaattagtgcagaatttaggaagatgtatagattgtcattagtcaggctacaggaaggaaatcatttcaggcaaagacaagatcctgagtgaaggcccagatgcatgagagcagaaattgtcttccagaagctatgggtaaacctctatggttcaaatatggtgtctagagtgagacacattgctaaggcagaaaatcagcctgaaaggaagattgggtcaagttatcaagtttttttcacaccactcaatattatagttgaggcagaatactattttcctctctccttcctgatctttgccgttaaatctttcagtggaaattatacacagtatgatatatgcagtaagggaaatacttaacaggcctctgtcatgggcatttgtggatgagtacaaaagaaatagaagatacaaattcttcacacaataaatatatagtatgtgtcaaaattaaataagataataatataagacaatgaggcaatagtgccattgcttgtggcaatttttaaactccattttttgagccagtagtgccaaattttgtctatactcccaagtgtcagattcaatcattctgtcatcacatatttattatatgctgtgtgctggataaaaatcttcatcgttgagggaagatttgatttggggatccctcccaaagttatttgtatcaaagtcagctgaataaggtggctgatcatgataaggaatgccattatagactaagacccaactgcaaggaggaaatgagattttttttttgacctgtacactgtgaagcataaaataagaaccataaacttaaggccatttaaaaagagaattatagaaaagcattttaagcaaaggcagctcactttaaaaaaaaaaaagtgactaacttcccacaaagactcctttgaaggacacgcctcatttgggtgtatagatctccctacgtttgttgccatgagccttagtctatcatcatcatacctcaacttagcaagttctatagcatatggaggagacaaaattgcttcagccatttagacaagactgaaatcattgtgggcttccgtgattggaaaaggtctttaaaaagctttgaacccagcatggaccttcactgcaaatacagtcatgtgctgcataatgatgtttcataatgatggaccaataaatggtagtatcaaaatattataatgccatattactactgtactttttctatgtttagatatacacatagttactattttaccattgtgtcacatttgcctgcagtattcagtacagtaacatactgtacaggtttgcagcctagaagcaatgggctgtaccagatagcctaggtgagtagtaggctatcccatctaggtttgtgtaagtatgctctatgatggtcatacaatgacaacatcaactaacaacacatatctcagaacatatccccattgggaagtgacaaagtgactctactggaaaacaaaatatttcgtacaaagcctgggatgtgtgctctgtttattatcacctcaaagaagacttacaaattgggagaactaagatttgtaagagttctcaaacatagagagaatattatgtatcattattatatatcatgcatacattcgtgtatatttacttcttagaaacgtgtatcatgtatatgcatgttaaataggtatgtagtctttggcaacttctatgaagttttttttttttttttaatttttttttttttttattgatcattcttgggtgtttttcgcagagggggatttggcagggtcataggacaatagtggagggaaggtcggcagataaacaagtgaacaaaggtctctggttttcctaggcagagcaccctgcggccttccgcagtgtttgtgtccctgggtacttgagattagggagtggtgatgattcttaacgagcatgctgccttcaagcatctgtttaacaaagcacatcttgcaccgcccttaatccatttaaccctgagtggacacagcatatgtttcagagagcacagggttgggggtaaggtcaccaatcaacaggatcccaagacagaagaatttatcttagtacagaacaaaatgaaaagtctcccatgtctacttctttctacacagacacggcaaccatccgatttctcaatcttttccccacccttcccccctttccattccacaaaaccgccattgtcatcatggcctgttctcaatgacctgctgggcacacctcccagacggggggggcggccgggcagaggggctcctcacttcccagtaggggcagccgggcagaggcgcccctcacctcctggacggggcggctggccgggcggggggctgacacccccacctccctcccggacggggtggctgccgggcggagacgctcctcacttcccggacagggtggctgccgggcggaggggctcctcacttctcagacggggcagttgccgggcggagggtctcctcacttctcagacggggcggccgggcagagacgctcctcacctcccagacggggtcgcggccgggcagaggcgctcctcacatcccagacggggcggcggggcagaggtgctccccacatctcagacgatgggcggccgggaagagacgctcctcacttcccagatgggatggcggccgggcagagacgctcctcactttccagactgggcagccaggcagaggggctcctcacatcccagacgatgggcggccaggcagagacactcctcacctcccagacggggtggcggccgggcagaggctgcaatctcggcactttgggaggccaaggcaggcggctgggaggtggaagttgtagcgagccgagatcaggccactgcactccagcctgggcaccattgagcactgagtgaaccagactccgtctgcaatcctggcacctcgggaggccgaggctggcggatcactcgcggttacgagctggagaccagcccggccaacacagcgaaaccccgtctccaccaaaaaagtacgaaaaccagtcaggcgtggcggcgcgcacctgcaatcgcaggcactcggcaggctgaggcaggagaatcaggcagggaggttgcagtgagccgagatggcagcagtacagtccagcttccgctcggcatcagagggagactgtggaaaggggagagggagagggagggggagggggagagggagagggagagggagagggagagggagagctctatgaagttttatcaacctgcacttttaaggtaacgtgtaggttaattttcacttctcaaaaccctcacttcagatagaaaaaataacttcggaaacagcaataataatagtaataattataataaatagtctaaataattgaaatgaaacctaataaacagacaaaggaaatgatacaaatggaataataatgaacaagagaaaaatttacgattgtgaaaattagattgtaaaatggctttagaggaaaagtactgtaattcacattcctacagttatttgagagaaagggaccaaaccagtttaaaaatgtttttactgagaatttaaaaacaccctttagaaatagaaattcagtttctgactttatttagcaaaaattaaccagcaaaaaccttatgccccccaaaatgtgacctctttctctgtggatagtccagtgtttttcagcctagagcctaattctgctcttgggggacagggtccatgaagcgcaaccctgtgttttgtattcatagaaatgcagccagcaaacttgggtattggatgaactgggcattgtgggtcactctgcccgtggacctgctggtggcaccgcagggaaaaggttagaaactgcatgttctctgccaggcagaggctctactcatgttcttctagggagtcttgccttgtcatttctaccagtcatagactgggagatttgctgaccttagagatagtaatatatttcaaacctcaagaggcaagaatgatatgaaacaaaggatatccctggatttcctctggggctgcgaaagggagtctccacctggctctggaaggctatgtcttgtttccatccactccatttaactcccacttcttggcctgctttgagactgtcagctgggggccaattactgccatttagagaagtggatgctttaatgtgaatacttgtctgcaggaaccacacagagacagctgccttatctcacaagaaccctgtgttgtttatactcagtaatctgccacagagctctctccacaatggggaaacgaatccaatttattctccctattgcctgcacttaatttctttgactcgtttacatgtctgtctttttaagttgaagaaagaatacgaatgtaagttcctctgtggctaagagcatctttgactgtgttcttaacagtctaagacaatggagcaatagtactattgcctgaggcaacccttctgagtttttcaatttattaccaaatttttagatgaattatgatctagtctagttccagatggtgcatctagatctttataaataccagaagcacttacttgaaaagctgccagatctataaagggatctactactatgacttggagttttttcatacattattgtctgttttcataaattgataattaataggttctctaaaagccaagctgttcatggtttaaaaacagctgttagccatgaaaactgtggtgacatctacttaccaaggtatttccagagagacatgtagaatcacactggaaattctgtaccactccctggtgctcttctgggcagggagagtttactccacaatgccacaaaatcttatcagattactctccttttgaaaccttccaaagacttcacactccatctaagataaaactcagaggccctgagcatgaccttcaaggtgctcacccactctcttgcttcagtttttgtttttttgtttgtttgttttatttttagacagggtctcactttgtcacccagactggagtacagtggtgcgatctcggctcactgcaacctctgcctcccaggctcaagtgattctcctgcctcagcctcccgaatagctggggttataggcatgcaccatgacacctggctaatttttgtatttttagtagagatggcgtttcaccatgttggccaggctggtctcaaactcctgacctcaaatgatccacccagcttatcttcccacagtgctgggattacaggcatgagccacccagcccagccctgcttcagtttttaacctcaccacctcccacaccaagctatgtccacagttgcctttttctctgttcttagaaccctacattgatgagcatcagggcacttgtctcacctcataatccagttatcctctgaggcagaatagaaatccagacctggaatctcctcttgtttctgctttccaacagcttcctctcaatcaaaatgacaaatgattcaatatcatttttttttttttgagacggagcctgagttttgttgcccaggctagagtgcaatggtgtgatcttggctcactgcaacctccaccacccaggttcaagcgattctcctgcctcagccttctgagtagctgggattaccagcctggcctcgaactcctcacctcaggtcatctgccctcccaaagtgctgggattataggtgtgagccacaatgccaagcccagtatcattcttgattaattagttgcaacttaaaggagtgaattttctaaatataagattatatcatctaaaaacaaggataatttgatttctccccttccaatttggatgagctttatttctttatcttgtctgactgctctgactaggactttaagtaccatgttgaataaaagtggagaaagtgggcatccttgtcttgttccagatcttagaggaaaggcattcagtttttccctgctcagtatgacattacctatgggtttgtcagatacagcctttattgtgttgagctatgttcttttgtaccctattggttgagagttttttatcatgaaggaatgctgggttttatcaaatgctttttctagcctctattaaaatgatgatatggtttttgtccttcattctattgatgtgatgtatcacttttactgatttgcatttgttgagccatccttgcatccctgggatgaatccacttgatcgggatgactgatctttttaatgtgttgttgcatttgatttgctagtattttcttgagaatcaaatcaaaatggattgagggcttcaatgtaagacctgaaactatgaaactagtaaaagaaaacattgggggaaatgcttcaggacattggtctggacaaaggtttcttgagtaagaccttaaaagcacaagaaaccaaagcaaaaatggagaagtaggattacatcaagctaaaaatctccacacagcaagggagacaatcaacaaagtgaagtgacaacttacagaatgggagaaaatatttgcaaactattcagctgagaaggattagtaaccagaacatataaagaacacaactcaatagcaaaaagcaactaataattgtatttaaaagtagggaaaatagctgagtagacatttttcacatacatatgcccaacaggtatgtgaaaaaatgctcaacatcactaataatcagagcaagacaaataaaaaaccataataagtatcatctcacccaagttaaaatggcttttatcaaaaagataaaataataacagatggtagtgaggatgcagagaaaggggaacacttgcccactggtggtgggaatgtgaattagtatagtcattatggaaaacagcataaaggtttctcagaaaactaaaaatagagctattaatactatatgatccagtaatcccactgctgaatatatataaaaaagaatgaaaatcagtatttcaaaaaggtatctgcactcccaggtttattgcagcactatttgcagtagccaagatgtggaagcagccttagtgtctacctacatatgaatggataaagaaaatgtggtacatatacaaaatggaatattattcaaccataaaaagaatgaaattctgtcatttacaacaatatggttggaactggaggtcattatattaagtgaaataagccaggcaccaaaaggcaaatattgcatattctcactcatgagtgggagctaaaacaattgatctcatggaggtagagagtagaatgatggttaccagactttaggaagggtagtggggaaggaggaataaagaggtgatggttaatgagtacaaaactacagttaggtagaaggaatgagatgtagtgtttggtagcacaatagggtgactatagttaacaataatttattgtatatttcaaaataacttgaagagtgggattgaaatgttcctaacacaaattatatatggctgggcattgtggctcaagcctgtaatcctagcactttgggaggctcaggtgggagaatcgcttgaacccaggagtttgagaccatagtgggcaccataatgagacccctatctctacaaaagaataaaaagttttaaaaaattagcttggcatgagggtgtatgcctgtggtcccagctacttgagaggctgagctgggaggatcacctgaacccaggagattgaggcttcagtgagccatggttacttcactgtactcgagcctggatgacagagcaggtccttgactcaaaaaaaaaaaaaaaaaaaaaaacgaaaacaaaaaaaagaagaggaggaaatgatatatgtttaagaacatggagatccccattaacctgatttttatcattacaccttgcatgctgtatcaaaatattgcatgtgtcccatatatatgttcaaatattatgtacccatagaaattaaaaataaaaaaaattaaagctaaattttaagttttcactgtgttctcagagcacgtagtcattctatccatctatccacccatccatcaatcgagtgcctagtacgtaaccttaaagtgattatatttcttagtaagcacctgctgtatactaaaggtaaaagttattggtctctgtgcatatgtggttgagtttagcagataaggcagaccaacaaacaaatcactatatgatgggggaatagatcaggttttctagaaacatgagtgagagcttctaatatgccctagttggtgatgtgagcgtcaggacagtttttctaagagttgttttgagttaagcattaaatcatgaataaaagatagtttgggttgccagatatttatcaggctttcattgatgcccccttaacatttgccagtcatatgggaagtactcaaaaaatgtttgagattcattctttagtgatatgttcactttcttttttaaaaaaaaaaaataaaaagtagtttgagacttctgtgattctctgtaaataaattttgacttgacatgtctgggaccttggcactgactctcctgggatacctcaattcccctcctttcccctttcctctctctatatatactatatatatgaagtcccattgtcctggcctctccatatggcctctttctgtaggatactggatgatattctgtacctctttgcaatttgttagctgagagccaggaaagtgaaagcaggaactgctgggacccataacatcgaggcccggaaagggcagcgtcacttctatagcattataatgatcaaagaaagtcacaggccagccaagattctggggaggagaaatcaattccatctctcatgtatgtagtggaaaagggattgctggtggctatctttggcaactatctactgcattccctcctcctcaaattaccttattctttctatcctcccaaagactaccatatgtatatttgcactcattctctagatttgacataaattggttgacactaatgacacttccctgtgtctaacccttgtccccatcatccaattctttctgcccttacctggcatctgtaattaatttctttgcctccaatgttacttctctgtttggtagtgcaattgaagaccacataaaaatgctgctagaatgcatctcctttgttagcagatttagtattctaatgtgaaattccttctcatcctttaaaacccagttaaatctgacttctataaagtccttattgactatcccaaagaagaggggatttctctttctaaaatttgtagtaatgtgtttctggaatgtattctagttttgactatggttaggaatacacatgctttacctttctaataattttgaaaactcaaaggcaggcagtaggatatactcattttttaaattttctaaagcaccaagatgagcccattacatagaataagttgagtttttgttgagttgtcagggatctgggaagaatggtttggcttttaggagaggttctcagccaaccaggaaggaaaaaaaaaatgattcagtgattagtgacaacagctttacttctagaatcctcccacctactactggcagcacgagcaggcagcttgccttcctgggacgaacctagatgaggtacaatgtggctggaaagctctctaatactgatctgacatggcatatttcagattaatctgttttctctccttgtttccagtttcagcacatactaatgccatcttgaatcttacttttcctccctggccctcagcttccccatctgtaaataacaaaggctactatttactaagaacctgcatcagtgccagacacagtgctgggcactagtgctaatcctcacaataatagtgaaaggtgcattttttttatttcctccttttaaatgaatatcagatatggaaaggaaaacaacttgcccaagccctctcagcacaactggattgaaactcatcccccatgagtagcatcagggtcaggccagataagctgtaaattcccttagcctttactatgcatctccaccaggatgtaaaatacaatctgctgtttgtcttccaccttctcctagaccagcttttctgcgtcattatttttcttttttgtcttcagctgcagtttctcttatcagttattggctccacaactagcaagtttattttttgctccatattgtattctggtgtgttatgctacaatttgtatagggaatgagacacaatatggtttgctaatgagaaaatctacactgcagagacagaacctatttgttctcagttacttgaaacgtatgttagaatgtagaatctcttcttcattcccgtgtgaggtgctgaggaaggctggaggggttctgattcagtcacatttgattttggagtcaaggtcttggcttcaactcatattgagttttactggaaactgccagctttgttttgggtagacatttgtaaatgtgacagaacagatgactcatctcaagccagctctatgcttttattcaatgtgtgcttaaaaagagtaaacgtggatgttggaaagtattttcttgtaagtactttgtatggcagatgccaagtactgctaaacctaattatttaattcttcttcttaaatagatattatttagttttaatttttaaaaaccttcaactatataattgatatatatcatatatatagatatagatatatatcaataatataattttactttttagcacaccagaagcatattattttggaagatcataggactcagagctctggataggcaaagtagacttggatttacattctctgtgatcttaagaaatctactttctcccttattttcacttttctgtactaaaaaaaacagctgtactaacatgaataatatgtacctcacagggttcatgttgaggacaaaattattaatagataatatgtcaaagagcttgccatataatcagtaggttctttcctgccatggaaaaatttttttagtcagaataggtctcagccaacctctttcatgttccagaatttaatgcatacttgctgattcaatacaggtagaaagtttaatattaatttttattttgttggctttctaaaaaagcagtcttttcacattagaataagtgaatgaaagagatcactaaaatcaaaagttgttacaaatgttattttgattgctatgatttcaaatgcagttttatcttcttataaagttaaaatacccaatttcgtttttaatttatttggaaacaacaacacgactggttgaatactctgtctaaagtaatctctaacaaagaatgactgaagttctactctaccaatgaaaagcaagaaccggggttcctcctttctctttctgtggtatgggagctacatgaaggcagaataaaagagtcagactaggctgggaatcctgttcaagagaggcactcagttacagtgtacatgtcagaattgattgataaagttactaggaagtaggcatgtaaccttagttagtcttgttctccagttttcaataaaatgtggactatacctttgggggttgtgttcatttgtttgtttttaagacagagtcttgctctgtcacccaggctggagtgaagtggcacaatctcagctcactgcaacctccacctcctgggttcaagcaattctcctgcctcagcctcccaagtagctgggactataggcacgtgcaaccacgctcagctgattttttgtatttttagtggagacgcagagtttcaccaagttgcccaggctggtctcgaactcctgagctcaggcaatccacccatctaggcctcacaaagtgctaggattacaggcatgagccaccatgcccagcctactacagtatttttaaagaagagcagtttcacagtgtcaccaaatcatggctttcagatccagagttacaaattgcctcccaactcagcagttcttgaaaatataatattaccgatgtttggctcatgaagactccctagaagcccagtgtcccctagggaggaagtgccaaattgaaaatttttaaataatcgttactgtattttatagcaaataagtatatgattatcaaatatgcttaaaccctttgggaaagaggagcttgaaaacactgtatccatcctttgacagatccatttagcctaattattcaatgatccccatacattttactcgcattcttgacccaaataattcagattatatttgtatgctttttgatatccttaatgtaaaaaaaattcttgattctttttctcattcattcaacaaatacttgttgagtgaagaccatattctccatgagcaaataagtagaagaatctccatgtgggtcctgcattctaatggggaaagagaggctgataaatactaaacgcaagaacattaagtaggtactatgtcagtaaacaaagtatagagtagattagaaggaaaaaaatcaaataatagcaatgttaggggcgaaggagcctggagttgtgaggatggcttataattttaaatagagttgtgggaattggcctcaggaaggaggtgacatttatgagagagttggaagaggtgcagggattcaccatgtgactatgtgggggaagaacattcagatagggagagcggccagtccagaggctcaaggcaagtctgtgtctgagatgttccaggaagaggaaggaggccggtgttcaggagtaaactttgtaacttagtctttcttttctcacattagactttttcgttgttgatgttttactttaaggaaatttatttttgcaaaaatatgtactatttggtttgttaaaataacatctaactcttgaaagatcatttaccttgatagaggcattcatctattctgttaggaagaagcacaggtcagccggagatgtttacagtacagagttcttatataagtaggaaaaaaaaaactgtaataatttaaaaagtaaaaaaaaaaaaagtcaatacaggacctgccccttcctagacaatcacaacgtgtccactcattctactttcagctgccccctccccaccctatccgttcaatatcctgccactctggcaccatcccagccacaaggcctcaggtcctctctctgctctcgctggttttcagagaggcgctcctcagagagagtttctagcactaaaggataagtgattgttatgacaatatacttctttttaaaaaatgcttgtttcatcggagaattttggctggctatgggtaatggaagagatttcacataaaagttgagtccccttctcacaaagcaaatgagcacatgatggatcaaggtgctctgctggtgtagactaacatatattaataatacacacatacctattaagagatctgtgtcaaggaatatacatgtagtatatattaaagacatcagaatataagacaataaattaaattaccttatagtcacctggcttctatggagcaaggagaatttaattaaaccacagaatctgagagaacatttgatccttggttgatgctaaaaaattgtttcactatttgaaaatagtttcaaatcatttcactatttgaaaaaaaaaaaaagcaagttcagatgggagatggactcatagcttatactatgtcgaaatgcattaggaaagattagtttaagatttcatgccaataaaataactttaccaaaaactacctttatggagtactagtctcaccaggggaagttcaaaacatcacattttttaccaggaagttgatgcattcccttggcaagtcaatgggatggtttatgcctagaatctcagagaagaagaaagcctttttagatgaaaaagatagtcatatgtctccaaaccctcatgtgtatttatgtagtggagaggaaactaattgaagcagaaggtagctagatttttaaatgtaatcattaatagtctcacagttgtgttgatagcatccaacagggttaccttctgggcagaaacacagatcactcctactgttcttggagaaagaaaaaggaggaaatgaacacatgctcactgaacctcctagcaaaaaaagtctctctagaaatatatggtccactcccaagctcaccctttaattctccaatgttacttctgtaaaatagcagtcctgtgatattactcactgaacagatgaaattaaaatatttatattctgcacatgcacgcacggaggaaaatctcacttcaattatagcagttaagaagtctgaagtaattttcccagctagcatttggccattccattgagattgaaggaatctggtatgatgatggttcttattaattcaccctctcttcgttttaaaagaatattatagttcctttgtgatgtaaattgtttgggcaatatgatggtgcactgccttgtgactaaaaagtcgacaagctcaaaggacaaagtattcaggaacaatagctaacatttactgttcggcactttttaaatgttctcggtaagataatttttatttctgattcacttttctttttgcctttccaaaagggatttaagttaattactttttctaatgtgactttgatatttcagtcccctcagatcttccaaggaatttacaggtgaaataccattctagttcttttattttcctagaaactctgatattaaatatgggtgtcacactggaaaattccaccagaataaaaagctaaacaaggcataaaatttacattagtaacatcccattaaaccatcatctagaaagcttttgttacatgattttcatcatttattaaattattttggtgtcttttctggtcttttttgcctgtaggactgaaccttgttatgcatttgtctccatcaaaatggtgtagctgcatttggcattattccttcaacattcttctttattttttccacagaagatgaaattagcttggtttaataatagtcattcctgattactctctctgtggaaaacagcttaagaggcacattattcaattaaagaaagtatttgcctcgccctttaaaaccttcattttatataacctattgattgtgaatccaattagtcttacatattaaacttttattacttttagtatagcacttttacatgccatcgggaaactcatcaccatgtaaaatgcatgtagttcctgactttcaaacaagaggtatttcagaagatcactgctaagtcagtgtttcaaatttgaatatacatgttcatcctataaatgatctatattcagcctataaatgatgacatgattatatatatagtcgtcctacaaataatcatcctataaacaattattgggttcctggggtaacagcaaagcaaaataattagaacatttttgttaataatatacctagtaataataatgtagctgggaaaataatgaacaaaataatatagctgaaatagtagtcctacgttttagggacaaggttagaaagaagagagcaccaggggttggagggagagagtggttcctcatatacactgtgataactcagatagtctgcagtcaggaaacaattggtaatccattaattagagagtatgatgcccttttatgaagtgatagtgtagacacaatagcaatattaattagctttcctattgcttccataataaattagcacaagcttagtgacttaacccaaacttattatctcacacaattctataggtcataagtctgagttgattctgctggtttctctgttctgggtgttaggaagatgatgtcaagatgattaacagctgggctgtggaaagaatctgcttccagtctcattcagtttgttggcagaatccagttccatgtgaccataggactgaaattcctatttccttgctggctgtcaacagggaaccagcctctagttcttgcatgtgggccccgacatctcagagccagcaaacatggaatccttctcaagcttggaatctctttgactttctcttcttccacatccttcttctgcttcaagccagagaacactctctacttttaagggttcatatgattcaatatgtcccacccagacaatcatctctctattttaaggtctgtaaccacaatttcgtgtgcaatgtccattttgccaccatggaatacaacatattcacatattccagggatccaggtgtggacatttttaaagggccattatgctgcttatcacaaatgtaacatgttttgagttgttcttcaagggttcaatccacgaatagcttgtatgcacaaaagcacttgtacaaaagatgaccaccagggctccgcgggctgcctgtgtcacagaatcgagtgatgtccactggcctcacagttcagagctcaccagtactctctttcagcagttcttaatcttatttccaaagatacaccccagatatcctttccttgtgtttacatattctcagactctggctgctgtgttaataagtggtgttgagactattgcttaatgtacagtgaaagagttaaagtgattttgtataaaaatgcaacgatctgtttcactaacattgtcccaagcaacagcatgagcagtcgttttttatattactttaacagaatttcccatccacacaggagaagttcatcctctccattttcttaagagtagagagtgtctttagcatctcaaggtttctgtggatcaccaggagccctgccttggagaggctccagtacacaggtgttactgagctggagggcttgagagaggggaccattctgaggatgggggatggagaaagaatgttaccaaggtgaacggaaaggtagcaaagacgggtatgtacgggaaggtctgagattgctgtttggaattgatttttcaattattaattttttcatgtattctgatatgatgaaaaaaatgacagaacacattaatcttatggaaatgtagggtaaaaaagaggatttgagattggaattattctggaaacctggatcttgagctagaattttaaaaataatggagatggttagcctacagttcggtttctgcttgggaactctttttcaaaaattctctggaaattattaaggcaccaactacttgctctgaaaattgataattaaaggggaaaaaactaaatatttattctgactttaaagggagttatatttttcagtaatcaaaataatcacttgatgatgaatagccttttttatggaaatattgcagttcattaatgtgtaagaataaaactcaccattttgcaatgttaataaaataactgatcaaagcaacgttcatcagtgattaaatcctttggataaaatattaaaaagaactagacaatagagggactaggttttcattataactagaatttggaaccctagaacttattttttctcttaagataatgtaacataaagcagactgcaccatctatgaagcatttctgtcaaaagttgaacctaaatctaattgagcctttatcacttacttccagccaccaggaaatagagagggaaggaagcagttaaatgacaccacaatgaaacaaacagagaaatccagaatgaaggacattttataggactactgacacagtttctgccaaaagttaatgacatgggaaaaaaggagaggggaagaaggaggagcacagctgtaaatttaaaaaagaaagaaagaaaaatgacttgggagatttaccaaatacagtatttgaatcttaattcgagcatatcaactaagaaaaagacatttttgaaaccgttagaaaaattttagtatgcactagacatgattccaagacattattgttaatatgtaggtgagataatatcactgttatcttgtgagacaatgtttgtgcttttagagatggatactgaagtattttaggtatgatgttacatgttgctgggatttgttttaaaaatttttagcaaagacaacatatatggcgcagtgtatattgctcagttgatgggtgcaccaggatctcacaaatcaccgctgaagaacttattcacgtaattaaatgccacctgtactccaataacttatgggaaaaaatttaaaaaatagcaaagaaggccgggcgtggtggctcatgcctgtaacccagcactttgggaggccgaggtgggcggatcacaaggtcaggagatcgagaccatcctggctaacatggtgaaaccctgtctccactaaaaatacaaaaaaaattagccgggcatgatggtgggcgcctgtagtcccagctacctgagaggttgaggcaggagaatggcgtgaacccaggaggtggatcttgcagtgagctgagatggtgccactgcactccagcctgggcaacagagcgagactctgtctcaaaaaaaaaaaaaaaaaatagcaaagaaaaaaattaagcagatgtggcttatttttgctggaaaattaatgaatctaaatgatgagtttatggggattcattatatcatcttttctgtatacaattggtagttacagaatttttcattaatttttttttaaaaaaatcagttattcccacataactgtatatcttaaaaccattgttttctacaaagaggtataatattattgtgtggttgctctgtgatggtacgagtaggcatccttattttatcaagtattgtcctcttaaattgcttggtttcttatcatggtggtctaatttctttgaggctctgtatctcaggcctatgttcattgataaagttcctttctctttgaaattcctattaatagacagtcttcaatcaagaacatattagttctgctaatacaatttatatgaaattttaccctactccataatttgcagaagctaatagtgtactaacaagggagcaggagcaataattgatcatatttgctttcccttagagagaagtgcagccatcagtcttagaagactgatgtaatgagtgccaagtgatggatgccccgtgcactcacgattgctagatctcccatgggtgtcctaaaaggaagcacgtggtctgttgggagatgcagacagcagaattatttggaaataggtggagccactgtcaatgagagacgtttcccctatctctattttaaaaaatgcaattctatcttaatcccttccttttttcctcaaaaatttaacaatgctaattctaagcttgtgtgcacttttcccagtggttaattataatccttttctttattaggttttattttgcagccttaaaaaataaaaagaaattaacaaaatggcttaaaggcaaaattagagcaaatctcattttcttaggagactctgcatttcatttattgttatagttcttacttcagagacagggaaggaagagaaggtagcttgatagtaaaataatatccttcaaggtaaattccatgaatgttaagtcaagcagaacttctatttttgtagcattctagagacattgaatccagtttcttgatgtttcttgccgcatttctcactctgttctacagagcaatttggtttacaggtaatttaagcttgggataaagctctggttaattcagtttctggataaaagaaagagtaattcaacttaaagatcaccatagaattttaatcatagagatgagaaagcaaggaaaggcataaacctcgttagtggtataatgggaaaagaattgtctcagatagatggttctagctcttgaagttttgctgtaagctgtaccagcactagaaaaaaggtacaatgggaaatgcagacctttagttttgtccaccttcctgatgttgcctttttcacttcagcttttcaacaacgttgctgaaaaggtctaccagtcagtgcccattatatatacgtttctcttcctttctccaatcccatctaaataatgaattctgtattccagatcttgatcctcattttaaacattcatttcctttatttaaattttacttatattgttattactttataccttaagatattatattttaattatagtgtttttattgaaatgtaatttttacatcatgaaatgcagactctaagcacacagtttggtaaattttgacaaatgtatacacctgtgtatcccacacccatcaagataatagaacattttcatcaacctagaaaattctgtcatgccaattcctaggtcatcagtgcctttcagttcaaaggagaatgtagatctgatttccatcaacagattcatttcacctgttgtggaattttatagaaatagagtaatacagaatatactcttcgaggtctgactttctgcatcagaaaaatattttagagtttactccatgttgttaaatggtatttcattaaataacacacctcagtttattcacctgtttttcagtttgtggccatttgggatgtttctagctttgaaatattgtgaataaagctgctataacatttttgtataaatctttttatagatctatttttttaaaattctacctaggagtggaattgctaggtcataaggtagatatatgtttaaatttataagaatctgataattttccaaaggagttatacctatttacatatccaccagcaaaataatatagttctagttgcttttcccttaccaacatttggtgcagccgtcagagttttaattttaatttggtccattccagtgggtgtacagtgatctgtcattatggttttaatttgtatttccctgatgattaatgattctgggcactgttttatttgcttattggttattgcatgtcttttgttgtttaatgtctgttcaatttgttgtttaatgtctgtttaatgtgtctattttttcgttgctgctttattgagttatataaatactttattctgaatctaagtcctttgagatatatatttgaatgatacatttcctgccggtctatgattttatgatctgcctatttattttcttagtggtaatatgtcaaagaggagaagtctttaattttgattaagttcaatttaaatatttttctttgtggctagcactttctctgtgttatctaaaaaagctttgcctccccaagttcataaaaaatattctcctatgttttcttccaaaagtttcataattttagcttttagatttgttactgatcaatttcaaattaatttgtgtatctggtgtgaggcaaggatcaatttattcatattagattattcagtcatttcagaaacatttgtgaaaaaaacttaaaatgactttccttaatgaattccctaggaacctttgttaaagatgaattgaccatatagctgtgggttatttctagattatcttttctgtcccattgatttatttgcctatgtttatggcagtgttacagtaccttcatttctgagttttatggtaagctctttaggtactaatgtggaagtatctttaaaacagagtgctgaatggaaaaaatgtacagattaatatgtctagcttttgtctaaaaaaagagaaaataacatatgttcatgtatgcttgactttgcattaaaaaccttggaagaacacaaatgatactaaagacatagttacctgtggcaggtagcagtatatagttactagacatatttgtgacaggaatataaagaggaataggaatttttattatatttttaaacaacatgactatattaattatgaaaagattaatttttaaaaagagtaagtgatataggaaatgtattctttctcagagtagataaaacattgagtgggcaattcattgaaataatgttttctaggtcccattagatattttttgggccttgaaatttttaatatctgttttacttgacaaatatttattaagtgccttttatgtatcaagcaatggtaatacagaaggcaacaagactgacatgttcctcatccccatggtatgtatattccagtggagggaaaacacaataaatcataaacaaataaaaaagatattttcagaatgtgataagtgctataaataacataaacatgacagaaagaggcaagatgaatgtgaaatggaagtcctggagaaggtcttccagtgtggtaacttaggaactgagattggaatgccaggaaggattcagagatgtgaagaatttgggtgttggggaggaacctgcaaaggaaaaggccctgaaaagggaaatggctgaagagaaacaggaaagaaggcaaggtggaagagcacggtgaatgtggtgcagaataaaattgcggcgacaggtagggactaaatcaagctgaactttagggaaatgatgaggaatttgggttttattttacatgaaatgaaaaactactaaaagttattggaagttactgaaagagtataatgatctgatcaagattaaaaaacaaaaagcattcattttattgggggaaaaataacagattaagaaggggttggcagtgagaaaggaagaaaatcagaagttacatcacataagccaagaaacaatagtgtttaaaaaagaagaaatgtcccccaaatgttccaactgaggacagagaaactgtccgctagatttagtctcatggaagtcttctatggtctgacaagagcaatttctatggagtcgtgggtagagaagatggactagaatatgatggaaagtggatggactctctattttatactcacctccccacctcactcccaacacatgaaagtgaatgagaaataaagaagtgaagaaagaagatttagatgactctttcaagtgctctatgtaaccgtagatacatggagatgttgtgtatatccaggctggcatatctgtgtgttggtttagcaaatacatatcaaaaattcttacatgaaaagctcctttataacaagatgttctcacttttttagtgacaaaatcccatgaataaatccaaaaagagtctattttatataaaatcccaccctgttggaagtattgcaagtttccactgaaatttttaatctgacttctagatatatttttggagtgttgtctattttgtcagcctgccagattatgtcaaaatgttgatatgtaataacagtttatctcgtgttcctttatccaccctatttacccacctcagctgtgttaactgtccttgactgattccactgcatcattaatactgccatagggaaccgtgccctgatcattcatactgccactaataggatgccaagtggatgtttcaaagttggatgctgatgattatcattgcgatgtatatgacatcgctaagacagcattttcagtcaaaaatatggctgccgtttaaggtgtgagctttttgcctttttacctagaaaaacaatgatatgtaaatttcttattataatttgtattactctactcttatttgctatttgtcaactctgcaagagacaagggttggtacagaaaatatcattttatcagaaggaaaccttgtcttctacagtaggtactaccttcttgagctgattctggataataaagcttgcttcgcaataatccagagttttccaaaccatatatttgactccctttactgactgatatgcaaagttgtgtttaactatatggaaaattgtgaatccttttcatccaagtctacacactccacttgcttttcccttctaccttgaattcatgtgcattcccccagttttctgcctttgtaatggaggcttcagttcttctgcagccacagttgcaggaaacccaattgtaatcagcagctgccctgctgctaaaagctattagtgccaatgttgttaatgaccgacccagttgaatgtgctgatttaaggggtagacttatttcttgtcactccctagggccttgttcttaaatgagatttctacgttgtttagttgtttactcctctagcataaggagtattaaccactaacaaccacacttcgtatatcagcacgttgaattgaaataatggggaggttaagacatatcactacctttgaggtatgaagacacgcgccctgaaaaaacttggctcctacccctaatttttgcctaaagaagttggataccactgcaatttgctctgaagttatacatgttattgtcttcaagggactataggatgagaagggtacagttaggtttcttttcagaactaaacacattagcagtaacctgcaaaaatcaataccaattacttgcaagcaagggcttaaaaaaaaaaaaaattactgaagctacagaatatgcccataggtgaatggcttaaaacaaagaaaatactggcatagctggtactctcacaaaatagaagcaaaagtagtaaagttctcttttatttattttggcattttggtattaatttgtaaaagccaacaactgttatatttaaaaagaaaaataaataaagcagcaaataactcaatataagaaggctattttactgtctccctggcatgactaaggtttgtgttgtctttctagcagacatcaaggcattcagaaggtgtatggggatggcttatctatataaaccagtaaaccttttattcaatacccagacattctgcatgccaatattatgtgtttagtgtctcgagattctatttagcagaaattcactttgaggggcttggtgaagccttcagaggtttaactgtgtagtctctcctttattcaaaaggctgaaataatatttttccggtttctggaattcttaagcttgcatttcagattaaactatcgcagagagtagaatttcttccttccttgtcttctagtagtaaagatggggcacatatctgtaagatgtggacccagaaactctactctcaagtctggctatgatgacgaagtcttgagaagctagtaagccttgctacctcattcaagtccacggtagagttgtgtatgaatgtatggagaggtgggggaagttccaaatactacagaatttccccatagttaacagccctgcttaccaaacaattgaggccatgtggaaatggtacctatcattaaatctcacatcagaaggaacgagttttggcatgtctgtatcgccaatatgagtatcaaaaaaggtaactgtggatcttcttggacagtcattttcctggacttcagtttggtcctccctggtcataaaatgatatgattcttaatacttgaaaaaattgtcccaaaacacaatatcacccaaaaaaaccctcttttaccagcttcctttttttttctttaattgcagagcctcaaatcgatatttaagaagtaagagaagtgaatggtggtcacacaatgcctgaaaaagaaagctctgagtagttgtctgggggacactagaaacaaaagaagtgtgtcacgtgataccataatggcatccagcactttccatatagggaaggcagacagggaaaagaaaattttgcttaacgtggattgaggaagtagtggactcaagtaatggaaaggaaatgaattttacagtattctgaggtactggtaaatttacttgctacggattatactgaaggtaaaatgctgcttaaatagagtctaagattttatgtatcaaatatttacctaatttttaaagcattaaaaatgttaggattcaatagttatagttactttcatcctttgaaacaaaaataattcttgtttcaattttatatgttgagctgttaaaagaaaattgaaagaggcaaacaatatatacttatttgtctctatgggtttgtgcagtttatagatatcctgagcagtgcttctagtgagcgttcttagtagcaccaggttggttgttaatggagtattgacccagcaatttactggggcaagcccttctgctctactcagagttgatgtgttttatattacaattgcatctaataccttattttacaacttcaattaatatagttgggtagaactcgaagaaagtttataacaaagctatgaatagagtaattcattattataaaagtgtactttgagaggagaaactaggattgtttttcctcagaaagaaaacactgatgtatgataatagtattctccaataaaattaaaaataaacatctaaagagacataacatttctgttgagaatagaaaacctgcactcgctgtctgcaaacactgggataatatctttcacaaaatgtttataatccagataaaaagagaagatatatatgtgcaaatcaagagaagaaatgaaatagagaagaaatgagagaagagatgacaaccactaaacaaagagtggagagagagaagtgctctgacagttggagggcaacagagatctctctgcactgaggaggccaaggaaggctttttaaaaagatgatatggggtgtgggtgttgaagatagaaggtgggatgtaaaatataagaaaaagggcaaagtttttgcacgaaaccttaaggtgaccattctcacttcggttccttggtttttgtggagggatagtaggtagtaaaattagggtgagaactttgaggatagattgagggtagtaatttacatcaggctaaggagttgtaggcattctcctataagccaggcaatagaaggccatcagaagtttacaagctgggatataatatgacttttataaacagcaatatgccagttgtgtgaaggatgagtttagagaaagactgaagctgagaacactaagaaaatgttttaacagtgatagggaaaaagtaattggatattttggctgaactccttaatagaaataatgaaaggaacacaaaaggaaaacacaaaatctagttcaatgaatacttaaaatttataagtgatagtataatcctataatttattctgaattaagaatccataattctgattctataattggaactatcccagaattctatgtcctatttgacattagtttgacttaaagattggcttatgtctcaatcaatcaatttgatggtgaccaagaatttcctttcaatttacagtttaatactggccagagaatggaaagtaaaaagccatagcacatgctatatatatgatccatagacttatcaaattcaaatttaatggggagtctaaaacagctatttggcatttataccccaggttttttctaatattttatcagagatatcaaagagacttcaaactcaattcactgactgatataaacagcaagctatttcaacagatagagaacgctgggataaagaaaaagggcttggaatttttttgaagtgaaaaaatatgtgtaaaaaatgcatttctaatagtcacaggacaaaagtggacagaatttcccattacagtaaaatttaatgaattcagttggttcttttaaccatcatatggtctcatcaagaaataagaaagaatatcattaagtggatatccccctttacataaaagctgaatacattttttttttttttttttttgagacggagtcttgctctgtcacccaggctggagtgcagtggtgcaatctcggctcactgcaagctccacctcctgggttcacaccattctccaacctcagcctcctgagtagcgggactacaggcacccactaccaagctcagctaatttttttctattttcattagagatggggtttcgccattcacaggataaaatctgaatacataatacattttaaggactgaaatcccttctataataactttagtaattactcactgttgatgaaaaatatcctaggccaaaagttttctctgtttgccccaagcagatggagtaagggctctgagtcaacctgacttccctctgcatggtgtcaagcactctgtggcttcatggccttgcaatccagttaatccctaggaaccaaacttacccaagtggttgtgtaagttgtacataataaatgtaaagtgcttagcatagcacataaaatgtaaagtgcttaacatagcacataacaaaaaaaattgttgagtaaacgaatattttgctctaaatagtgtgggccacaagatctactaaacaaattagattgtaaaacttctcaagggatatcctcggtgtatttggtagaggaaagaggaaagagatttgtaaaatgattgaaatatgttacttacctttaggattttttttcttgccaagctttgggttttgaacttgcggaatcttagagtcacaggaagaagaaatagatagctcctgtagtgctggctatagtctcatagagcccaaaaaggtaggaaggagatgatttagaaagtatgagagggtagaatgccagggaggtttctgaccagttgttttccaggccaaagcaagtaatgcaatgacttcttgtattaaacccatcatttatttaatcaaagataaagcatatttctattatttctataataatagaaattctacaagaaaggagagaaacctttaagttttccctaaagaaagccattcttcctattcttatgatttctgatgctagctacactgctttcaaaacacacgatcctttagggtacagaggagagaaaaggaattcgtttaaaacatgattttctatgtagatcatcaacgaatgaagaaagaaactagaaaaaagggggaagaaatgggtgaatgtagtatacttatttcagatatgaagatgtgcttccaggtacagcactagaggtacaaattcattctagagctttgttcactgctacttactatctctggaactacagtcactgcagaaccagggcattgaagcccaaggttaatacagattgtagggagcagacaaaattggatcgaagtccagatttccttgttttctaactggaaggggcttgggcatttcatttaataccactaagtttcaatttatccatatgtaaaatgagcctcatagaggtgttataaggaatcatagattactgcattcttccattctatgacataggcacatttcacattttaattgggatgattcttaaaatcaatggcacatcttttttggaagtgccacataaagtcatgaggcatcaaacaataaattctatcttaatttgataaaatacatgaaggtaataaaggcaaagtgcctctgacaacatctggcatctaataagcaccagcaaattgttttggggtgatgctcagtgctgttgctattaccccatgctacaccactcagggaagcatctctttcttcataaatgttcactgatactccagctcaagtgaatgcagtctagtgcgtattttgtgaaagagtaattaaagtcttaaatgtcctagtttctctaatcatctaaaatatcatacttttaatataaaaataataataccttaaaaatgaaatgatacatctttggaacatttatcaccttcaaaggacttgcaatcctcctacataataatggtactatattacttagttcttgggtatgaagagtctgtactgcacatagcactctgctaggcacgagttttccttgttttttctaatacaactttgatatgacctaatttcaccaccaaaaaaaccagcaccatatggcaagttccccatttcccctaaaataatttattgagcctttagtgtgtcccagtgactgaactctttatgctgaatttttctcaagatttcttcaggacatcagaacataatgcagattttttttcaggtggccctctaccaactggatatgaaattggatcagctggaggcaagaacagatggggttgagcagcagatggaaagatcctgtttaggatatgcagaatcactctggcaaaatcaatcatgccacaggagttagtttcagtttggtgaaagaaaatgaactcaagtagacaactgagttaccgggaaattaatacgagctcacactttagaaagtcttgattaagtgtcaataagacagatgagctaatgatgttgaattaaaagtcttaaatgtcacgtttgtcagtgatcataatagctctccatatttagtgcttaccctttaccaggcatttcaggtacagatctcattcaatccttacaaaaaccctgtgagacaggcatttttccgatatcacaaatgcttaaatggaagttctaagtaaattgatcaaggtcataggactctaggtaacagaaacaggattggaacttgtctggctagctggaaagcccacacaaatcatgaacactctactactttccagtgttaaatgatgtgtatacaagaacaattggaggagcatacggtcaactttcagatatcctaaggtcctttccacagtaacaattggaacaggcctgtgatggtcagagtgaccaccgggcatctgcttgaatctttgtggggaatacagagcagcgaggggggccacatggtccccagtaaagcagaggtcacaggtgtcacatacaggctctggtgaatcccacggagtccctgtagaaatctcacatctgcttaccccgagaaggtctcccagaatcctggagctgccttgctccagaagtggatctccatagcaaccttaggccaaaagagtctcatgcacccgttctagtccaaacatgctatgatggactttgtttccatggggcattcaatacatatgtgaatctgagattgtgagtggcttggagtacgtactgtctcagtccattcgggttgctattaaaaaaaaaaaaaaaacataaactaggtggcttataaacaacaggaattcatttctcacggctctggaggctgggaagtccaagacctgccaaggtattggtggatctggtgtctggtgagggggagttttctgttcatagatggctctttctagctgtgacttttcatggcagaggggaaaatgcactctctggggcctcttgtataaggtcactaataccatatgtaaaggctctgcatctcatgacctacttcccccccaaaaggccccacttcctaacatcactttgggtgttaagatttcagcatattaatttggtgggggtcacataaacatccaatccactacatctactttcttcaaaactgtaggcaagctgtaaagaagggaaaatcatttcagcccaagtattcgccctgctttaactttggagcaaaagcaggaaatagaaggaacttatcattcattgactgcctactatttgccaagcatggaaagaccatataatgggttggagggaaaataagataaaagtctgagcaacagatggaaacacatctgccaggtgccatgctctgtacgcattacttcattccatacagcattctcttgtattagtgagttcctgctgactgctacgttactttttcttctcagccaaatgttcaagaagcaggtactggttatgagtaagcatggtgaaaacccattttctaagaaacagaagagatggcaagtgtatcctctcaaagaattaaattttgttttctgccttatttttctcaaacaaaacaagcttttaccaattgcattaccatagccttgctatctatacataggtatcacagaaatcttaatctttgagttttcaagttagaggaattcttattaagcatgagagttaataatctcctgagacacaaatatgcctggtaatatgagaacaataaatgtttgttgggtccaaacatgaattaaagctgtatatgttatgccttaaagacattaaattaatcataaattatagtgattaattacattaaaacagtagcattatgaatacacaagatacaagtttcagtttaaggaaaaaccatattttaataatccccaagtacgcctgtattctgagacactaaaaataattatatgctactaactataccttgaaaacgcatacactcttactgaagacacagaaatgaacagaacagaactaaaaattgaatacattttgtgacacatgatttttttcattgtaatatttctgaaatttggatgcatcttggaatctatgacatcttatagttgccttcagccaggtggcagtcgtgatgtcacaagcaatgcttgcatgtaggagaacaacgtgtaagacacatgtcagcatcttgcaagaaaacctcagagtcaattacagaccactcttattattcctaggacctacttgttttgaaagaagatgggtgagacaatgtattatatatgtttaacatacaggaagcaaaagtaaaaaaagaagtctagttctatgtcattgccaaatgacttaagagtctagcaccacagcattttagttgcttaacagatttaaatgttacattgcgcttgctttggcagcacatatgctaacactggaccaatacagggaagatcagcaaggcccctgcacaagaatgacacataaatgcataaagattccatatttttttggaacacaaaggataaatgcttcaggggattgacacccaattttccatgatgtgactgttacacatggcatacctgcaccaaaatatctcatgtaccccatgaatatatacacctacaatgtacccacgacattaaaaataagttaacattttttaaggaaatattacctcatcttatctcttgatggcatagaaatttatattttaaaactgttatatataattatataattttataatcatacaattatatttttatatttttaaataaatatataatttaattatataaacatttaattaaattatacatttaattatataaacatttaattaaattatacatttaattatataaacatttaattaaattatacatttaattatatattaactatgtaatttaattgtatgtttttatatatttattatataatatagatccattatctatatttatacatatatctatatacataatatatttaatatatattatttatacagaattatatataattaggcttaataactctgagtcaaaaacgtgattcaaagagtcaaactctacatgaaaggaagtttcagaaatatctcacccaattaactttgcttatattttattttaagtatatttaattatatttcaatatatttttatatttcaatatattatattgaaatatattatattgaaatatattgaaatatatatttttacgtttcaatatattatatttttatatttttatataaagcaatatataaaattatatttcaatatatttcaatatattatatttcatattatatttcaatatatttcaagatattgtttttatatttttaaataaatattttataatttaatgacatataaacatttaattaaattgtacatttaattatatattaactatgtaatttaattatatatagttatatatatttattctataatatagatcattatatttatacatattttatatgttatttatacagaattatatgtaattaggcttaataactctgagtcaaaaacatgattcaaagagtcagactctacatgaaaggaagtttcagaaatatctcacccaatttattttgtttatattttatttttgtgtatatgcaataaataatttaaaaatttataatcaagctgaaaagagttctttcagcaagcacaaaattttccagtgattaaaatttactgagtccgtttatttggtggtatttttcttaggttttttttttttttcatgaaacaatgataactgctagcatcgtagatacaacaaaataggggtataaaaatatgcgggaacatgaggagatggtatacaaatctacagaggcatgaaacaatagaaattagcgccaatctggaagttaggagatagagatcccaggcttggttccataattaaggagctgcgtgatcttgagcaagtcacttaatctctccgagcttcaaccataaaataaggagctgtgatagataatttccgagctccagagagcagtgatgtaagcaatcaggaaaatagaaccttccctcgatgctccaaggaagaagggatctgatgtgggtcactatgtgcttatgaaagtgacggaaaggagtcctgaggttgaggaaggccagtcactgctggcctcagcttctctaatggctaccgagggattagacattgcctccaggcaggtcagaaactcaaggaaacttccccacaggtcacagcagcctccggtatctattggtgaactgctaaaggctactaaaaaccctttaggttccaaactctgcatgtcagcaggccactgccccaatacacacttctctgccatccaaatctcccacaggagtttcttactggtcgcatccaagacaaagctctgttaggcaaggggttctgggaaatgtagttcctacactgccagtccctgtgctgtaggagagatcatagaatgaggtaggaatggggctgagtgtcacagacagatatctggtaccccagctggggagcgagggactatgatggcaacgcaggtgaacaagagggaggggacggcatgaagacagattcagaagtcatggagaggaaggtacacatctgaaagacacctcaaaggaagaattgaaagattagatatgggttactttttctttccacactagtgagtcaatataatctataaatcaagtctctttagctcctctgctgactatcatgttctttttccctagctctcctgtaacagggaacaatacaccctttttcttgtagtgcaagaataatgatttgctggcagaagctccgtgaatcagactttgcactgaacatgttatattgtttgggaacccagctaaatttttccatgactgctttaaaagtgatttccatttaaagctaggtggaacaaattcctgctgctggctaaatcttctttttcttttccaatgaacagaatctcataaaaaggactattgctcttttgtacttttctgtgatgcattttgtgttggggtctatggaggaagccatctaaaactacagagtgttgtaaaaataccctcgtaattctactagaattcaactttttaatagctgtctttcttctccttttatatctccttttcaattatttctttccctttggtactctgacagactaatgtttctgggtctttcatagacacctacatcgaccaaatggatccatctcccacctttgagatcctcattaaactctggcagagtttggtggctacatgaactcaaaccccagacgtatggagaaagaatcactttcaatagaaaacctaacatcaccagtacttacaattctgactaatttttgtcataaataaatacagtggacgtcatttatgtccattttgagtctgtatctatgttatatcacactttgcctaataataatgctgctgtcaatttaatgagggttttagcttacataaataacaaacattcagttcagtggggtttatcttaaactgtacagaggtgcttgttttattataattcaactgaatcagaaactttctttctctccacttgctcacactggcttctaaccaactcacgtttctttaatgacaagtgctaaataaacttcacctggggactgatctgccaataaggataaaaaaaagaattgccccggctaccaaagtatcattgtttcatctccaatgaaacattcccctgtaaaaccatttctctctatgcaaggacttggagtaggaatccagccacagaggtcagggaaggccccaccaccaccatccccactgactcagaaaaggattaaaatattttaaagaaggaggaccagaggacaaaacgtcagcatggtcaagaaaaagtgagcagagccatgaatcgagtgatgaagttgtagattcatagaaaacatgtaaaggctatcatatatgtagaggtaaagtgtcactcctcgttttaagggtgaagaaatgaggcttgcaggagttaagtgtcacacagcagatagtggccaagatagtggccaagccaggctgagtcccatgtccaaatcagtgtactgcttgcttctctgtgcacctgtcatctttagtggtggtgaatggatgagcagtattgaggttaataccctaagaaataacacagcaataatgctcaagtgtaatctagtaataataatgattggaaatcaacattactgtagtgacttcaattgtgtgccccaaaaagatatgtccaagttctcatccctggtacctgtgaacatgaccttacttggaaacagggtttgtgcagatgtaatgcagttaaggatctgcagattaagatcatcctggacttagaaatctactctaaatccactgactggagtcctcatgagagaaaggagagagagctttgacacacagagaagcaactcatgtgaagacccatgtgaagagagaggaagagattgaagttctgtggtcacaagaccaagaatgccaggagccatgagaagctgaaagaggcaacaaacctcctcccctggagctgtggagggagtgcagtcctgctgaggcctccattgtggacttctggcctccattgtggatttctggcctccagagctgtgagccaatacattctgtggttttaggccatcaagtttgtggtcagttgttacagcagctttaggaaactaatacaactatgaaaatacccaatctaaaaagcaatccaggaagaaatttttgttgtcctagtggtttgttgttgtcattgttgattttaacaaaatatagctcaaataacagtactttgaacttttcagttaggaataattacacacgtaacggctcccctaaatgttttttagcctaaagactctgtcaacatttaatattatataaaaggctctgtctacctccccagcctcgtgtcctcccagccttccccttcccccagtattccagccacactggtcttctctttggttccagaacatgctaggacccttctcacctcaggcttctatgtgctcctcctttggctggcacactcctcccccaccatgcaccacctccccagtcaacatcagctccaaagtgcaactctacgggaagccctcctgcccctttataatagatcagccccacacatacactctctttgtaaactctcctaacaccctttccctcttcttcacagtcatgatcattgtttgtaatttttcatttatatttctggattgtctgtctttcctgctggactgtcactctctgacggcaggcacaggacattttgctcatcatgacatttcatgggtagcatgatgcctggcatatagcagccactcataaatatttggaaaataagtgagtgatagtatttagccttggatggagctcttgtctgttattcaaacttatagctgttctgtttccaacatataaaattgaaattgtagaaaaatctgtacatagtcataatttgaaaattaacttattttagtaatgtcttaatttttctcctctgagtttctaaatgaattcatgaaagttctgctttgtcccaaaggcatttcataaataagtaagcatagctaaaagggactcaaacctgttacatttcaccatgccatccgagttcatggataggtgaatttgccctaattagtattatccatttatataatcaataagcatgttgggtaccgtattagtccattttcatgctgctaataaagacatatccgagactgggcaatttacaaaagaaagaggtttaatggactcacagttccatgttgctggggaggccccacaatcatggcagaaggtgaaagtcacgtctcacatggtggcagacaagagaagagagcttgtgcagggaaacttctctttataaaaccatcaagattcatgagacttattcactatcatgagactagcacaggaaagacccacctccatgattcagttacctcccactgggtccctcccacaacacatgggaattgtgggagctacaattcaagttgagatttgggtggggacacagccaaaccatatcattctgccccagcccctcccaaatctcttgtcctctcatttcaaaaccaattatgccttcccaacagtcccccaaagtcttaactcatttcagcattaactcaaaagtccacagtccaaagtcttatctgagacaatataagtcccttctgcctatgagccagtaaaaccaaaagcaagttagttacaccctagatacaatgagggtgcaggcattagataaatacatcattccaaatcggagaaattggccagactgaagaagctaaaggccctatgcaagtccaaaatccagcagggctgtcaaatcttaaagctccaaaagatctcctttgactccaggtctcacatccgggtcacactgatggtgggctctcacagccttgggcagctctgtccctgtggctttgcaggctatagcctccctcctgactgctttcatgggctggcattgggtgtctacagctcttccaggtgcatggtagttctccatgagcaccccgcccctgcagcaaatttctgcctggacatccaggcatttccatacatcttctgaaatctaggtggagggtctcaaacctcagttattgacttctgtataccttcaggctcaataccatgtggaagctgccaggacttggggcttgcaccctctgaaaccattgtccaacctgtaccttgaccccttttagtcacacctggagcggctgggatgcaggacaccaattccctagactgcatacagcacagggaccctggggccaccccacgaaaccatttttctctcctaggcctctgggcctgtgatgggagggactgccacaaagatctcttacatgtcctggagacattttccccatagtcttggtgaataactcggctcctcattacttatccaaatctctgcagccagcttgaatatctcctcagaaaataggatttttttttctatcacattgtcaggctgcaaattttccaaacttttatattctgattctctttttaaactgaatgcctttaagagcacccaagtcacctcttcaatgtttttctgcttagatattttttctaccagatactctgaatcatctctctcaagttcaaagttccacaaatctctatggcaggggcaaaatgctgtcagtctctttgctaaagcataaaaagaatcacctttgctccagttcccaacaagttcctcattccatctgagactacctctgcctggattttactgtccatatcattatcagcattttggtcaaagccattcagcaagtctctagggagttccaaactttcccacattttcctgtcttcttttgagccctccaaactattccaacctctgcctgttacccagttccaaaattgcttccacattttttggtatcttttcagtagggctccactctacttgtgccaaaatctgtattagggttctctagagggacagaactgataggatagacatatatataaagggaatttattaagagtattgactcacatgatcataaggtgagatcccacaataggccacctgcaagctgaggggcaaggaagcaagtccaagtcccaaagctaaagaactttgggtccaatgttcaagggcaggaagtagccagcacaagagaaaaatatagaccagaagactaagccagtctagtctttccacgttcttctgcctgcttttattttggctatgctggcaggtgattagattgtatccacccagattgagggtggatctgccttccccagtccattgactcaaatgttagtctcctttggcagcaccctcacagacatacccaggaacaacactttgcatccttcaatccaatcaagttgacactcagtattaaccatcacaggtacctaatagattccaaagattgtattttaaaatatgttttaatctatagaagagaaaaagaagataacaagaacagtaatgagaggtaaatcacagtgaggctgggtggcggtaaaggaacatttccagaggcagtcactcttgagctgagtcttaaagagtaggagaaagtgagtaaagaaagccatgaaggttgttttaggtcagggtttcttatttttgacatttttcacagaataattctttgttgtcaggggctgtcctgtgtgttttaggatcttaacagcatccctggcctctgtccatgaggtgctagtgtgacaaccaaaatgtctcctgaagatttctcaatgaactgaaaacagaactgcagtttgatacagcaatcctactactgggcgtctactcagaataaaagaaatcattatataaaaaggatgcctgcacttgtatgcttattgcagcactattcacaatagcaaagatatggaatcaccgtaagtgtctaatggatgattggataaagacaatgtggtgtatatatgtgtgtgtgtgtgtatatatatgtgtgtgtgtgtgctgtgtatatatatatgtatacacacacacacacacatatatataccatggaatactactcagccataaacaagaatgaaatcatgtcttttggagcaacatgaatggaattggaggtcattatgttaaatgaaataactcagaagcagaaagccaaatacctcatgttctcacttataagtaggagctaaatgatgtgcacatatggtcatagagcatggaataatagacactggaggctcagaaagggaggagggtgggaaggggaatgagaaattatctaatgggtacaatgtacactatttgggtgatagttatcctaaaagccagacttccccactgtacaatatatctgtataacaatactgcacttttaccccctaaatctataaaaatttaaaaattttaaaaaacgaaaacaaaatgtcacctgacattgcaaaatatctcccctggaatgcaccttcttcccagttaagaaccactggtgggggcagaggaaggagcctatctgcagttgggggtgtctgagttactgcagcatgtccaggtagctctaggagagtgcccgggagggagataggagagaaagtacaacactgctcttacacagggggtttcatgtcttatgctggggagtgtggaatttcatcctgaaagcacttatgcagaatcaaaggatcttaagtaggaagtggacatgggctaatttgtgcttaagaaaaatcactctggtcacagtggaaaggaaggatcgaatggagatcagaatgaatttgaaagaattgaatgtaatccagaagagaaatgattcatggggacagaaaggaaaggaaagggaagatagaaaggtactcacatcacatctctaagaccttgtctagaatgggatctagattcttggtttggatgatcagaaagtagaatcataaatcttctccaaaatccacttggaaattagccctcatgactttatgaaaaaaaaaatcaaacccttgaactcagaaaaattacttgtaaagttggttaagcataatctaggtgacctcatgatgtaataaataaaaatagccactacctccggcttcaaattcaattaggccttcagcaaagattatttcagcaaattgtcaaaaatattagtttttaatcaatgtattagaaaactgtagtaaattttcaccccctgcccccaagcaatgtctagacaagtgagacagagagacaaaatgagtaattgaggccatttttcttgcctgattgttcagaaaattgcctcatttctttgctttattttctgagtccacataatgataacagaaaaagttgtatgtgtggatattttttacaatctgaatctttgacagtgttgagagaggtaatcgccaacaaacacactatcacagcatttgccagatcgtctgttttctttcaggcttttgtcagtatctaaggcaagtcctttgtgtgagaactgactagataaaatgtcatgagcacctcctgtgagggaaagaccgagactgagatctcagtcataaagagactccccagctacaggtgctacaaggtgtgcaaaggcaattaacaatttggggcaaagcgcaattttcatagactctgttttgcaaaaaaaaagaccctacgctacctatttcacaaagttattcacatttctagctcatgaggaacacaggatattcaggccctgctaaaggatatgaataggtcatccaggttttgattaagagattgtttgaacaagtcccaagtgggaataattcaaattaaagcaagaatgtgtcaatacatctgaaatgttgaagaatgcaaaaatagtatttatacataaatataaaatataaatggaatttttatgtgttgatcaattatgtatttttaaatatttggcttcaataacaatataagaaaaatgaaattcctactaatccatagaataatgtgtactttcttttaagaaatcaccaaccttaaaatcactaaaatatgatacatttaacaaaatggtagattttaaattataaaccaaactgaattcagaaagtaaaaattatgatacacagtttatattggtcaaagttgccattaattgtttattatcattaaaaataaatacatatgtttcacttcacatgtgttacacaggtgcttaatattttattaatataaatgcataattcatttgctcttcacaaccacaaaaactagatacatgattattcccattttgcagataaggaaattaacacccaagtgaaatactttaccaaaggtcacataggtagtaagtaacaactgtgtgatcagaggagagcattatctccaaacttcgtgagagacacatataagcaattagtcccttacagactaagaaattttgatacagacaatttgttgcagattcataagatagtacagccagttctgtgaatcacagtgttatatttatttccacatattctatgttaataatataatttttaattccatgtattttaagttttcattcaataactgctataagtatatgcagctctgagaacaagggggaagagaataatttcagccatttaaaaatagcttttatatttagatttaaatatttcagttgcatttcttttttttttttttttactttttacttttctttttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggcgtatatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctcaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccaggctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttacccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagctgacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtgctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaagtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttatgtctctatttccttcagttctgctctgattttagttatttcttgccttctgccagcttttgaatgtgtttgctcttgcttttctagttcttttaattgtgatgttagggtgtcaattttggatctttcctgctttctcttctaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggcttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacattggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccatcactgataccctttcttccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcattttagagtttccagtttttctgttctgttttttccccatctttgtggttttatctacttttggtctttgatgatggtgatgtacagatgggttttcggtgtagatgtcctttctggttgttagttttccttctaacagacaggaccctcaggtgcaggtctgttggaataccctgccgtgtgaggtgtcagtgtgcccctgctggggggtgcctcccagttaggctgctcgggggtcaggggtcagggacccacttgaggaggcagtctgcccgttctcagatcgccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttggagcttcccggctgctttgtttacctaagcaagcctgggcaatggcgggcgcccctcccccagcctcgttgccgccttgcagtttgatctcagactgctgtgctagcaatcagcgagattccgtaggcgtaggaccctctgagccaggtgtgggatatagtctcgtggtgcgccgtttcttaagccggtctgaaaagtgcaatattcgggtgggagtgacccgattttccaggtgcgtccgtcacccctttctttgactcggaaagggaactccctgaccccttgcgcttcccaggtgaggcaatgcctcgccctgcttcggctcgcacacggtgcgcacacacactggcctgcgcccactgtctggcactccctagtgagatgaacccggtacctcagatggaaatgcagaaatcacccgtcttctgcgtcactcacgctgggagctgtagaccggagctgttcctattcggccatcttggctcctcctcccttcagttgcatttcaagtatctttttctgctaagaatttggcctgtctgaatttcaaaaggcatttgggcttcaaactttagttaatggtaaaaaaaaaaaataactaaatatttaatttcctgaaatagttccaaattacagaaacagagagaaagcttaaataccatagaacaaaaattcatagaatagaatttatgaatcatgattcatacacaaaagaccaaacctctcaatgaataactgtattgttgacagtttgggaggaattttaattttgtttttttttctcaaatagtgagatcagagtcggaaaagccttaacatctccatattagagattctgtaactcacatcacttatgccaggctccagctacgtactctgaaaagtatattaaatcagaatgaaaattgttcagtaaaatttctcctagaggtatagtaaatatgattgatttaatacatcattgagattctactggaaaaatggcataaaacagcaacattctgttgccattttataactttcatttttgtaaagtgaccattagcataatatagtaatatcattatgacaatctgcacagatgaaaatatctcaaggccaatattacattttcatcaagtaaatgaccatgtgtttcaataaacacgattatgaatgttaatataccaacagattgagtattttcatttctcagcatcattgtttgtaggggaaaacaaattaatcatctttgagataacaggagtgtagacttttagaacatgatctgtttcactacaactattcttggtttgctgaataagagtcaggattttactccagactgtcctcatctgaggtcatcttatctgtccccttctgaagtaatcttgtcattatgtaaatacctatgcagcattatcaatttagagccagataatttaagatgaatcacgtctttattttgataagtatccacaggacacccatttgtacagtagaaacatgcaaagaaacctcttcctcctgcctgttctattgtcttggacaattcctgaataagctgttctccagccctgcacacctgcgagcaggccagggactctgtggacccagccatgccctttctgtcaccaaggccacatttgtggtcaggaggcaagtgagatggtcatcactttcacttaagtcctttttagcaataggcatgttaggcattggaatggatgtgcaagcgaaatggacacaaaccaaaaatggaagaggcaacctgtctatggccttaccatcccgaatatgcctgatctcagaagctaagcagggttggtttggctagtacatggatgggagaagagataactagctgagacttcagtatctagcttataggctgcttcagccttcaagcacagcttaattatatgtattactggggaagatccttttctggaaagaggcaacattttaagaccattcaagattaacctttacttgagcaaaaagaaatgtttctactttcaaatgctttttggtaaaaatctttaaaaaataataaatgcttcaaagagaataaaacagctaggaatccaacttataagggatgtgaaggacctcttcaaggagaactacaaaccactgctcagcgaaataaaagaggacacaaacaaatggaagaacattccatgctcatggataggaagaatcaatatcgtgaaaatggccatactgcccaaggtaacttatagattcagtgccatcccaatcaagctaccaatgactttcttcacagaattggaaaaaactgctttaaagttcatatgcaaccaaaaaagagcccgcattgccaagacaatcctaagccaaaagaacaaagctggaggcatcacactacctgacttcaaaccatactacactacaaggctacagtaaccaaaacagcatggtactggtgccaaaacagatatatagaccaatggaacagaacagaggcatcagaaataacaccacacatctacaaccatctgatctttgacaaacttgacaaaaacaagaaatggggaaaagattccctgtttaataaatagtgctgggaaaactggctagccatatgtagaaagctgaaactggatcccttccttacaccttatacaaaaattaattcaagatggattaaagacttaaatgttagacctaaaaccataaaaactctagaagaaaacctaggcaataccattcaggacataggcatgggcaaggacttcatgtctaaaacaccaaaagcaatggcaacaaaagccaaaattgacaaatgggatctaattaaactaaagagcttctgcagagcaaaagaaactaccagcagagtgaacaggcaacctacagaatgggaaaaaatttttgcaatctacccatctgacaaagggctaatatccagaatctataaagaactcaaacaaatttacaagaaaaaacaaacaaccccatcaacaagtgggcgaaggacatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactaattcaaccattgtggaagacagtgtggtgattcctcagggatctagaactagaaataccatttgacccagccatcccattactgggtatatacccaaaggattataaatcatgctgctataaagacacatgcacacgtatgtttattgcagcactattcacaatagcaaagacttggaaccaacccaaatatccatcaatgatagactggattaagaaaatgtggcacatatacaccatggaatactatgcagccataaaaaatgtcctttgcagggccatggagaagctggaaaccatcattctcagcaaactatcacaaggacagaaaaccaaacaccacgtgttctcactcataggcgggaattgaacaatgagaacacttggacacaggaaggggaacatcacacaccaaggcctgtcgtggggtggggggaggggggaaggatagcattaggagatatacctaatgtaaatgacgagttaatgggtgcagcacaccaacatggcacatgtatacatatgtaataaacctgcacgttgtgcatatgtaccctagaacttaaaatataataaataataagaataataataaattatttttctgatttgtttaaaaaaaatcactgtattccttggctgcagcacagcagcaaatgtagctagtataagaactacttatcctgggtcccaaaatatagttgcttgaaaaagtctatattgcgaccttaatttttagtgctttgcctctttgggaactccagtgtgaagagaggtatgcacaacctcacggtcctcaggttgttatcacatggccgaacactttacaacatgaattcatgaattatgtagttaattattacatcaaagaagatctcgccgcacttatcacaaacactcttagttatagccccacaaccttaattgttattgccaagaatttctttccatccactcttcctattttgcaaactacaattacagaggaggtatgaatgaaaagttttctgtatcattccaaaaatatgttaagatgttctgaaaagttctgattccttgatctacgagtgacttagcaacatgattagatgagacaaaacccatagctacacatctttctctagaagtcttaatgtcgactcttgacaaaatttcagatccattcaaaatttcaaatacgttaaaataaaaaaattaacactctaatgttgagattgagtagactatacaaagccttccttaaagattacattttttgcattttctagttttcattcattgcaagaatgtttgtaattgctcagtgaatggctaatttcaaatctgtaccaggtaattctcacatctctgtcatctcacggctgacacctattgattttctttctttttctttcattcactttgagatcttcctggtccttgacattgtgagtgactcttggttgaaacctagacattttagatattattttatgagactacggatcctctgctggttgaaacctagacatttaagatattattttgtaagactatggatctgctgctgtcatcctctctctgcttttctttttcttctccacttactcctacccctttaatccagtgctcaagtaggaccagggaaacattaaaagttggcccacagatggaaggaacattgtacttcatgtgtcacatttaaattctccaggaagaaagggcttgtcaataaagtgtctttttaagtcacagatggcagtaaggctgtgctactcccaccttttctttctattcattgtctcctaatgtcatttattttctgaagtatctaagtagcaccaccactatccaagactgacagtctccatttatattcaatcataactcactagtgaagattaattggggaggagacaagtctgaattagaaatcaccaaagtagtattttaaaagaagtgcagatttattgcattcaattctagacctaattcagagacatggctagaactgttacgaaggaaatgtcttaaacggcctgatttaaagcatagagacaacccatttgtacattagtagaaagtaatgtgttttaaatctttaacaatggttttcttgagtagattaactaccgctttaaaaatcctatttatttatctcctacactaagtaaatttcaacacaacccttttctgaattttcacaaatactacaggagaggaatctaaattagaagctcgattatatatgttatttctgtttaaaaggcactaattaagctgctttgccctgtgagcactagaatttgggttggcacagtcatttcataatctgaactctaacacaattatttctggatgaaccattgccataaaatttaacaggctatattagctgttggttggcattgatgatctataaatactaacctttatctcttgatattttttctcattcttttttatggttaatttagaatttcactgattaggcatttgcttatataaagtgctttgttaagactcaaaacatttttaagcatgtttatgctgcaaagtgaatgagtgttgcaaagtttgacttagtgtagaaagattgtaagactagaagttacttttagaaaacctaaactatcttgtagaaaaattatctcacggtttttaaaaatggcgttcaaaattcagagagaacaattcaagcttgttgctagtggaaagttaacagtggtttagatcagttgtacacactgtgcaagatgtttatgtgctgacagcttgtgtgcctacctccacatcaattcggccattataccagctaattcttctatctaggattcataacataaaaatgtgcttcctctttctgagggaaagttgactatgggtagagaagagttgccgttatttcaccttgaagaataacaatataagctcatgtgcaatgaaatagcagacttattggaaatgattactagcttcttgaaagcaaagaagtatatattttttaacttcataaggatttagaagttgatcattcatcatccccttctgcactctgagtgctgaaccaactgaaaaagagatggaagcaagtgtcagacagaaatcaaaacagtagctcagactgtgtttctcttgtgacataggcccttcaaaccctactttttgaaagagtggctaggatacatgaagtcattacagtatcaactgcatacccacaacatttagaaaatataaaactccccagcccctacttcaaggttatgttctcagaaccagatatatagtgcagtctagccctgcatcatccagcacagtggttcctagccacatgtgactgttgagcactcgtaatatggctactgtgacagaggaattgaattttcattgtgttttaattaatttaaaattatatttaaaaactgattctcaattcactattggaagactttgaagtctacttgaaacaatttcaggtatgtgcatctactttttcaaccataagctacatggaacctaagtataaattagttatttctaattagaataattaattccattaaaatgaaaaggccaaattgagatatgctctcagtacaaaatacataagaattttgaagacaccgcccaagaaagagaatataaaatagcccatttataattgtttacatgttgaaagaattgtattttggatatacaggattaaataaaacacgaaaattgacttttaaaaattcatctgtttctttttacttctttaacacgattactagaaaatgtttaattacatatgcggctcacattgtatttctattagactcactctactagagtgtgatgtagattcaccctctagttggtgtgtaaaagtcatggtggagatttcattgtatctaggggaagaagaacaaactaatgaagggggagaaggagaaaaccttctgactcccaggaagccaactggtctgggccagtttgtgtctctgcatgacttctgagcctgaacttaagtggaagaaatctcccaccaagaagttacttacattgccaggtgtttgtttcttctcagacctaggattactgagctctgagtgtcatcttacctggatgcttcttctcctactcttgtttattaaaagctgttacttctctaggctttgattaacattaactattaaaattacagtgtaggctcggcatggtggctcacacctataatcccagcactttgggaggccaaagtggacagatcacgtgagatcaggagtttgagaccagtctggccaacatggtaaaacccggtctctactaaaaaaaaaataagtacaattgcaaaacaaataaataaataaatctgcagtgtaaaactctcttttactctctattttcctattgcaacataattcagctttccctgggtagccattccttaatcctaggtgagaaaaaatatatattaaagatgaaacatctactaatgcccagccctgcaaaaaacttatactcccatttctggtggaggcaacattgaaggttggctctctggtgtctaaaaagatgttctgcccatgtcgatttgaacacctattttttgtaaaaggccttgccctttccacatggactatgaaggacccacagaagtgaaactgtgtccccagtctaaactccctgggagaacctctcctgactcaataaagaattggtttttctgcccaagaacagagctctgcttgattagtttgaggtcgaggagaccacctggatcaccaagataaatgctttttcttgctaacccaacgcagaaacaggtacatttctcagttcttcaaccggccgaccctgctgcctcctggagcccatatagggtttcttgttcagccatagttctagaccttggctgcattttggaatcacctttctagtctcgagcataaaataaggcccagagcccaggccagactcactacatgagcattttcagctactaaggagaacttgaagaaaagaaattggccaagcagcggactcatgtgtgccctggcacttttcctatctcactaatcgcccttctcatatcataactcacccttctcatgaaaaaatagaatgaataaatgtggacggggaaatgccgaaacaccctcctcataacttgcacacgaatcctcctctatgttcgaaggcagggaaagagagaaaatggtaccaaagatagcctgtgtgcagtacttgaggcaaggctttgcatgtttcaagcgcccaatacttatctgttgacacaaagagtgccgtaattatgttagaattagtttggctttttttttttttctgctctagaaacattttgttcgtataagtcaaaaattagaaagaaagtttggaatttaatttcttatcaggcaatagccaagggaaaatatttctgttaaaggagtaatcatacagaacagctaaaattccaggaataataaaactcaggaaattttggggggagtggggtggttaggttttggaaaatatttgtcagtaatatttgaaaatccagatcttccttaaaagtctacagatttgagtgtacccctcacccaaggaaatctgtctcaagagacagaatcagtccatttttcagggttccccaggaaagtttgtcacagccagacataaatgtgatgaaaggcaggaaagggagagacagaggctgggacaaagaagatgacagactttattggtaacattaggccagaatgataaccataacccaggctgtgttttcaaagttgttgttgtaaactaaatgttttggtatatttgtcagaactttttatcttggttagtttaattaaaataaagtcggtagccaaaataaaattatgtaaaggttaatcaggatgtttcctgtattttttgacataaaccaaattaagtagttatttttctaacacatggaattcttacatttgtctccgtgcaagatgtatgttaatgttagttgttttactacatttgaaattcagtcttttaaaatgggttttctctgttctcctccaaggctatttgagcatctaaatatctacatattacatggctgttggcaaaagttttcaaatgctattcactcaatttgaaaaaaatttgcacttcttataaagctagtatgaatgtgactctaaaatctcaccaattggcactaatcaggttcatcatcaaaataaacctgataaatattaaaactaaattgttgagttggttttgtaatgtcaggattttcaagacaacaaatggccaagaacttggcgtcagaggaagtcctgctttcggttgattcttgatgctgattgagaacaggcctcctaagcactgatgggaatatttgcctctaagaagtacagcccatttaccacttagaagctaaagttcagaaataaaactctgacacaacaaaatatcaataaagccagatagagcactagaaaaattcgtaaatctctaatatgaatatacatctctaatacaaattacattcaagcaacagtgatttgcctcggctgcaagtaattatgtacctattgttaaaatagtgtgagtcacagcaagaacatggacaatatcaattcccttcagagactggactctgtgaagcctttccagttctaactacacagtacgatctttttaaaactatcagctttgcactcatttcagacccaagtatgttgaactggatgaggtattactttcaaggacaaggactggacgttaatcaaaatgaaaatactctttttttcttttttgagatggagtctcactctgttgcccaggctagagtgcagtggcgtgatcttggcttactgcaacctccacctcctgggtgcaagcaattctctgcctcagcctcctgagtatctgggatgacaggcgcctgccaccatgcccagctaacttttgtattcttagtagagacagggtttcatcatactggccaggctggtctccaattcctgacctcaggtgatccgcctgcctcggcctcccaaagtgctgggatgacaggcgtaagccactgcgcccggcctaatcaaaatgaaaatactttcaacatggaaataaagctttccagtgctaaagcttctgttttcttagagcaaaagagctccactaagaagaaaactgaatgttattgagatgttgtttaataagttcctggtatgtagattgaattgtgtcactgccaaagaagataggttgaattcttaactcctggaatctgtgaatgtgaccttatttgggagttgcagatgtaatcaagttcggatgaggtcatactgaagtaaagtgggccctaattcaatgactggtatcctcataagaaagacatgtagacatagccacacagggagggcgccaggtgaggacaaagttagagtctaaaagctacgtgtacaagccaagaggaattaaggattgctggcaactaccaggaactagtaagatgcatggaaatattctcccctagagacttcagagagagagcacagccctgctggcacctgcattttggacttttagtctccagaactgtgagaaaattaagttattttgtttgaagctacccagtttatggtaatttgtttcggcaaccctgggaaacttctatataaggctatgtcagaactcctcttatctcttaggaaaccaaagttctatccttaagcgaatataagatgtaagttcacagataactcagaatgtcctcccgcttctcaagaactagtcctgggtttgcattatccttataaatgccctaagatgattttttcaagcatatgttaccaagaagtagggaagtttcagcattaacaatacatagcttcgtaacaattagccatctgtttataatgctgttagggatcgacagcatctcaatggaagcagggaaaacaacagaaatatcatatctgccaagttctagtcatctgttatgttacatagtaatttgtcatctcatgagatcaccaaggagagaaaaaagccatgccgtgctacaaaataaactctgtaaagcaggtagtttaatagcaaattaatgatgtgctgacaagatcaagaccaaaaaaaaaaaaaaaaaacatgtcatattttctgcagtgcagctaataatgcaagtttgtaagctgtctcacaagaaggtagtatttattttttccaaggagctatttgaaaaccagagagttaacatattttaagacagttttcctcaatgtcagtttattttaaatattactagagttcagatattatcttgctatcactcttaatatccatcttaattatgggagtccctgtggtaaagtctaacctctttcaatctcatctcttgacttgatgattcatttcaaagaatgtgttagtacaatggggcttcttctcaagagcaaagtaactttgaataaaatttacaaaagtaaaagaaataaagcagatggcaaatattgcccacagaattggttatagtatcattatccattaagaaatgaattttgtacaatagatgatttaggtcttacttatctgtctctcataaatatgtatatatgcaatattaagatagatatactgatattgcaaactggcaataaaaaaggtggctttaatatttcgtatggtttggctctgtgtccacacccaaacctcatcctgaattgtaatttccatgtgtcaagggagggacctggtgggaggtgattgggtcatgggggcggtttcccccatgctgttctcaggatggtgagtgagttctcacaaaatctaatactttgaagggatttggagactgggtgcagtggctcatgcctgtaatctcaacactttggaaggccaaggtgggcagatcacctgaggtcaggagtttgagaccagcctgaacaacatgctgaaaccccatctctactaaaaatacaaaaattagctgggcacggtggtctgcgcctgtaatcccagtgttcaggaggctgaggcagaagaatcgtttggaccaaggaggtggagattgcagtgagcagagaacacaccactgcactccaacctgggcaacagagtgagactccgtctcaacaacaacaaaaaaaattagccatgtgtggtggtgggtgtctataatcccagctactcgggaagctgaggcatgagaatcacttgaacccaggaggcagaggttgtggtgagccgagatcacaccactgcactccagcctaggcaacagagtgagactctgtctcaaaaaaaaaaaaaagtgtttggcagtttcctccttgctctctctctctctttcctgccaccatgtaagacatgccttgattccccttctacttctgccatgactgtaaatttcctgatgcctcctcagccatgaggaactgggagtcaactaaacctctttctttataaattaccgagtctcaggtcattcatggcagtgtgaaaatgcactaatacaatatttggaaactctatgcaacaatacagggttcatatattgtccagcctgaattaaagtgctatgtgttatctctcctatcaaactatctttaagatgatgacaaagggatttcaggtgacaacttggaatgaaagatactgacccactgtttgctttcctgtagcttttcctcaagtggataaaaacaattacagctttttttcactagtctactaaattgaactcttaatatcaccccagctgcttttcttgtaggtgttcctttctatgtcaaccacacttctgtttgtgataaggattttcacctcatctgatgaaaagagcagtctactgtgagaaagaactaagcttctactcccaaagcacaagcagtttctgtcaaagcaggaatacaaatatggtcccttggaacctagcccattgcctttccaacataatggtggttattgagccatcagaccatgctttcagcagatacttgaacttccactgtgtatgaatcattatattagtgtaatagagctgtagagataaataagacctagcccatgcttataaatgcctcataacacaaaggacagagaaattatgcataaataaatgcaaaataaatgcagataaatctccatggctgttcagttacacaggcatccaacacatccattgagtatttaccacataccaactttgtcctaaagactgatgatgacacaaattgaaccagatttaggcaaccaccaatctcacaaagtttgcaatccaattagaagagaaaagaatttaaaacagccattgcattatagaatcattaatgcaatgaaaggaagattcccaagtactaagagaaggcaacgctgggacacctagcctaatctaaagggcccaaaataaatatccttaaagtggcatataaattaagacattaccaagtgtggtggctcatggctgtaatcccagcactttgggaggctgaggcatgaggatcgcttgaggtcaggagttcgagagcagcctgggcaacatggtaaaaccccatgtctaataaaaatataaaaattacctgggcatggtggtgtactcgggaggctaaggtggaagaattgttcgaacccaggaggcagaagttgcagtgagccaggatcgtgccattgcactccaacttgggcaatagagtgaaactccatctcacaaaaaaaaaaaaaaaaaaaaaaaattaagacacgaaggataggagttagttagccaatatggtattttgtggtaatgcagctataatctaatcaccgatgaaacagtattccagcaaaccacttcaaggaagctttgaaaaccgaccacatccttttggcctgtccatcatcaaaaaagataatagcccgacaaaccatgggttataaaatgcctgacacataactgtgattacagcattagaggtttaaaatgcaactaggaaaacttgaaaatataagcaccaatttcaaatcactagtcatttgcatcaatttcaaccattcccccgtactcctccaagcattctatttggcttgtgtcgtatccaagaccatccgaaatcacagaataaatttcctataacatgcatctttcgtgtgcataataatgcatactaacaatttacaatttgttataatgtcctataatgtacttctttattgcatctgtgtgactaaagagggcagtcgggagaaaatctaataggagaacttcctagggttgaggttcttcagcttaaaatctttataactgggaccccttacattagcactcagctttggccagtatgtctgagaccactcatatatatatacatatatacacacacacacatatacacatacacacacatatgattgttttgtcattgtaccttgtaaaaaggtatttgttaccaaaatgataaaaggaagtgaactttaaaaaatacatgtcttattactgtcatttggagtattcctcaaaccactgattgtatatgatatagctacctctaggaattcaagctcaagttattcacaacactaaagatacaaactgatttccaaaggtattatccaagaaattaaccgtttataagggaagcaaagtatctttccatttcttttatatttttatatatatatattttaagttctagggtacatgttcacaacgtgcaggtttgatacagaggtatacatatgccatgttggtttgctccacccatcaactcgtcatttattttaggtatttctcctaatgctattcctcccccaggcccccactccctgacaggccccagtgtgtgatgttccctgccctgtgtccaagtgttctcattgttcatttcccacctataagtgagaacatgtggtgtttggttttctgtccttgtgatagtttgctgagaatgatggtttccagcttctccacggccctgcaaagaacatgaactcatccttttttatgactgcgtagtattccatggggtatatatgccatattttcttaatccaatctatcattgatggacatttgggttggttccaagtctctgctattgtgaagagtgccacaataaacatacgtgtgcatgtgtctttacaggagcatgatttataatccttttggtatatacccagtaatgggatcactgggttaaatggtatttctagttctagatccttaaggaattaccgcactgtcttccacaatggttgaactaatttagactcccaccaacagtgtaaaagcatttctatttctccacatcctttccagcatctgttgtttcctgactttttaatgatcaccattctaactggtgtgagatggtatctcattgtagttttgatttgcatttctctgatggtcagtgatgatgagcattttttcatgtgtctgttggctgcagaaatatcttgttttgagaagtgtctgttaatatcctttgcccgctttttgatggggttgttttttttcttgtaaatttgtttcagttcttcgtagattctggatattagccctttgtcagatgggtagattgcaaaaattttctcccattctgtaggttgcctgttcactccaatgatagtttcttttgccatgcagaagctctttggtttaatcacatctgatttgtctattttggcttttgttgccattgcttttggtgttttagacatgaagtccttgcccatgcctatgtcctgaatggtattgcctaggttttcttctggggtttttatggtttcaggtctaacatttaagtctttaatccatcttgaattaatttttgtatatgatgtaaagaaaggatccagtttcagctttctacatatggctagccagttttcccagcaccatttattaaatagggaatcctttccccatttcttgtttttgtcaggtttgtcaaagatccaatggttatagatgtgtggtgttatttctgatgcctctgttctgttccattggtctatatatctgttttggcaccaataccatgctgttttggttactgtagccttgtagtatagtttgaagtcaggtagcatgatgcctccagttttggtcttttggcttaggattttcttggcaatgaggggtcttttttgcttccatatgaactttaaagtagttttttccaattctgtgaagaaagtcattggtagcttgatggggatggcattgaatctgtaaattaccttgggcagtatggccattttcatgatattgattcttcctatccatgagcatggaatgttcttccatttgtttgtgtcctcttttatttcattgagcagtgttttgtagttctccttgaagaggtccttcacatcccttgtaagttggattcctgggtattttattttctttgaagcaattgtgaatgggagttcactcatgatttggctctctgtttgtctgttattggtgtataggaatgcttgatttttgcacattgattttgtatcctgagactttgctgaagttgcttatcagcttaaggagatttggggctgagacgatagggttttctaaatatacaatcatgtcatctgcaaacagggacaatttgacttcctcttttcctaattgaatgccctttatttctttctcctgcctgattgccctggccataattcccaacactatgttgaataggagtgatgagagaagacatccttgtcttgtgccagttttcaaagggaatgcttccagtttttgcccattcagtatgatattggctgtgggtttgtcataaatagctcttattattttgagatacgttccatcaatacctagcttattgggagtttttagcaggaagggctgttgaattttgtcaaaggccttttctgcatctattgagattatcatgtgttttttgtcattgattctgtttatgtgatggattacatttattgatttgcatatgttgaaccagccttgcatcccagggatgaagctgacttgatcatggtggataagctttttgatatgctgctggattcggtttgccagtattttattgaagatttccccatcgatgcttaccagggatattggtctaaaattctctttttttgttgtctctctgccagccttcggtatcaggatcatgttggcctcataaagtgagttagggaggattccttctttttctattgattggaatagtttcagaaggaatgataccagctcctctttgtacctctggtagaattcggctgtgaatctgtctggttctggactttttttgattggtaggctattaattattgcctcaatttcagagcctgttattggtctattgagagattcaatttcttcctggtttagtgttgggagggtgtatgtgtccaggaatctatccatttcttctagattttctagtttatttgcgtagaagtgtttatagtattcgctaatgatagtttttatttctgtgggatcggtggtgatatcccctttataattttttattgcatctatttgattcttctctgttttcattagtcttgctagtggtctatcaattttgttgatcttttcaaaaaaccagctcctggtttcattgattttttgaagggtttttttgtgtctctatctctttcagttctgctctgatcttagttatttcttgccttctgctagcttttgaatgtgtttgctcttgcttctctagttcttttaattgtgatgttaggatgtcgattttagatctttcctgctttctcttgtgggcatttagtgctataaatttccctctatacactgctttaaatgtgtcccagagattctggtacgttgtgtctttgttctcattggtttcaaagaacatctttatttctgccttcatttcgtcatgtacccagtagtcattcaggagcaggttgttcagtttccatgtagttgtgtgattttgaatgagtttcttaatgctgagttctaaattgattgcactgtggtctgagagactgttgtcatttctgttcttttctatttgctgaggagtgttttacttccaattttgtggtcatttttagaataagtgtgatgtggtgctgagaaaaatgtgtattctgttgatttggggaggagagttctgtagatgtctattaagtctgcttaatgcagagctgagttcaagtcctggatatccttgttaaccttctgtctcattgatctgtctaatattgacagtagggtgttaaagtctcccattattattgtgtgggagtataagtctccttgtaggtctctaaggacttgctttgtgaatctgggtgctcctgttttggttgggtgcgtatatatttcggatagttagctcttctttttgaattgctccctttaccattatgaaatggccttctttgcctcttttgatctttgttggtttaaagtctgttttatcagagactaggattgcaacccctgttttttttttgttttttgttgttgttgttgttttgctttccatttgcttggtagatcttcctccatccctttattttgagcctatgtacgtctttgcatgtgagatgggtctcctgaatacagcacgctgataggtcttgactctttatccaatttgccaatatgtgtcttttaactggggcttttagcccatttacatttaaggttaatattgttatgtgtgaatttgaccctctcattattatgttagctgtttattttgctcattaattgatgcagtttcttcacagcatcgatggtctttaccacttggcatgtttttgtagtggatgataccggttgtttctttccatgtttagtgcttccttcaggagctcttgtagggcaggcctggtggtgacaaaatctctcagcatttgcttgtgtgtaaaggattttatttctgcttcacttatgaagcttattttggctggatatgaaattctgggttgaaaattcttttctttaagaacgttgaatattgaccccaactctcttctggcttttgggtttctgctgagagatccgctgtttgtctgatgggcttccctttgtgggtaacccgacctttctttctggctgcccttaatattttttatttcatttcaaccttggtgaatctgacggttatgtaccttggagtggctcttcttgaggagtatctttgtgatgttctctgtatttcctgaatttgaatgttgacctgccttgctaggttggggaagttctcctggataatatcctgaagagtgttttccaacttggttgtattctccccattacttttaggtacaccaatcaaacgtagatttggtcttttcacatagtcccatgtttcttggaggctttcttcatttctttttactctcttttctctaaccttgtcatctcactttatttcattaatttgatcttcagtcactaataacctttcttctacttgatcgaatcagctgttgaagattgtgcatgcatcacaaagttcgcgtgccatggttttcagctccatcaggtcattcaaggttttctccacactgtttattatagttagccattcgtctagccttttttcaaggtttttaacttccttgcaatgtgttagaacatgctcctttagctcagaagtttgttattatcaaccttctgaagcctacttctgtcagcttgtcaatgtcattctctgtccagctttgttctgttgctggcaaggagctgcaatcttttggaggagaagaggtgctctgatttttagaattttcggtttttctgctctggtttctccccatctttgtggttttatctacctttggtctatgtgatggtgacctacagatggggttttggtgtggatatcctttttgttgatgttgatgctattcctttctgtttgttagttttccgtctaatagtcaggtccctcagctgcagttctgttggagtttgctggtggtccactccagaccctgttttcttgggtatcaccagcagaggctgcaaaacagcaaatattgcagaacaacaaatattgctgcatgatccttcctctgggagcttcatcccagaggggtgcctgcctatatgaggtgtctgtcggcccatactgggaggtgtctcccagttaggctacacaggggtcagggacccacttgaggaggcagtctgtccattctcagagctcaaacactgtgctgggagaaccactgctctcttcagagctgtcagacagggatgtttaagtctgcagaagttgtctgctgccttttcttgagctatgccctgcccacagaggtggagtctatagaggcagtaggccttgctgagctgtggtgggctctacccagttcgagcttcctggccacttcgtttacctactcaagcctcagcaatggtggacaccccacccacagccaggctgctgccttgcagtttgatctcagactgctgcgctagcagtgagcaaggctccatgggcatgggaccctccaagccaggcatgggaaaggttctccttgtctgccggttgctaagaccttgggaaaagtgcagtatttggtcagaagtgtcctatttttccaggtacagtctgtcacggcttcccttggctaggaaagggaaatcccctgaccccttgcacttcccaggtgaggcaacgcctgccctacttcagctcaccctccatgggctgcacccactgtccaatcagtcccagtgcgatgaaccaggtacttcagttggaaatgcagaaatcatccatcttctgcatcgatcacactgggtgctgcggaccagaactgttcctcttcggccgtcttggaatggagctctatctttccatttcaatgcagccactttagcagttctcttaaagctgaaaatatatagaaaaagataaaacctttcaacagctacagtgatcctgaagtaaattactgtgtatatgacacagtgcattatcaaattgttgctgcatcagcatgtcattttcaaaatgaaaacaagtctattaaagtgcatatcgaaggtataaagtaggatgatagtgtatagtttgatcatgagatattgcttgcagtgtaagtttcatagaagaaaaatggtttgagaaaatggatcaaagggaaatctccaagttgacaacaatgtgttaagagaatgagaatttcaaagtacaactactgaaaaagccaaatttatgcagacaaagtgaaaaagaaatgaatcaaccctggaagagggagaatcagcacatcaccgtcaaggaaaacaagtacaagaataaatggatgttaatttcagctcacaagacagtagtaatttcaaaataactaaggaagggaagtgaaaaaataaactgcagtgtcataactgactcttgatccggagggatgtataagtgtccctgaataatgactgtagttgtggttttgcttttctagcctccttgcttgataaaaaagcctatggaatgatgtaaaacatagattgcagataataagtttgtgccaaggattggctggtttagctcaatttcatatcaacttacaatttaacctagagtattttacatcatctcatcagtttatccatttaaattgattatcttgatcttcttttattttttaagatcatccagtaagtatgtattcagcatctaacctgtactaaatattttgctaaggttgagggagacattaaactcacaacactcctataagatggacattattattacttccatttaacaggtgaatgactaaggcaaagtcatattagatgcccaaggtaacacagctagtaaatggcagaattgttgtgttagttcaggtcctccaagaagcagatgccaagacaagaatatatgtgcaagagatttatggtattgatctatgttgaaaatttggtgaggaagttgcaggagcctaactgagagagactcaggccataacgctggtctgaccctatggaggaaagagggaaggaaggaagattgggtaggaaatttcttagtctctggtgcagttctagaaaattttggcaaggctcatgggaagtccttgagctaaagtagcccatatgaggagccccacatcttgcagaaatgggcctgcctgagtatctctccctgctcagcattgcctggggcagcccatggaaagggtggcccagaaattgatgtggtggtggatcccaagcagctgaccatctgtcattcacactcctgcaccaggaagttgagaggccatgttactggtcccacagctgagatctcaacccataaaccttgtggcagagaaaacatgctcaaccccaatgccaaggcaatcctggcattcaacataaaatcagagaatgcaaatctttatatgccgcaattcataaattctttgcatttttttagtctgcttctgcttatatcagagatagaacatccaaggccaacaatacacttcttgtccttgagaacaggtggaagtcacctaggaaaatggaacataaggaggatgggatcctcttgtggcatctgttgtgaccctaggagagacattgtggatggcgaggggatacaaattctggcttacctccgtggtctgaggatagggggatcctttcagagtccctcctatccctcaggctaaccaagcatctccccctaccctcaactattacctggtcccaggtaagaaaggaaggaggctttccagcatagccttacttttggctgggcttggcaaagaaggtgtttggagtaattatggcccctcggtcacccatgaactcagaccaaccatcactggcctcccttccagatgatctctatttgagcagtttggtaatattttggaaagtacatttcactcatttaatgggaaaataatttaaatatgatttagatatgtattgaaagaatttactagatattttaaccatgtgacttgttgttgttgctatttgtattaggggaaagatgccagggaaattaggtaactagtctaaagtcttgcaaaagtaggcaggatttgaacttaagtctgtctgacctgaaggccacattccttctcctccatggccccctgccccagatattttactgggctcgggctttacaaaatgcttgtacatgtgctatttcatttgaactgtaatattagctactattttccagtccagtattatgggacttaaagacgtcagtgccagaaggtctattggttcttttcccctcctgggactcctcctctgcctcagttgccctcattggggtatcagcccccactacagccattacaaccggcttggcacgtccacaggggctgctgcccactgaagtgggtacaatttctttatccacccattcttctccattcctttctcttttttttttttttgcccctttttttaaccctatcttcattcttgagttcattcctgccctattactcctccaaagcacacatgctatccactcttcttcactttgagactatgtgagtcgtggccgaatagttcgggaatttattttgcacaatttgcacaggccagctcctctcacatctgcttcaatgatctctgtctttatcttcccagttctggtgtctttccttcagctctggatttcttgctttggttggagccactacctcgacatgctcctgggtaatgcttttttcgtacgtgttttaacttttattcacatgagtgaaattgatttttaaattaccactgtccctagcaggaaaaagccagtggcagagccagaaagagaatctactcctccttggcccaccctacattctttgactatcacaaatgccctgtggagaaagagaaacctgcccaccctgtgtgttccaatttactgaaataacatataaggcatgatttggttattttggaattcctcaatttctgatgttatcataccacagaattttgggactatttatcagttgagtgttaacatatcagatccaactttgtaattcttctttttagcagttgattatatttttgaagcccacaagcaccaatttcagggaaaatataagcctaaaatcattcactagaaaactacagaaccgaataggagagtaaatattatttaacttatgcttatgatttgatgtctttatttcttttttattgtgaagcagaattacctttgcctagcattctactgactcaccagtctaaccaatctaccttctgagggtggcagcaagatgggcaaatctggagatgagctctttcaacaaataaacatcatgatagattcctggaaggatttttggtgttttggccgtaactttctagttcaaattgctcattcatgaatcgtcacaaaatgacattcaaaaagaaagtaaatcttgattcaattcattatactatgaagcttttgacttaagaattagaaaaaaaacctttatccaacaaacacccttttttgggggcgtagattacttcctcaattccatcttaccacagaatcaaatattcccaagtatcaagtatccttctcatgtgaaattcttgctataaatgccaaacaagaggaaaaaagaaaaatgtacaaataattaaaacacaaatatatagcatgttagtaggcattgtgtgaatgaaaaaatagttcatgtctctttagatttatgcacagataagagataccattcaatacatgtgctgatcaaagcctaaatatgaacattcaataaagtaaaagtgctaacaaaaatttgagtttggcattaggtcaccaataatgttaattgattgtacttatacataataaaagctaacattttaaatctatcctgatagacaggaataggaatccacgctccagcttgggatcaagaaaactaaaattagtaacactaactggactccttaccactaaggagctctaaccagaaacgtttgttaaaataaaaagatagggagtgtatactagtatgcctttggacttagctaagaaaaatgtaaaatataaaattgtattagtccattctcattctgctaataaggacatacctaagactgggtaatttataaaggaaagaggtttaatggactcacagatctacatggctggggaggcctcacaatcatggcagaacacaaaggaagggcaaaggcatgtcttacatggcagcaggcaagagagcatgtgcagaggaactgccctttataaaaccagccaatcttgtgagacttattcactatcacaggaacagcacaggaaaaacccacccccatgatttaattagctcccacagggtccctcccacaacacatggggattatgggagctacaattcaagatgagatttgggtggggacacagccaaactatatcattctgcccctggctcctcccaaatctcatgtcctcacatttcaaagccaaccatgcctttccaacggacctccaaagtcttagctcattccagcattaactcaaaagtccaaaatctcatccgagacaaggcaagtcccttctgcctatgagcctgtaaaatcaaaagcaagttagttccttcctagattcaaggagggtataggcattgggtaaatacacccattccaaatgggagaaattggccaaaacaaaggggctacaggctccatgcaagtccaaaattcaacagggcagtcattaaaccttaaagttccaaaatgatctcctttgactccatgactcacatccaggtcacaatgatgccaaaggttggctcacacagccttgggcagctctgcctctgtggctttgcagggtatagacccccatctcagctgctttcatgggctggcgttgaacgtctacagcatttccaggctcacggtgcaagctctcagtggatctaccattctggggtctggaggacggtgacgctcttctcacagctccactatgcagtgccccagtgggaactctgtgtggggggttccaaccccacatttcccttctgcactgacctaggagaggttctccatgaggggcctgtgcctgcagcaaacttcttcctggacatccaggcatttccatacattctctgaaatctaggtggaggttcccaaacctcaattcttgacttctgtgttcctgcagactcaaaaccatgtggaagctgccaaagcttggggtttgtgccctctgaagccacggctcaagctgtactttggctccttttagccatggctggagcagcttggacacagagcaccaagtccctaggctgcacacagcaggggggccctgggcccagcccatgaaaccatttttccctcctaggcctctgggccagtgatgggaagggctgccatgaaggtttctgatatgtcctggagacattttccctgttgtcttggtgtttaacattcagctttgtttgtttgtttatgcaaattcctgcagtaggcttgaatttctccccataaaatgggtttttcttttttattgcatcatcaggctgcaaattttccaaacttctatgctctgcttcatcttgaatgctttgctgcttagaaattcgttctgccagataccctaaattatctcactcaagttcaaagttccgcagatctctagggcaggggcaaaatgctgccagtctctttgcatatcaagagtgacctttcctccagttcccaacaagttccttatctccatctgagaccacctcagcctagactttgttgtccatatcactatcagcattttggtcaaagccatttcacaagtctctaggaagttccaaactttcctacatcgtcctgtcttcttctgagccttccaaactgttccaacctctgcctgttacccagttccaaagttgctttcacatttttaggtatctttatatcagtacaccatttcccggtaccaatttactgtatttgtttgttctcatgctgctaataagtacatacccaagactgggtaatttataaaggaaagaggtttaatggacttacacttccacatggctgggaaggcctcacaatcacagtggaagggaaaggaggagcaaagtcatgtctttccgggcaggcaagagattgtgtacaggggaactgccctttataaaatcaacagatcgtgtgagacttattcactatcatgagaacagcccaggaaaaacccagccccatgattcaattacctcccaccaggtccctcccacaacacatggggattatgggagctacaattcaagatgagatttgggtggagatagagccaaaccatatcaaaaatgcttccagtgaatagacctggggaaaataaaacaaagtaatttttaaaaatgcttaacatgaccaggcacaatggctcataccgtaatcacagcactttgggaggccaaggtagtaggataccttgagcccatgagttcaaggccagcctgggcaacatagtgagactctgtctctacaaaaataataaaaataaaataaataattatggttttaaaaatgcttaacataaccctttctacttcagcaggagggatagatttacattttgggatgttttcagcatcagattactctgggtgaccctaccttcagaagcagataaaagtggtaacaacacaattaaggagtattcttcagtgaataaaatatttgagagtacagaggtaaagaataaaagttctgtggtcccatctagggctaaatgtcaacaccataaaaatcatactgaatcactctgatcctatcactgcagaactgaaaattattccatttattttatacacattgggacccaaataagttccaacttatataaaagaatgaaaagtaaatcctgacaacctaccggaagagaacactctgccccgtgctttccattctccttcgaatgcgtgagtgtctctccctgtctctctgtcctgctctctcacgtcactttcttttctccatctttatttcactcttctttggtgtctcctttgcttactgacatgtattgggcttttttcttatgcattgtcctcctcttattgcttattattattagtgctgctgtgcgaaaagttttgtttctttttttatcatttcaaaagcagaggagaaaaacgtttaaatgtatattgctcagccaaaataatgtttatttgcatgggaacttcgatttgtgtgtgtttgtgtggtataccagagagaatggggacagcaatttttcctattgtagaacgagaaaaggaccaacccctcttcaataacaccagataatgggtaaagtggctgaagttagttattatgtgctttaccaaaccttggaatcaaattgtaatacaaatattattgttattccttcctttccctccacatttttttttaaatagcagttagggggagtgatattcccctactttgctctgtttggtcaatctctggctcatcataaggtagagacgatgttttctaggaagcctgaacgtagggtgcttattattggtgtgatgtttagtttgttaattcccaccagcctgagaccaccaggagcacaccacagaaaggtgggtctgtgggcttgcaagaacaggaacattagaggggggtgtgcactgtggggaactacggggcatccttgtaagggaatgtggagaggaggatattataggattggggctggtgtcgggtgatttcagggagtgaagatttgttgtggattgggtggtgctcaggaatggatgcaaattgatagcaggagggcccacgtggggctgtttgtcattgggaaaaaagtggtagccagtcaggttagccagatgagggagtttttcggttatttttgtggccacacatggttttggtgttcagacacaacgaaggcttttttgtgttgtttggccatgatcatggagtgaacctgtttgattattgctgatagtctatggaattgtattatgttcaggagtctagctgttacctcagtctggctggtacctgcaaactgccagctgccagagcctttttgtttttccttctttctcaggtctcagagtaaatgttaaccaatcggtcagtccatccatgtgtaatagctgctatgcccagcactgagctaaacattatgaacaccatatggggactttctcattaataaaacacccacatttaaaaagtaatggaaaagaacataaaagaactagagaatacttaactaatatttgaaaccgaagtaaatattctatcactcatccattttgtgccctagaaggttctaaatgaaaagttttggtaaaacccttcatttatttcatagctaagagaaagggtactgtttgaaaattaatttttataaataattgaattgttcctcctcctagataagctcaagacactttgttaaatgaacacctgacaaaggctttcattttttctaattacaaattagagatactagctgggttgtgtctggttttttttcattgtttttgtttgtttgtttatctttgttgttgttgttttttacctcttgcagcagttgaaatgcatgtggtctttggttctgtatatttaagctctagtttattacttctaatctttaaaagatattaaatcatttaaattggcagacaccagtgtttgctggctgctcgaatattaccatttaataccctacattggagaattaaagcatggtgccctgctataggcaaagtttagaagagtcctgcctgtcatcttgatggtttccaacactgagttttctaattactatattttggtagggcgaaactgagtatgctgatggtttttgcagctatggtagtaacatttttccagccatctttaggtatgtttttcagtggaaagtttagcattggaagtttagggtttttttttttttctttttcttttagtggagtgatgtataggtattctattttattactcattggaaaattatctatttgtacagtgcctaaaacagctgaacacctagtaattgttcagtaaatgatgatgatgatgatagtgatgatgatgatgattttctcttcaaattaaggacaatgtcaaattaattcttgttctctagcttctaatacagtatttgactcagcctccctaccagccacttgactttgctaattacttatgttgtaatcatttgatagtaatttgaattattctttttttttgagatgtctttgtattccttgaaagaaagttattgtttgttatatatcaaaaatttttagcaatctttagggtcttttttctctgaaaactcaagtttatttttgtctttttatcaaatacttttatagatttaggaaataacttattctagtttaataaattatacttggcccgttattgttactccctaatctttctttgtttctgatggggagaaaggatccttttagattctttttaagtcactctgatttcattctggaaagaataaggcaacatacatcaaatccttttgagaatattcaacatgagatagttttcttttaagtctgacagtggcaggccataatactactgaataaattcttaccaaactgaagcttctgggctcagtttcaatgttttatttagtattgttctcaccagctttcttctgacagggctcaatgaagatgttagttaatattcttgcacattgcatttggatgggtttgctctttttggtactgactctgttacggttttcacaatgacacacacttctgttggtttattactaaccatagttgttattgaagagaacctctctttcggcctcagtgatgtagtaaacggtaattttgcaatccttacaaattcacccttatacaatgtatggtacatttctgaacatggtaatttttaagtgctttcaacttgcaaagtagcaaattgatacacaggggatttccgacagcttcttctccagactgaatgtcactcatgggattgtgattccatgtgaaataaggcaacattggccggaggagctgccatctggactttgacgacgaaggcatcatttacacagggctggcattcagagccagggtcacaaagcagctctttccaggagcaaaatgaagttgtcaagcaagtatttgctctgactctgccaggcaccattcagatatgacaaacttgccttcctctttttattacagcttactaattctggagaaagatggaaatttttttttttaatgcgtgctcttccaaaggtcaaaacaattttaaacaagggcaggcacagtcctgcaataaaaattcagcaatctagttgtgcaataagtccgtgtaggggctgagggaagtgtcatgtttacctctctggaaagggcactgtaatcaaaagactgatggcaagaggagctttgaatttgttgttctatttctcccacatctgcatgaaattgtgtctttgaaactatatattatggagatgagtgatactggagagaaacacatgctctgaagtaaacagaaaaatacagcagcataataaaatgctttgcccacttttacagcctctgtggtggccatgaaataggagatgccaactgatggggatgtgagtggagctgtttgaggggtggatttttccccattactacacatagatgcttgcatctttccctaactgtgtatttccttaggtgggtaatgacagtcagtggaaaagccagtgcctgctgttcaaacacagtgtggaaaaaatgaaattgaaaacagtggtgatgagatccagttctccaatattcctctcctagacagactaaaacctttcttctcccgcagcgttagcgctcactctggtcctctcagctgcaaagcagatggatttctttgagaagtggtcagaatttccttgattcaggagctggacctcacgccctcctctagggctccatcatcaccacacaggcacacggccacacctgagtcccatacacagagaagggtggtcatggacaaaagaaacagtggacaaagttttgtgtatgacaattcctggtggctccaatagcaggatggatggatttgggctattaacagaggtccaaaatcccaaaaagtgaccacatgtagatgagacagtcatgacttttatgtgcatttgaattgggcttgagatacctaagtggggatgcctaatcgacagttggatatgtgagtctgagtctcagaggaaagagctgatttaaacgtacaaatgagtgagtcctgtgtctactgaaggcctgaatatggatgagacagcacagaaagcagaagaagagggagcatagaaagacgggacttggaaagtgccaactttttcattgtttgagttaaaaaaaaaaaaagttaagactaacagaaatagcaaccagagaagtaggagaaatcaggaccagctctcgggacataggttaagtgtaaagactgttccaagacaaaggaatgacagggacaatattgagcatcaaatgctgctgagaggtctggtaaaataaaaaatgcaaagatctattggatataatgaaatggaaggaggagtagaccttaacaaagaccattttcatgtgatgattggagttgggtgtgtgtgtgtgtgtgtgtgtgtgtgtgtgtgtgtgtgtttccaagtaagataatcagtcttagatgccagtgggaggaatcctaagagaaataaagaataaataataatgtacatctcctgagaagatggagaaagggtagaaccctaccataagaccaggaagtggccagaggtaggaggaaaaactgctgtaagagacaggagaagatggtattcctacagacagaatggtgaggcatttctctctgatatcctgtatttttccatgaatttaaaaatgagatcagttgttgaagaatgaaaaggaagttcctgagagcatagacacaaatagatacatgtgttttgttgaaaggccaaagagtgaaaccattggaattgagtatatgtagcaccaccaaatgcagaaatctattaaattgttaagaatatggaactggagttcacaggagggagagagagagtgggactagacttatgtggcattagcattaccaaaggtgtgtattgtagtcatgggactgaattcatgaagtcatttaatatatactgaattattatgaatcctagtagctgcagagaatatatactgagttattgttatgaacctttgtagctgcaaagataaagtgagatggcttccacccgctgagtagtcgtcggtctagaaagaagctgacatttacacaggaaataggcagtgtgaccgaggctccaataagcaggacaaggttttataaatgtttgtaagaaaatgcacctctctttgctagaagaatagaatagttagaataggaaaacaatgtttgtatctatacataaagaaaaagcaggccagcaccgtggctcacgcctgtaatcccagcactttgggaggccgaggctggcagatcacctgaggtcatgagtttgagaccagcctggccaacaacggtgaaaccccgtctctattaaaaatacaaaaattagccaggcctggtgatgggtgcctgtagtctcagctactcagaaggctgaggtaggagcatcgcttgaacctgggaagcggaggttgcagtgagccaagattaagccactgcactccagcctgggcgacagaatgagacttcatccacccctcatccctaccaagaaaagaaaaaacagtggcaaacttgatgaagaaatgagaagaatatttctgttaccgagaagaggtgtgaataatgttgttacaatatatgcaatgtaaagaaaatagacatgtggcaatataatccaattaggtcacttctgaaaacataatcagaaaaaaaaatcatagaatcatgaaataataaagccagaaacagagatcatcaaagtccatgccccatgttagacagcaggaaagagcctgaggaagaaatggaacgttatgatcataatggaggtggaatagagtccagatctcctggctccaatttcagtgatcacctcactcactgatctctatttcacagccactcttgcactggctggaatatgcaggatctgtaatatccttgggaaggaacagaattctctggggtccactgtcaaatagtggacatctgaatcagctgcttcaggtgaggtggtgctcagccccctgcctctgtccacagatagagaacagagttactttgtgagcctctaggctgtcaacattacccttgcagatctgtaggatttatgctatgctggagacataactgccgacctagtgggaccagagtggaggtaggaaggcttccgagtctctctttgtaaagcctgtgactacgagccaggctttaacagaatccctgctttactccctttttgtgggttatgccatgtacctctatagtctcccaagaatctgtcaagatatcagcttttattactcattaccctaaacctaaagaagacagacaggacagaacccaggaaatccaataagtggatttcccagaaatgaaagtgcatagaacctagaaatccttatatgtgaattttcttgtgaataaaaagtataatagaaaaacaatttggtttgacaaatatatacagaaatcttttgtttgtgtgtatgtgtgtttatttaagattcgcctgcttttgtaaatgtaatcagctacatacaatttttaaatttctcacttccgtaaaattgtctttccttgggtcatgattctgaacactgatataactgtacagcatgatagatagggtaggtgtagaaaattgtactgaattgtcattgagtgttggctataccagggtctcccagaatatagaaagccttgtgctagttagaaaatgggctcctcttctctgcaggccaattagtttcagccagcctcatgagctgactgcatactgaagtcagccccaaatcctgccctcccaaatcaacctgcactaccatatcttaagagtagactgtcaaaacaagtccctggtttactcttttttttgagacagtgtaagacacaagtagattattgagcttcctgaaaagatagattcagagtaattaaaatttgattttaatgctgctaagaaaagaatagagatgtgatataaagttatgacacaaggaatacaaataagattatcacttatggatgatggctgtttgaaagataagcccaattatgaacaccaatacagattctgcaaatgtatgttcagagatggttatataagtggcataattgctgtaccttttacatagaaaaattgcagctattctttaatcaactgacactgggagaaactgattaggtgtgataaagttgcctcaggtgaaatccaatttcaactgatagactgaggcataaagaaaggaaaaaatacaccgaaacaccagaattcaaaatgtgcgcatgatttttaaaatttattttctcttttttctttttttaaaaatgtgtttagatatgaaaaaagaaatagaataatgacttgaattcgtgcatctgaaaaatgtttattaaccacctaactatggacaggtgctatttatcagaaaccaaaacaacagctcaactctactggatcataaactctagtgggaggggacaaaataaacaataaacaaaacagtatctaatattagaggtggataaatgcaaatagataaataaagtaggataagggttatggagtgaagcaaagatgctctttggaggttattaagtgaaagccagcctaacaaaatggcatttgaagaacatctaaggaaggaggatgaaaggtccttgaggatattaaggaaagagaatttcaggtggcaaaaatagtccctgccaagccctaaagtgggaatgtgcttgggtgtttaaggagcagcaagatggcagaccggctggaacagcgtgagcaaaagccttgaacaatgaaagaggtcagtgataaataaggaattcattcttcacagaaaatggggcgatgcatccaggcaggttataaagattaagagttgaaatcagagaggcaggtggttttgatgttttgagatttgcttcctaataggcatcttaatcaaattattcatccagagttgcaaagcagcaataaccaaaaacatatctgaatattgagtaatttgtcacattcattacaatcaaactgatatcatttgcctcgccagaaaaaaaaaaaaatgactaattgacataatgtgaagagctttgaagaattgcatttaataccagcaggttaatcaaaaggctaacgaaacaagttttagttaaatacatacaaggaaaaatgtattctgtgtctttcctgctgttgtcaggaaaaaaagaataagggcaaattttagtgatttcactgtttatatgtgtcccttttacccacttgaaaaatctgccacttattattgttattgaattttccgtcatcttactgctcttctgtgagattggaggactttgaatttgtgccacttttattaactgcttgtgccatcgagaaaggctttagcatcttagtttcctgggaggaagaccgggtaatggatgaataatgtgtgactctgccagtttgatgtgttataaacaaaaaaaggatttgtgcccccactaaatagcaggcttgatatgagacctcaggttttgagctgcataagcagcgtcttgctctgctgttgaagaatggatgcatttttcagatagtaagtaacacatgactgtctggagagtaacaagtattgggttggtgcaaaagtaattgcagtttttgatgttactttcaatggtaaaaaccgcagttacttttgcactgacctaatagggttaaaggtcaaggctaagtattttaatgtcatcaattttattttctttcttaatgtgttaaatagtagaaaagaagaggccaggtcagaaagtctcaatattaaggcttatttgtctcccttgtccttttctggactctcctggtcgtgtcttcatcaaattgggttaagaaaccaaactcagcttgagatattctccaaggcaatgtttatgtggagttggttcaggccccagcacgttgggaagaagtagtaaatatcataatagtgattgtagttattgatcagtattggtccaatcatcagagctttgatctttccttctttgtcaatttcttttacttttgactacagattcattcagaactccaccccccgccaccccgccccatcttgcagaagccacactttctccttcatcaccctttggctggtctgtctctctctccttatgttcagaaggcttttctgttttgatcattcatgtttgctttcttatatcaccttaacctcttaaagcttgatcacctgaaacatgagtctgccgctcagatgattctaatcctcaaatctgatgatgtcggccaacctttacccttggaacactggaacatttacctttctgaaacactcaccgctcgtttacctgctagaagctggagtacagaatcagtgtccaggtggaactcccagtctgtagggaagatgagcacataaagtaactgcaacacaatacatgaatcagaggaagaaatgcaataactaagttctgcatgaactgtggcttaacacaaatagggaacaaatactagtggctgtgggaaatgagaatgaaagcagatttcagagaagtaacattcttcaaatcacgttgcctagacccttcccattttgtagctgctttcctaaattctttcttcctctcctgttgctgcagcaccctaagaggtggggccttagctagccatgtgccccattccacagactgtcccatgctcaggcatcagttgtcactgtggatgactcacagaattaaagatgcggttctggctgggcgcagtggctcacgcctgtaatcctagcactttgggaggccaagacgggtggattgcttgaggctaggcattcaaaagcagcctggccaacatggtgaaaccctgtctctaataaaaatacaaaaaaattatccaggtgtggtggcaggcacctgtaatcccagctacttgggaggctgaggcaggagaatcgcttgaacccaggaggcagaggttgcagtgagccaagatcatgccactgcactgaagcctgggcaacaagagggaaactccatctcaaaaaaaaaaaaaaaaaaaaaaaaaaaagatttggttgtaatctctctctctcttgaagtcgtaagtcccatctcttgtacatcctcatttccaagttgctatgtcagagggcttctcaaccagggtgctactggcatttgaggtgtgacatttattgtgcagaactatctaacacattgtaagacattcagctttcatgggacctgaggcactacatatcagtggcaccttacacatgtttccgaatcatacctgaggaggtagtgccagccccagttgagacccactggcacatcaaattcaccctctataaaattaaactgaaaaagtgttcatttcccccaaaattaacactctcctactgacatttctttcaaaatgttcagatttgcgtaatcgtgaaaccaagcatttaccactagctgatccatcaggtcaacacatcctactaatgtccttttatagtatgttttccctctgtctgttaggcagaatgtcacatccatgatactccaagtctttatcacctaatttgtagaatagttcctctatttactgttgcctttcctttatgtcacattgtataataaaatatcaccttgaccatgcctctcccttgctttaaaacctacagtaacagacttcgactatacaattaaggccaaatagatacaacaaaagtgctcccccataaacatttttaaaatgcataaggccaggcgtggtggctcacgcctgtaatcccagcactttgggaggctgaggtgggtggatcacctgtggtcaggagttcgagaccagcttggccaacatggtgaaaccccatctctactaaaatacaaaaattagccagatgtggtggcaggcacctgttatcccagctactcaggaggctgatgcaggagaattgcttggacccaggaggtggagattgcagtgagctgagatcatgctattgcactccagcctgagggacaagagcaagacttcgtctcaaaaaaattaaaaataaaaataatttttaaaatccttttaaatgtatgattgagcatgcaagaaattgaggaagatccttgaggcctaaaatgaagaaaaatcatgaaccaaggttataaatgaatgccaaagccagaagctgacctaaaggcttctgtcagttccatgcaaccagcagcttttctttcagtggctatatgaggaagaagggtccatgccaagtaataaattatatcaaatatccctgtatggaaaacaaaatccagggggttagactctcaatgaaaaacaaaactgaaaatggaaaaatccactctacaaaagaagataatgtaaaaattttgattatctgaactttagctcagagtacaaagaagaaattatcccttgaagctatgtaatagaaagccagttctgatgcatgtttacagcctaacttcacagcatttgaatggttggagaaaactcaagctgaaaatatattttaaagaggtcccagattggtaatgtctccatgtatctgagaaaagcaaatgcagatgatctgagagagacataccttctactgaacctcacaggattctcacagacatatttccaagaaacatgatctcaaaagaaaaaataatcaccaaatgtatggggaaacaagatactgtaattgtgaatcaatagagataactaatagcattttcagtcctacagaatcttcaggtattgaaattattggattgaaaaaaattttaaagagaaaagtggatatactattaaaaataatgggtaacatttgaaaaagaaccaaataaacattacaggaataaaaacataatagataaaattaaaagcttaatgttagagataaatagcagtttctacccagctaaagtaggaacaatgaaattaaaaatagattctgaagaaatttcccagaaatctgcccagtgagagttgtcaaatatgaaaaataaaatattaaaagcaaggagattagatcacaaccaatcaatacatctctaattggagttgtgaaagaagagataagagtggtgaggccttattttggtgaatgatggctaaaaattgaccagaaccaaaaaaacatgcaaattaagattcagattaaggcatcatagtggatgtaagccagaatgaaagcaatccccagctagacagaaattacagattatttacaaaagaattgaaattaaactgaccattgacttcttgacaatggaaccctgaagaaacaaactattgtgagaaaataaccattgaccttgaatatgccacccagaaaaaaacacatatataaagtctaaataaagactttttaggacaaaataatgataacatactaccctctgaccctagagaaaaaaagatctcataagaatagtctgagatagaaaaaagagggaacaaagaaaatagtaaaatgtcagtaaatctatgcaaacattgacaatattgagcaataaactttaatttgtgatatttaaggaaaacaagatgaagctaaaaaatagatgaaataccttatatgtaaggaacagaaacaagctataaaattgctgtattgtttaggaagagaataaatatactatgttgagacactgttaagttaaatatgaaatttaaactttctagggtatctactaaaagaatgatatttaagagaatgcaaaattctaaaccagtagaaaatatatggaatgaagaaaaactatcaattcagaaggaagaaaaaatacttaaacattagtaacaataaaaagcaaacaagagagaaaaaaaggtacaaatatttggaaataagtccaagtcagttatcacaataaatagactagactctccagttaaaagataattttagacaattaaaaagaaaaactatgtgctgtacacaagagatattaaaaacattaaggacaccacaaagtctgaaagaaagatgatagaaaacaaggccaggagattacaaattccaaaaagctattgtgagcctattgatacgaatgcaaatgaaagagaaaaaaaaattacaattcagagcattacaatagcataaaaatttccaaattactgaaaatacctaatgctaaacttgggaagattgaaagatatagtattatagaagaagcttttaatattgatgtctcagtaattataggtcagaagcctttaaaaatcattaagtgtacagagcagcagtatccaaaagaactttctgaggtgatcaaaatattttctgtacaatatggtagccattagcacatatagctagtgagactgaaaaactaaattttaaatagctgcgtgtggctattggttacctactgggcaacccagataggattaaatagcataattaataactgtgagtcaatgcacacatagtactattagaaaataaatattttttcaagcacatgtaaaatgtttttgaatattgaccacagactcgattctttaaaataaatctcaacaaatttcaggttattggtatcataaatcctgttttctatgaccaattaaattttaaaaatcagctaaaaagacacttttacaaaaaaagcttaaagcaaaacatataattagacattttaaaaatacttctaaataatccctgcactgtgggagactgaggcgggcaaatcacgaggtcaggaattcaagaccagcctgaccaatgtggtgaaaccccgtctctactaaaaataataataatcaaaattagtgcatattatcaaataatgatgacagcataattcaaaacttgagggatattcctaaagtggtattttgatagaatttatagtcttatgtgtatagtaaaagcttagaaaggctgaaaattattgatccaagcatccatcttaagatattagacaaagaagggaattcttgtacacttttggtggggatgtaaattaggacgaccattatgagaaacagcatagaagttcctcaaaaaataaaaatagaactcccatatgatccagccatctctctacctgctatgtattttttaaaactgaaatcagtatgtcaaagaggtatctgcattcccatgttcattgcagcattattgatagtagcccagatgtggaatcaacccaagcgtccatgaatggatgaatggataaagagaaagcaggatttaaacacagtgatttctggaacacagaagaacatagaatacattatgttgagtgaaatgagctaggcacagaaagacaaataccacatcatctcacttatatatggaatttttaaaagttgcactcatagaattagagagttgaatggtggttaccagaggctagggaatgggaggttgcagagttgttgatcaaaggatataaaattttagttagataggaggaataagttcaagagatctattgtacaacatgatcattatagttaatacagtgcattgcattttgaatattgctgagagtacacaaaaaatgataagtacgtgaggtaatgcgtatgttcattagctccactgagccatttcacagtgcatacatatttcaaaacatcatgttgtatgtgttaaatgtatttaatttttatagatcaattaaaaactattttttttaaaaagaatagactaaaggattataggatatatccaaaggaagtagaacaaatgaaatgcatgtaaaagcaggaataaatgaacaagaaaatcaaccatacagtaggtaaaaatcaacaaatagatttttttttttttttgagacggagtctcactctgtcgcccaggctggagcgcagtggtgagatcttggctcactgcaacctctgcctcccgggttcaagcgattctccttccgcggcctcccgagtagctgggattgcaggcgtgcaccatcatgcccggctaatttttgtatttttagtagagacggggtttcaccatattggacaggctggtcttgaactcctgacctcctgatttgcccgcctcagcctcccaaagtgctgggattacaggcatgagccaccacgcccagccaacaaattgattttttgaagagactaacaaaatcaataaacttctggctagactggtcagaaaatagcaggaaaatatattagtagaaatgaagaaaagggatataaacacaactatttcccaatatatttaaatatttaaatgcaaagagcaaattcatttaaaaaaaacaacatctacctggaatataacataaattagaatataaacttatagaaatggatataagaataatcttataatgaaagatactaaattatatgagcctcagatagtttaccaaataattccaacatagccccccctaccattctttgagtccagtattaacttgataccaaaaacataatgatagtacaacaaagggaagttataggccaaagtcattcatgaatacagtggcaaaaatcctaaacaaaatagcaaagcaaacccaaccatatgtatgaagaatgatttatcacaacaaagtcgatttttttaaaagtactattattagaaaaaatctctgaacgctaaaaggagaaaaaacttttatcattttaataagagcagacaaaggattgaataaaatttagtattgattcatgcaaaaaaaaatcctaacaaatgagaaatgacaaatagcttccttaaacataaagatgaactattcttaacaggtgatagcagcatctcaactcaatggttacacataaaagcgttttctttaaaatcaggaagcacgtaaagaccgtcatcacaacttagtttaacattgaactaaatggatcatatccactgcattaggacaggaaagaagacatatttttataatagatagaggttggaaaggaacaactgttgttaaaagaataagagaaacaaaaagaatcaaagaaacaaatagcatatgtttccattccatcactttggtattaatcacacttgtttctggagaccatggtgtaaaggaatgagccaggattactgaagggtcctgcagtgccagtgaccacaagacaagccagaaccaagttaacttagagtgaattggcctattctttaatactgctcagaattacaaactcccatataatctgtcacttaaattccattcaaattaataaaatctaattcatttgaataagacttaaagtgatttgattctactgcatcaaattctgctcagtggaatcagtccttgattgaaatctattaagttcaattcagtaaaataaatttaaatattatgcaatacaattaatttttaattaattaccatttcagttcaggtccattttgatctgaacttcaattctacatttctaaatttggtccctattcaaatcaataaaatgcagcaaaatccagtgtaattctaaaagatacaacctgaagctaatcaactgcatttatttctattcacccctaatcagatgagtttagtgacattcaatcacagaaagataaaatgctcacctttaactaccaaattgaatgtttacattagaacttcagaattaccaggttttcccaaactcacatcaccatctgcagtagggactccacaggattttatcttgactcattctttgtttggcttatatattaacatagaacaatgtagaattggatggttaggaaacaaaagagaatattgctatcctgtttaataagctgaaatcataggtaagttgagataatagacttttgcatctatgagaatgccaatacatgattttttattttatttttaaagttcttaatttaaatagtaaaagacaggaatttttgactccagaccatggttataaaactgagaaaaaaagtattaaaaggactgtattattcagaaaaaaataattgggaattaaattgagatgttactatagtaacaccattatcacctctttgtatcttaccaagcaaacaaggtcctggattggtatcccaatggcacccagtcatctgggcctctttgtttctttatagatgttcccaagtgtccagtgaactccacctaccactgtccttttcccaggtcagtatatggcagactggtctgatggtaaggatcacagggacactgagtctcaaactcttcctctgagattcttattctacaggacaggggatctatattgtttacaagatcttagtggaatcatagggaaattgaaaacccttccctatacttacctcccacccgtgggtgaaaaacaaaaaaatcagaagttattactccacggcttcacctcccccacttcatcctcctgtaaggatcctgagacttcagctaccatggcccagatcttggaagtgattctgtgcggattttccacatgtaaaagaagaggaagctgtctgtatttaagccagagaactttaggactagtagcctgtttccatttccagtccctgggggaggggttcccatcaggtttagctttaagcccctatattcctggaagcgtacacatccatactggggaaaacaagaaaattctggccggcttgatcttccaaattacagctatcagatgatttggaggactctatagaggctacagcacctccaaattccttctctgctccatcccatcctggagattattataaaagcttttacctttcttgttatctaggacatttgcactggaaggaaagtttctcacaggtgcaagaatgttttgaatggtctagaattgcaccaattaaggatgcctatacttagtaagtgtatcatcaccattcataacttaatatggattttgtaatcagatcagagtgctcagctgaaatttacttataaagtggagaaaaaagatttggtagtggtaagaaaggaagagagaaggaagtaggagatttttctgagcatgagtcgcttagaaaaaatcctgcactgcaagggccttcaaataaccaaatgttaccagagagcagagcctgggaaggactgccaatgagctgccggcaggggacactgggaacaatagtgaaaagcgtgtttgtgctgcaagggtacctgttctatttcctcagctgaagagcccccagggactctttaacagaatttgtagataaggttgtaattgtacatatgataaaactagttctcatcaagccaaaaagatgcttttacgttttcattttggagattatatacccttgtggtgttgtttttaatatcctatagaaacagtgggaatgaaagaaattaaatgtcccagagactgtgctgggtcttatctcagagggcgccaggatcatatttatttaagcagcctgttaagttactctgtgtagcccagaagttccgaagaacacattttgaaaatcacaggtatgcacctcattttcatcaagcagtccccaagcattcgcccttgtgcttctgaaacaacttcttgttattggtgaaaataaataacagaaatctattggtttctttttctttctttctttctttctttctttctttttttttttttttttttttttgagacagagtcttactctgtcgcccaggctggagtgcagtggcacaatctcagctcactgcaaactccacctcctgggttcaagtgattcccctgcctcatcagcctcctgagtagctgggattacaggtgcacaccaccacagctggctaatttttgtatttttagtagaaacggggtttcatcatgttggccaggctgattttgaacccctgacctcaggtgatcctcccacctcggcctcctaaagtgttgggactacaggcgtgagccaccgcgcccagcttattggtttttttaagtaagtcttggaaaactcctttcctttctagcctattttctttctccctttcccagtttaatcatccacaccataataaacccttcaccataataaaacttgatctgaagtgagtacaaacagtatagtgattatatttaattcatttcatatttggctgttttaatacaatatgccttactttgataatttagctctagttaacttagaatgccattcatcattacctaaccttgttgcagtgaccatagctacttaatatagttaaatacaatcttcatattctgaggttagagaagttcttgaactcttggaaatagataattcagttatttctttcctcaccactttttgcccttgtcttttaaaaaagctttccatttttattgcctttaactgctattccccaaagccaattaacaggtaaataatgatttgtaaagctaaaagtagcatttcattagcatagcactggaataagggaattctttgctcaaaataaattgaaccgttctcctcttgctgaatataaaatacacaacaaattaataatttattttagttacagtgatttaaccaaattagccaatgctaataacaaagtctacaatttcctttctctctggaatacgtttttcttattggcattcttttgcagtagatgtggaaagagctaagttaagcattttgtgctgtattttaacttattttcctaggaaaaagaacagaacaacatcaattttgcatcagcctcactgggggcattcgttatatgaagactaaagtattgtgacttgagaaagagtgagggatgggagaagaagctgggaaaccaggctgctcttgccaggtcactaacttgccacctccttgcacctgtactccttgcacatggaggaaatatttcagatcatccccttaggtcccatcctgttgtgtaataagagtccctctctactgtaagctgagggtctgccatatgagattagcacacagcctggatcccatgcacagctcagggcttctactggaacacccaccgtaaccgcccaaggagttcaccttgcccgctgcctagacagagtcgattcatcaagacaggggagttgcaatagagagagtaactcacgcagagccagctgtgcaggagaccagagttttattattactcaaatcagtctccccaagcatttggggatcagagtttttaaggacaacttggcgggtcggggggaagccagtgagccaggagtgctgattggtcaggaatgaaaccacagggagtcgaagctgtcttcttgcacagtcagttcctggatgggaggcaccagatcagatgagccagtttattgatctgggtggtgccagctgacccatcaagtgcagggtctgcagaatatctcaagcactgattttaggagaagtttagggagggtcagaatcttgtagcctccagctgcatgactcttaactataatttctaatcttgcggctaatgttagtcctacaaaggcaatctagtcaccaggcaagaaggaggtctgctgtgggaaagggctattatcatccttgttttaaactataaactgtaagtttctcccaaagttagttccgcctacacccaggaatgaataaggacagcaaggaggttagaagcaagatggagtcgattaagttagatctctttcactgtctcagtcataattttgcacaggcggcttcaccactgcccaaacaattcaacaatgaaacttcctttcctgggcttctgagcactctctgaaggtacagtgggaaccagctgtctctcttcttttcccctagagtatgttccttgtagtctcattctgaaggtaaagctgattgttatcttctccttttactgagaatgtcctaatttttacaaagaatactgggccacacacagctctctgattcatgcaaattattactgtctgcaatgaaaatgaaacacagtgttaggttgtttctactgatcactcaaaggaacaatcataaattgggcagagattctgagatatataatctttcattggttatttgaggtatgggcaggacaaaggagtcatctgctagacaaacctttaactccacttttacaggtgcccgatttgtttcttctcctccaccaagagtgttagtgtcctctagtttccaaaaacagtgatactaaccaaaaattcctttgagagaatttagcatgaggtcagctttttgaatgcaatgcaaaaaatgaatatgataatcagttttggtaatgtttctatattttcagggtcaggctgtggcctgcccagcctcaaaggcatttcatgaggtcaaaatggaaccatctacctttgtcctctctctataacatggccagagatggaatcagccaagacctagtgtagcttttgggccaaatgaccttaacatttctttcggtggttgagatgctgtggtttccataaatgggatatttcaacgcttatttttgaaactctagacttcataaggagaaaaatttattattggccatgggaagcatcagagaagctggatgctttaccacttaccctgatggaaaaagaaaggagaagcaaatgacttaaacatagaaagcaaacacagcccccgcatgctgggaccaggcacaggtggacagaagacacagcttcagggtggacctttatgtcagaaagcgggcatgtttctccctttggaacagggtactgagctctccctcttgactgtttaccagattaagtcaaatatactttctttaatgtgggtgccaaaaatggtcatgccaagggaaaataataacttccaaattaagtcaacacacagaaaaatcaagaaatttgtttggagggagagaatacctgaataactaactcattttcaaattcagagggcttgctcattcattacattcatcctggactccagtccctgttcattctcaactttaaatcacccacctgttaacaaaattattcttgaggaaaactactggaatatctgagaaagtaccacagtatttttttgcataattccaatatggtccctactttttgtattgtttgtttagatattgtgactgttcacatggtaactttatgattttcctcacctttatttctgagcactcatagagtcaagtgtacacttaacatcccaagagggtggatgagttattaccatggaattttaacccatatacccagatttttttttctttttttttgagacagagtctcactctatcaggttggagtgcaatggcgtaatcttggcccactgcaacctctgccaccgaggttctagtgattctcctgcctcagcctcccaagtagctgggattacaggcacctgccactgagcctggctaatttttgtagttttagtagagacggggtttcaccatcttggccaggctgatcttgaactcctgaccttgtgatctgcccacctcagcctcccaaagtgctgggattacaggtgtgagccaccacgtccagccccagagattttaattgactggctattttggcttactggctgacattacctctgttagattccactcattccccagcttctggcaaggaacctctgttctcttagcataatgttctcaaggttcatccatgttgtcacatattgcaaaatgtcttttttaggtctgaataatattccattgtatgtatacacaaatattatatgactctgcttatatgagatatctaaagtagtcaaatccagctgaatgtggtcactcaggcctttcatcccagcactttgagaggcagaagcaggtgaatcacttgagcccaaaagttggagaccagcctaggcaacatggcaaaaccctttctctgcaaaaaatacaaaaattagccaagtgtggtggcatgtgcctgtagttccagctactcaggaggctgaggtgggaggatggcttgagtccaggaggtcaaggctgcagtgagttatgattgctccactgcactccagcctgggtgacagagtgagaccctgtcttaaaaaaataaataaaatataaagtagtcaaatcatagaaacaaagaggtcaccaggggctgggaagacggggaagtaggcagttgctaatcagtgggcataaaagcttcagttaaacaataaaagtaagttctagaaatcagccatacaacaccatatcattaatgctacattggacactttaaaagttgtcaagagagtggatttaacattaagtgcattctcatatgctaaagtcatattaagaataagaaagagtcatccagtcagacgggttggctcccacctgtaatcttcgcactttgagaggccaaggcgggtggatcacctgaggtcaggagttcgagaccagcctggccaacatggtaaaaccctatctccactaaaaatacaaaaattagctgggtgtggtggtgcatgcctgtaatcccagctacttgggaggctgaagcaggagaatcctttgaacctgggaggcagcggttacagtgagccgagatcgtgccactgcactactgcactccagcctgcacgacagagccagactccatctcaaaaaaaaaaaaagaaagaaagaaagaaagagtcatccattgtcagggtcttcctgctctctgcttccattctttccactgcctaccacgtctaggcttttcttcccgccattcacctgaaactcctttcatcaaaatctctagtgaccttccagctgtcaaattaaaagaaaactcttagttccccatcttaatagacttcactatgaaatctgatggtgctggcccctctgctctctgggaaatcctcctgtgtttttctcccatcaccctggctgccttcgttcttgcactctgctatggtcatctccatctctggtacggtttggctgtgtccccacccaaatctcatattgaattgtaatctgaattgtaaccccatgtgtcaagggggggacttggtgggaggtgactggatcatgagggctattcccccatgctgttctcatgatagtgaggaagttctcacaagatctggttgtttgataattgcctggcacttcccccttcttgctttctctctctcctgcccccatgagaagacgtgccttgcttacccttcttcgtctgccatgattgtaagttttctgaggcctcctcagccacacaaaattgtgagtcagtcaaacctcttttctttataaatggttaaagacccagtcttggatcattctttatagtagtgtgaaatcattcttgggttttggtgggttttttgtttgttttgttttgttttgtttttgagacagagtctcgctctgtctcccaagctagggtacagtggtgcaatctctgctcactgcaacttgcacctcccacattcaagcaattctcctgcctcagcctcccaagtaactgggactagaggcgcctgccactgtggccagctatgaaatcattccgtttttgaaatgatgttgtaatctaaaagattccagcagcatttctcccacttccaatatgttctggtttgccctgatagttcctaaaacatattttcagctcagaaaatcctcctgagaaccagacttctacaatcaatttgtacattttgtgagcaaacccattatcttttcttcaacattccctagacttttgatgatgatcttccttccctgtgccctaccttcatggagcatagtaccatccccattcatacaaaccagaagcctggattaatccacagcactccctgcccatcttctcttctacctaaatcccaacagtcccagccagctataactcctgaaccttttttgtgtgtgttttctcttctcctccatttctactactattttattacttcttttctctattaacataagagcatcacatctagcctccctgaatccattttgcagaaatctatctttcatcttcctgttgatcttttgaaacacaaatttaatcatgctagttccctgcttaaaatcctttactagtttcccattattttcaggataaagttcaaacgtcttaaattgggggaagataaacattgaaaagaaaggataaaccaatgaaaaataacttcttacttggacaaaggtattttgcaatgtgaccttcatctgctgtccatctatctcttactatctactactgctcctctcagcacatctcttcagcccaattctactacatatgaatatagtcctatacatattttccaaatagaagtttacctttctgtctttttacattctgctccatttgcctaggaggtcttacctctcttatgtccttattgatctgtgtaatgcatacttgaccttcaagatgcagctcaactattttgcctcctctgggagaccttcctttatgacctcatttgcctcccccactctcctctgtgttcataatactgataaaactgttctccaatctgtatctttttcttccattctgttgagttgcttctaatgtttggcacattgtgggaacccagtggatgtttgatgattggatgaatgaatgaatgagtgactattaggccaaatgataaaggagagttgggggctaatctgctgtgtggttaaaagaactacttaactcttctagacctaaatttctttacccataaaattaggaggtcatactcaaaaacagtgaaagtttgtgcttagctccaatattctatgatctccatgacttagttcacaaaaaagcatgaccagtcacgagaattgtatggtgtagaatcagttcatggcccatacaccttcattgcggactgaccgcaacttggcttccagtttactaaatagactcctaaatcacagaagtttgaatgtaaaattgtcttccaaggagagaggtacatattcccatgagaaatcttaagcttaacactcccactgatattttttatcaaatatttctactattgacataaatttacctttatgcttatgtttatatttatatacatgtaaaattgtgatatatacttttgaaaactcgtctaagcttaaaagagccttttgaagtatagaattaaaagcttttttaaaaaaaacaaatttatttctgtaggtttttgggtaacaggtagtatttggttgcatgagtaagttctttagtggtgatttatgagattttggtgcacccatcacccaagaagtatacactgaatccaatttgtcatcttttatccctcacccccttcccaccctttcaccctgagtccccaaagtccttgtatcattcttctgcctttgcatcctcatagcttagctcccacttatgagtgagaatatacaatatttggttttccattcctgagttacttcacttagaataatagtcttcagtcccatccaggttgctgcaaatgccattaattcatttctttttatggctgagtagtattccatcatatatgtttgtgtgtgtgtgtgtgtgtgtgtgtgtgtgtgtgtatgtgtgtgtgtgtgtgtgtgtgtgtgtgtatgagaaacagtttatttatccattcattgactgatgggcatttaggttgcttccacatttttgcaatggtgaattgtgctgctataaacacatgtgtgcaagtatctttttcgtataatgacttcttttcctctgggtagatatccatttgtgggactgctggatcaagtggtagttctacttttagttctttaaggaatctccacgctgttttccatagtggttgtactagttcgcattcccaccagcagtgtagaagtgttcccctttcaccacattcacaccaacatatattattttttgattttttgattatgggcattcttgtgggaataaggtagtattgcattttggttttgatttgcatttccctgatcattagggatgctgagcattttttcatatgtttgttggccttttgtatatcttattttgaggattttctattcatagccttagcccactttttgatgggattgttttttcttgttaattcatttgagtttgttgtagattctggatattagtcctttgtcagatagatagactgtgaagattttctcccactctgtgggttgtctgtttgaaataaattgacttttaagagggttgagtgatgttcagactatcagagtattcctggggaagtgggtgtaagtgtggcagtctaatgactgaacccaggtctgtttctaaatatacctttgccttttcttgtagatggaagcccttacacttggtgggttggcaaagccaacgagaagcactactactggggaggctctgggcctggaatccagaaatgtgcctgcggcatcgaacgcaactgcacagatcccaagtactactgtaactgcgacgcggactacaagcaatggtgagtgcctgcgggcagcacagccaggctcaccctcccagtgtgcctttgtgtcaaactcatgtgatagaagaaagtttgaaaagtgctataataatacgataatagggtagaaaggtctggaactaacccaactgacaaatgtcaggaacatactgaaaaatataaaagcagaaagaggtcagtgcgacaagggtatgcatttagaaactgagacataattgatgtgttcatattttattcagagaggaaaataatgagccatgttgtagacagtgatttgcattataaaatgtgctgtgtaacaatagagggatggctgggggcgggaagccagtgtgcatgagtgcaggcagtcaacagcctcctgcggggagcacaaccacctcctgcaatgtttgcgttggggatctggattggaaaaataggagagagagagagagaagggaaaaaacaaagaaacagaaaaaatcattctttgctcttgtcttctgtaagtgcttgcctgtctacttttctttcatacctggaattgtttataactctgatacaaatcagttcaagaaagatctattttgggtttcttcgatccctttgctggcttttgttctgccccgcagtgaatagctgggtctgtgtcagtaacagataaagataagatcagctgccattctttgtgaaaaaggccccagaagtttaggtggaagactataaacctaagtgtgattctttgcagaagcacatatccagtgccggctttctacatttttagaagtgttgagaggctccatttctgcttctgggcagctgtgcacatagccagtcatggtcatgaatttccccatatgcccagccatggttttcttcagttcacctatgtagtatgctatttacagggacagtttacaagacaaattcattccaccagttaaccaaaaacaaattctgagaacgtaactttatatgaatttcaggtaggatgtctgcttactttctgaaagttatatttcttctagtaaatataacaaattacaaagcctatctatttcaatggcttagaatgtgtgtgtatatgtgtgtaaaatacttgtaaatagctatcattaatctttaattatggattattgtaaagaagagatcatgataatttttaattttatttctttgaaagatgtatctacacacacacacacacacacacacacacactgtatacaaagattggaagttgggaatggagttaaaagggcatggtctttgaaattaaccttttattcattcgttcaatcattcattcagtgaatcatccaatcagtcattcattcaacaaatattgatcaaatacttatgagtcagcaactcttctaggcactggggataaaataccaaatgcaaagaacaagaatccctgtcctgactcacattcttgttcttgatgccttttattactagttgtgtgttcttaagccaggcagaccttctcccatccatttgtctatccaacattaattccctacctcttcaggaagctgacattgggttcagcctccccaactaggagaagtgggaacagagccccagctggttcattgtccaggcagcccagagtgccctgccaccatcaccttgtcccaccacagaggagagaagagggattcagaaagagtaagatctagtacctgcacctaagtgaacttcatttttatcagacatcatgctaagttctagggatacagtgatgaatggaacatggtatttgtcctcaggagctccaaaactagttgaaggaaacacacatgtgcacacacaaatagataacataatacagtcagtgttgtgaggaaggtgtgtgcaagatacaacaaaaactaatgaaagtggcggggcgtagtggctcacgcctataatcccagcactttgggaggccgaggccagcagatcacctgaggtcaggagttcgagaccagcctgcccaacaaggcaaaaccccgtctctactaaacatagaaaaaattagccgggcatggtggtgggtgcctgtaattgcagatactcgggaggctgaggcaggagaatcgcttgaacccaggaggcggagcttgcagtgagccaagatcccagatcgtgccactgcactccagcctgggtaacaagagtgaaactccatctcaaaaaacaaacaaacaaacaaacaaaaaaaaactgatggaagaaattttcaatctaactggaggagtgaaggaaggaatccataacgtcttggaggaagaggcataaacttgaaagacaaggaaaagcaagggccctgggacactcgcccttgcatggtggtcttggagaagaagcatgacggagctgggccaggctggggaactgtctgtgcagttgacagttttgaaaacattaaggccctagcatgacatctgtgtctaaaccctgagggctaccattagtagaattacaggttgaaaacatagattttttttttgagatggggtctcactctgtcacccaggatggagtacagtggcaaaacctcggcccactgaaacctctgcctccccggttcaagcaattctcctgcctctgctggcacctgccaccatgcccagctaatttttgtatttttagtacagacggggtttcaccatgttgaccagactggtcttgaactcctgacctcaagtgatccaccctcagcctcccacagtgctaggattacaaccatgagccaccatgcctggccaagatagatctttattttttttattttttatttttttttttgagacaaggtcttgctctgttgcctgggctggagtgcagtggcgcaatctcagtgattctcctgcttcagcctcccaagtagctgggactacaggtgcccaccaccatgcccagctaatttttgtatttttagtagagttgtgatttcaccatgttggccaggctggtcttgaactcctgacatcaagtgatctacctgcctcggcctcccaaagtgctgggattataggcgtgagccacggcgcccagtcacaagattgatttttaaagatatatattagcctctgaagccatttcaaagaacatgtctgaattcagatcacagattagaagacattccattccacccttattcccagacctcctcctctggcaagcttcaattgagttctaacatttcacagttactcagggacttggtcactgctggtgtcttgttctcttctggcttagcagcagctaagacatcccactcctttgcttccgtaaagtttgtctaatatttcataataaaggcactatagcttgagcaaactgaaaagtataatgaatatttttttttttaagagacggagtcttgctctgtcacccaggctggagtgcagtggcatgatctcagctcactgcaagctctgcctcccgggttcacaccattttcctgcctcagcctcccgagtagctgggactacaggcgcccaccaccacgcctggcttattttttgtatttttagtagagacggggtttcaccatgttagccaggatagtctcgatctcctgacctcgtgatctgcccacctcggcctcccaaagtgctgggattacaggcttgagccatcgcgcccagccatgaatgttttttataataaatagctcttaaaatggtcttccctttttagcacaagaaagaatgctcttggagaaatcttcttggtctttgaattcaccagcacctagcaaaggccctccttcctatgtggatgctttagatatttgggagtggatggggttgcttctagagacactttctaaagctctcaggggcagtgaagagaaagttgagcttgatgcgggtagaccttacatccaggcccagatttgccacttttgggggaggcttttaacctctctgaaatttaatttattatctgtataataaaaataaatcttggcaaatttttgtgatcattaagaatatagaatataaaagccttctataaattatactatatgggatagttatttgcaattctattgcattattttaaaatttattttctttatttatttattttgacacagagtcactctgtcaaccaggctgaggtacagtagtgtgatctaggctcaccgcaacctctgcccccagtctcatggctcagcctcccaagtagctgggattacaggcacgcatcaccatgcctagctaatttttttttttttgtatttttagtagagatggggtttcaccaggctggccttgaactcctgacctcaagtgatccatccacctcagcctcccaaagtgttaggattacaggcatgagccaccacaactggcccttatcacaattcttaatgattccaattgactcttaaatgaaaataaatgaaaacagagcgtggcaagtaggccccttcatgctcttgacctgctgtgtcgtaggcctcaagtctaattccacaacgccacatgcagatgttatgaaacaggctttactagagaaagttataaatcagggatcatcatcagaagagcaagtacaggtctccaatcccatcatccctcagggagacgtgcgaaagccaggctattccgctgaatgcaccaagggcattcgttaccaggaagcccctgcttctctcacttctcacaaagcaaaaatgacagcaactttgtcagtaggggaaaatcagatgcatggggcaccaggcagtctgggcataggtgcctgctgtttacaagtgttgtctgggagtcagagcccctccaggaacagggaggaagccagagccccttcttgaagctgactttgggtgtagtctctctaactaggagaagtgaggaacactgtccaggcaacctggagtgcactgtcacgatcattgctgttcagtttttttgtttctccaaacacagagaagggctgggagattatgggaaataaaaatgtagcacatacatccaaatgaaactcacatatgttaaaccacgtttgttgtaatgtcagggtaaaaataaaggttctattaaatctcatgcttttagatgctttgtccagttaagaaagctattttcaataatctgaatcacaaagcatcattggattaagatgaactaagaccaaaatgaggacaaagtacccgtgccacttcctttctgtgtgatctaagtcaggatatttcacatctttgttttcttatcagcaaaatagaaatagatagtatagtacttcccaagtcatgtaaggatcttggtaaattgctgtcataaatgaaagtttaaaattacagtgtgatatattatttttattattatttgaatgttgaatggaaccttagctaaaaattattttaaaatgtcttaaattacagatgcataaattggggccctgaaaaatgtaaattactttcaaaaaattacagtagaaatgaggagtagaaagaagaccaaagacacacatctccaaacacccaggccagtgttcttccacaatatcaggatcaaggaagtttttttaatattgtttttatctatctttttaatgatttcagaatgtaatttttaactagcttatatgtaagctttaaatttaaagcttaaaccacagaccacattatatgttctttttctaagaactctaaaacttagattgaatacttattcttatttactggtgtaaaatgcataaaaatggagccaggataaatgagattgcagctcagagcatgattgggtctcacaacgaagctgcaatggcctgtgagtacgatcaccatttcaataattgcctgattatctatgctgggagaagttttgcgcagttatttctgagattgaatgtaatttaacatttatgatttactattcacagcaatagtaaatattcccacctacagtgccagaattctaattacacgagtcttggtctcagctaagtggccactgctgggtaattcctggtctcttgcagcctgactcaatgagctaaatcaccatatctgaaattagcaattcgaaaatgaaattatcagggaaagaattgccattcattgcgtgagtacccttctcttattgtagaatttctggatagttatgtcctggccaagatgggcacatacatggtggaaaataagtgaagtgaaaagccgttagcacagtctttgtgttacaattagtcagcagttcccacctcaacattagaaaggccaaatactagccgttgtgctctctttcgctgaccctaaatggaattggcttgtctaacagcctttttcttcctgggccaaaaataatccatgaccaacttttatagcagctgaggggagttaactaaaaaatatcttcgatatttcaaagccagaaacatatttatttggttgggtcagcttactatccaacacctaattctgaatatttttaaaaataatcgttataattttttgtccttgtttataagaaatttgattgaatcttagtgacttttttcatgaagttttagactgcctcttactcaaagtgaaatatttatatatgcattctcattcgtcatgttgtttaaataatagtagttacatgtcagccactgttcatgtatgtttcatatactgtgtcatttaaacatctcattgactctatgccaaaggtactacatattttgtctttattttagaaatgctccagagagattaatttctcccacaaggtcatatagttaaaaagcagtagagcagagattcaaactcggggcaagcaactttagactcatccttaggaattacacaccaagactgtattagcctgttctcatgctgctagtgaagagacacccgagactgggtaatttataaaggaaagaagcttattggactcacagttccacatggatggggaggcctcacaatcatggcagaaggcagagggaaaagtaaagccacgtcttacatggctgcaggcaagagaacttgtgcaggagaactcccatttataaaaccatcagatctcatgagacttagtccctaccaggagaacagtatgggggataccacccccatgattcaattatctccacctggtcccgcccttaacatgtggggattattacacctctgggtgagatttgggtgggaacacagccaaaccatatcaaagatgtaagttctgtataaatttttcacctgtgtactatatacagcacaatttcattttttttccaatttttattatggtaaatacacataaaatgaactatcttaaccatttttacttttacaattcaatggtattaaatgcattcattttgttgtgcaatcatcaccatcatccatctccagagccgtttttatctagcaaaactgaaacgctatacccattgaacagtaattccccatttccctctcctcctagcccctggccagttaaccttaaataatgagttcagaaaatgtgattaaatatagagtttattccagctcaaagcctgaggatagccaccagggaaacaccaactccaagtgaatggggtcagctttccaaagtgggaaagttaaggtttcacttacataggcagaaatagagaaggttaacagggttgcaacatttgccatataaggccagcacagatgttacggtcatttgattggttacagtttgctatgttccaaggaagattgctttaacattccataaggaggggtaatggtctcgaggggtcttatttctggaaccatttggtcttttctaatcatttacaggacagaaatgaggaagagatttaatctataatcagagaagcagaagttgcagctgcacgtggcataactcaggccacataaccacatttctctcaaggctcaaaataatgtaaagttccaaccattttaagtttgaattatttgatttcacaccaccatcgttctattttctgtctctgtgattttgactgctctaagaacctcatgtgagtgaatcatatagtatttgtctttttgcagttggcatatttcacttagtataatgtccttaagttttgcctattttgtagcatgtatcaggattttccccctttttaagatggaataatattccattgtgtgggtagaatacattttgcttcttcattcatttgccaagggacacttttatttccacattttagtgactgtgaataacgctgctacgagcacggtggtacaatttctttttaacgtctacttttactcacctctgtagtgctcctgatttggtttctaaaaatctcttattttaattttatattaaaagtattcattatgacaaatacattcaaattattttctgaatgtgacctgatttcaaatcctagtcctattgcttgctagttcagtgaccttcagcaagttataaaagctgtcaatgactgtttccttaaccacagcatttaaatggcactcacagctacctcacatggtagaaagggagtttaaatgagaggatactcataagggagaaggcacatccatatttcactagtaaatgctcaagaaatattgattccaattacacccaagcacacacagataagggttagctcatgggttccccaggagcagcctcttcagtattcaaaaacaactcattgggcccctctgttctgacctccttgcctgcatgccttgctgccaccctgctgctgacactgccctcctgagatccttactctgccagctgcagctgtctcagcctgtgacagtcactgatgcccttatggagagatggagagggccccctactcaacctcagtgcagtggaaacgaagctatggctttcagcaagacttgacaaggattggagctaacagaaattttacactgagagaaacttgcaactgcttcctgaaatagccactcttcaaatccaggcaggagcccagcccctgagaccctgccaagctcccagcgaagcctcctatgggtctcaaccctgctttcattaatgaggctcctcaggcatttggatccaagccaaacctcctccaagccccagaggaagaagaagttcttcttcatcccaagccctacctcagttcctacaggaggaacatttgcttctcaggctgattgatagtgcaataattaaatcccttaaggaggaaattcccagcttaagccacaaaggtgtgcgtcaatcacctggcctgaacgggagcatcgctgtggtctgttctgggacctgggtttgttgagtgcatttctccaagctaagattccagtcttcagggacgcctcctgtaggacaacagtctaatgcaatgtgtgcagtgacaatatcagtcaagttttatttcatgatgtctcctcataaagagaagagaaggtaaagtcagcaagctcctccttctatgatttcatgggagaaaaagccaagacaaaaatgtaacacatgtccaaaggataaaaaggagcttccagggataagccagtttaaatccagatttattgggggaggaaggagcatctctcatactgctggcacaaggtcctgctaaatttacagtattcaacagaaaaatcacttcgcaaggaatattccattttaattcctgcccccaaattcaggagcaatatggaagtacttgccaggcatgtccacagatgaaaagccacaaaagtgatctctcaggaaatagagattttaccctcagtgacaacactggaaatcactttataaccactgcttccattccacctgctcccaccttagacaaacaaacacaaatggtttttacagcttcagatttttagggcccaacaacaggcagttcaatgaaggaaagataaagaaacatggacaatggatatttaaaaagaatttctgtttcataggttttaaaaaaggtttctaacatcagtctggaaaacagaaaccttaatacgagacagaaggtactgcacgatggcagctaggagcctggctatagagtcagaccatctacgtttatgttcctcctccaacactcagccagttagtaagacctgcctgtgcctcagttttctcttatctacagtggagatgaaaagagcgtgtctccagagatgatgtgagaatcaggggacccaagcaagctgagcatcattctttgtcctgtcagtggcaatgggactggaaacataacctttagtacaactgggtaggaatgtatgactgaggttacttttttgagggctatttgggaattgccatcaaaacttgaacactacattctttgactgaatccttcaccatatggcatgtaccatcttaaaaaaaatatatgttctaaggtggcatataccattttttgtagcagtcaaaaaaaaaaaataacctgtagacagcagaaatgtccatgaatagagtttcagaaaatgatgttataaggctggccaaggaatgaagtagatacataaacacttgcacagaaagatggccaagatgaaagtgaaaaaagcaagttgacaaatagcaggtataatacgagtctggtgtttcttttttaaaaaaaaaattatttaggctggtcgtggtggctcacgcctgtgatcccagcattttgggaggccaaggtgggcagatcacctgaggtcaggggtttgagactagcctggccaacatggtgaaaccctatgtctactaaaaatacaaaattagtcaggcatagtggcacatacctgtaatcccagccactcgggaggctgagacaggagaatcacttgaacccaggaggcagaggttgcagtgagccaagatcgcatcactgcattccagcttgggtgacaagagcgaaactccatctaaccaaaaaaaaaaaaaaagaaagaaaaaaaattatttttgagaagggtctcactgtgttgccccagctgaaatacagtgacatgatcttggctcactgcaacctcgacctccccaggctcaggtgatcctcccacttcagctgggactataggcacaaaccaccacatctagctaattttttgtattttttgtagagatgggggtcttgccattttgcccaggctggtctcgaattcctgggctcaagcaatctgcctgccttggcctcccaaaatactgggattacagttgtgagccactgtgcccagcctggcatttctctaatgtgtataatccataacctttatacatgcatacataatttctagaaaatctacaaaagaaacaattacaacgcaatagattaaggatgtaggactttatggaggacctggcttgtcccattgtacatcttataagctctttgaattttttgccatgaacacatttaacctgatcaatttaagtatttaaaaatagtttagaaattaaaataaaaaataagaatcctagccagcatcccagtacataataaaacaatactaaattcttattttaagaaaaatcagatcaaagactaattttcacatcatcaacaacaaaaccaaacaaagcatcttactggctctcctggccccaatattggaaggaatttctcagcaagctggaggattcctccgctcagcgggcgccgtgaaactgagaatattcataccattagccctgtaaccacatgcaaaacaaaatagttttttcattgatctgagttctgtggaactcatgtttgtgctcttaaatcttttggaatccttctggggaacaatcacttgacatcccaatactcagtggtcttattcgtgcatattataggaatatgatattatgaggagtactggtatcagttatgacaccagttgctaaactgaccagaaagattgttgatattcaaataaatgtgtgtgcatgtgcttgtctgtgtgtgtgtgtataaaataaaatgttaaaatggacagctatcaatatattttctttctagatacataaacggagatgccctcctgatctcatgaaggccattttcattaagttaagctttgttcattttcattcagttaagctttgtttaaaaaaaaaaaaaaaagatattgctttaccagtgatctgggtggcgggcgggggtgaagaagaagaaaaaaaaggaaactcttaattttagtcctatttagccccaaagcatgtgtttcagtattagagcatggccagagcagttttcaaaagggttacaccatcccgtgtacgttactccttatactgactccactgtggtttacttggcagatttgagctatgctgaagttgcctcttaacaggagattcctagagcgtctaacagctcaactcttttaggagcttaactactttttaatatgtgggtcagggttaagagcctcaggcaagggcttctgccctctttcgttaggaatttaccttggggatgaactaaaaaacttcaggaggctcatccaggcaggttccagatagctcaaattgcaaagctacctggaaagccactgtgtttctgcagccctgtgagtgaaacacctgttattggcaatggggaaggggaaatgtcctgtctctcccagttccccaaagaagcataaaaatgatgtattatatactgtctcagggacattttggtgccaacccacttggcacagcatagaatcctcctgtcacctcatggattgtatcatgacagaagggtaattgggcaccggagaagatgtcagcagagtgtcaatacggtttggccactgcccccaaataatattgatgacagcaaagagagcgattaatcaggtgtgatcctgtcaaatgttcagagtgtgctgtgggtactagaaatagatatagcctaccaacaaaatgttaaatggacttaaacaaaatagattatttagtcattttgagaaaagcagaactaagattcaaaagagctttttttctgaaaaaaaaaaaaaaaaatacagtgtatttcccattagtatttctctccacttgcttgaaaaagagggagagctgttatgttttctgaaaaaaaaaaaaatgcattctgcccaaaaaatcaatcatggaaaaaaaaagatcaaattaaaagagatgtcatgggatctaaagaaaagtgcagacgcagcaattgtaaaacacgttataattgtggacctatctgtttatttattctgtgtcccactgaaagttcaccctcacaccctccctaccaggccagccatctcctcccattaccccctcttgatattaatgatgctcgctcacttgtagtttcccacgtgtaaaaccccattgccttatgtattatcagttgttcaccattttccatacatggattctgtctcccctgggcctttcacagacacctgaccatctgtgaccatggcctttctcctagttctaaatctaagcaatggtattgcaacaatcttccaaaataacttccagccttaaaactctcttatcctacaactctgtctataactgtggccatcactggcttcacattagaatcacctggaaaacttaaactattacttatcattaggccctgcctcagactaattaaatcaaagtctctggagattatttttggccatctttgattttgcaatttcctgaggtttctaatgtgtagccaaggttaaaaaccattgatatagggctaggttaagctgcatataacagaaaaataactaaacaagagtgcttaaacaagatgaaagttagttcccatgcatgtaaaggaagtccaggctccttccagctctctgttctggtgttattcagatttgacatcctcctcaggatccaacatggcttctagagctccagccattatgcttccattccaggcagaaggtagaaaagagaggaaagagagcatgccttttccttccaagaatgactttacataccacttccatttacgtatcattggctggaactttagttaaccacgactagcagcaaagatggctgggttctgtagcctttaactgggcatgaatatgccttcctaaaaatgagcattctgttaccaaggaagaagaggaaaatgagcattaaggggcaactaagagcctctgtcggaagtgttaattcttcaaaggggccctgctagtctcctgttcacacctacagtaggtccctgtgatctccagaataaagtccagactcctgcagttctggagtccctcctcaccttgcattctctgctttacctcactcacactggggccattgtaaggatatttgtattttctcatcgctggtcctttacctacacctaaaataactcttcacatatctgcgttttcaacatcatctacttctgcagaaccagcgccagtgctgcttcccaaggaaacctccctgcctttgcccacacccctcatgtctagcaaaagtccatgcataaaaggcctgcttcctgagggtctcaaagcaaattacacttattttaaagttattttctctcttatctgcaattagatgcctgggtatctgagttctctctcaaattacaagcttcaggaggtcaagcaccatacctcatgtgtattataagtcattcatgcctgtcacttagcagctagtcaacatctatttgcaatgtaagccaaatgtgtagcactttagagaatccggttttttgtatgtatttataaactttctttttgcattgagtcataaacccacatagacatacactcatctctgctttaggctttgtagatggttttagttcacatagcaaaaattggaaagttactttatattcaatagtgaggtaaatcatccaagtcagtttttaaaaagataatgggtgtgtactaatatgtatgtccatactcacatagacactgacacgtgtatacaagtatattacatgcacatcctacattactaaatgtgatgtataatgactttattaatttttttggaagcatgctagttgtcttaggctaatttaatgcccggtattaaggtgaaatcaattactaccttttttcatcaggactagaggaggaaaaaaacaaacagaaaaactacccttatgcaggaggaataattctaaagacagaaatacaggatgtttggaaatgaccatctgtgacgatatttacctgcttgtccctgtcagccctgggaatggtgtgtctttaccttaggttactatattaggcagaataatggcccccaagatgttcacattctaattcccagaacctgtgaaggtcctacttcatgtggcagaagggactttgcagatgtagttcaaggtacagactttgagatggagagattatcctggactatcagtgggtgcccagtcaaagcacatgacttcttaaaagtgagaaaagaccctttcctggctgtgatcagaaagaaatgtgatgacagtagtaggctcagagagatgctatattgctggctttgaaggtggaggaagaaatccatgaactaagacataaaggcatcctatagaggctgaaagagacaaggaaattgactctcacagaggctccagaaaggaacacagccctgacacaccttgatcttaatacagccagacccatggtctgaattctaatctacagaaccataagataatatgtttgtcaggttttgtttttgttttgagacaggtctcactgtgtcacccaagctagagtgcagtggcgcgatcacaactcactgcagcctcaacctccctgggctcagatgatcctcccacgtcagcctcctgagttgccaggactatacgcatgtgccaccatgtctggctactttttctttctttttttttttttttttgagacagagtcttgctctgtctcccaggctggagtgcagtggcgcaatctctgctcactgcaagctccgtcccctgggttcatgccattctcttgcctcagcctcccaagtagctgggactacaggcagccgccaccacgcctggctaattttttgtatttttagtagagatggggtttcacagtgttcactaggatggtctcgatctcctgaactcgtgatccgcccgcctcggcctcccaaagtgctgggattacaggcgtgagccaccacgcccagcctacattttctattttttgtgtttttctccgcgttgctcaggccagtctggaactcctgggctcaagtgattcacccaccttagcctcctaaagtgctgggattataggcatgagccaccgtgcccggccacatttctgttgttttaagctacttcattggtgttaatttgctaggcagcaataaaaaattaagtttccttcctacggtggtgatgtcatcaaaaagaccccgtaaagctttattttttcctctcacattggtatagagtgaaagttcactggtaaaatagctttgcagaaaccttaaaaagtatgccttggccgggcgcggtggctcatgcctgtaatcccagcactttgggaggccgaggcgggcagatcaccaggtcaggggttagagaccagcctgaacaacatggtaaaacccgtctctactaaaaatacaaaaattagctgggcgtggtggcacatgcctgtaatcccagccactcaggagactgaggcaggagaatcacttgaacctgggaagtggaggttgcagtgagccgagatggcaccactgtactccaacctgggtgacagagggagactccgtctcaaaaaaaaaaaaaaaaaaaaagcatgtctctgaaagtgattttgtggctaacaccctgtttccctgcctgtccatcacttgctgatgctgagagcttccagcctacgaagaggatgtgcagggccttcgttcactgataaccagctctaccagtgaaggactggttgtctgtgcctacctgtgatcaggtctccttcaagtagatgattatatagcagttggcaggaattttttaaaactcagaaacattcatttatacatccaatcattcagctcatgtctgagtccctgctatatatcaggcacagtcagactatctggcagtccttggaaacacagggtgggtgggtagttttaagtcatatgcctcctgctgaaagacagatttaagaatgtgtcttcacaatccctacaccactgcaatttcacgtatgtgcttctgctcctgtcttttttttttttttttttttttgagatggagtctcactctgtcacctaggctggagtgcggtggcgtgatctcagctcactgcaagctctgcctcccgggttcaagcaattctcctgcctcagcctcccaagtagctgggactacaggcacccgccaccacgcccagctaattttttgtatttttagtagagatggggtttcaccatgttagccaggatggtctccatctcctgaccttgtgatctgcccacctcggcctcccaaagtgctgagattacaggtgtgagccaccacgccctgcctccttttttttttttgtttaacaggcagagaaatgattagataatgaagacgttatttattttttattttcataataatgaattaaagaggatcttatggacattctgagctttcccattgtaacagcctcatttatggcagacgccatttgcctgctgtccacaccgtacttaatttggcctcaatctgtatctttggtgtattaatctcctcatgatccagataacctcttctccattaacaatggggttttatagctaggacagtgcctggaaagttataagcattattattttctattattattatttaggagatgttttgggcagcttactacattgcacagaagctatctcatttcctagggactttgatgcaatagtcaattgtaaaatagacttttccaaagtcattcatttcatccattcctttaaacacctaatttttgagttcctgttatgcacaaggtagtctgctaagactaatgacaatgataggtgaatgccacccctgctattatcatctttagggctttgagaagttacttgacttttctcacttcagtttcttcatctttaaaatgagaatagtaatattactgaccttgtgaagatccccatgtttatgcaatatgggtattgttttatcaggcctttgtatttcagaagtttataagcctcatgaacaggagcaggggaccaactagacaaggaaagaggcagatctattcaacaaacatgtgttgagtacttactatgcacaaaggcaggatatcaatatggggggtaggaattcaatggtgagtaacgctgagacatgtggtgggattttagagcacacattttgcaaatcaaagagaacttgtgaatccctgtaacagccctagtgaaaattgttaagaatgattctggcaagtcccatattagccatatacaaattatccccattatagacttcccatagtgtatatctctagtataaaaagcattacaataatcacatttaatccttgttacattttaaatacgcatgtcgatgcaaattacaaatatcgaaaggaaaatgaagacagaaggaaaataaatcaagaaattcatttagagaaagaaaaatcacaatataaaacagccaatctttcttgttaagagcagccctcacatttctaaatgtatgaattggttttgtgttgactgtgccccaaccctgcttatagtatgtcaatattgggagaaatccatcactgacactaacatggcagccctctgaggagtcaagccaggggcatctagaggggcaatgcccaggcttcactccccctccttttgaaaggctcaggttgccttatagtcttccataaaaatactgagggcttttccaggactgctcactgtgtgataggaacttacatctatagggcatgtggtaacatgcaactgaaagcttagatttttttctagtgatgggtcacattctacactaggtccatcttgccattggtgccctgaagtgctttgtctaggccaactgatgcagtccacagagtctaaagaccactcaaactactcataacgtttcttgtggctgcccatccattccagttctaggagtagtttagaccatgttcatctctattaattatctcaagtctttatgcagaaacagcaacaaaaataggctatagaggtatgagaagtggttttgaattgttagtaaagagaggatgcaaaaatcagtttgtttgttgtcatttatttcaagctcaatattagatgccaatgttagggactatcaacatacaaagaacattttttaaaaacactcttaatgacaccttagtcaagtgtccaggttataggagtttccagcaagcatcagctagaccacacctgaagaattataaatagtactaaaaaaccaaaacatggaaaatgaggtcaggaatttgataagtgtccaatataatgataatgagcaaaaaggaaggaaggaagggaggggagggaaggggaggggagatgagaccactgtccatgcaataatccctttcccagtgttaacagttgaattgtgtccccacaaaagatatattgtgaacgtgacatgtttttgacatagagtctttacagatgtactcaggttaagatgaagtcattattaggtgggccctaattcattattactgttatcctcatgagaagaggaaagacacagggacagacacacatggagaggagaatgccatgtgaagacccagactcaaggagaacaccacgttgggagggaggcagagatttaagtgatgtgtctaccttccaaagcatgcccagggttgcctgcaacaccagaagctaagagaaaggcctggagcagattttcccctaggcccttctctccgtttaaatttatttttaaaaattttttagaggtggcatctcggtctgtcacccaggctgaaatgcagtggtataatcacagctcactgcagcctcaattgccagggctccagcaatcttcttgcctcagcctccgaagtagctaggattataggcatgcaccaccatgcccagctaattaaaaaaaaaaaaaaaatttctagagattttcctttgtaggaattttctgtgttgcccaggctggtctcaaagtcctaggctcaagtgattcttctaccttggtctcccaaaatactgggattacaggtatgagccaccatgcgtagcctcctagagccttcagaaaaaaacgtagtctgcaaacaccttgatttcagacttctagcctccagaactgtgagaaaataaatctctgttgttggaagccacccagtttgtggcattttgtcatggcagtcataggaaatttaatgcattcagcaatgctgccagagatggccattcccctctgccagcacattcctaatgtggtgccagtctcctaagccagtctgatgatgttggacagctccaggcatttgctgagggcttcccaaatgctgggcaccactctaagcacttttttcttttcttttcttttctttttttttttttgagacagagtttcactcttgttgcccaggctggagtgcaatggcacgatcgcagctcacccaacctctgcctcctgggctcaagtgattctcttccctcagcctcccgagtagctgggattacaggcatgtaccacaatgcccggctaatttttgtatttttagtagagacagggtttctccatgttggtcaggctggtctcgaactcctgacctcaggtgattcgcctgccttggcttcccaaaatgctgggattgcaggtgtcagccaccatgcaagcccacactaagcactttatctgcatttccttatgtaatcttcacaaaaacctataaaataggtacaattacttttccaactctgtaaataaagaaaccgaggcttagagaggataattaacctgcacaagaccacaccattcataaggagtgaacgggaggcaatctgatgctgcagccatgatactccacctcctgtagagaaaaggggaatgagtgtgatggttaagagaactgaaagtaagccgggaagatggaacagagaaggaggcatggagaaaggtgaaagatgtaagcccagtcttagactgtccttgtgcagagtatgagagccaagctgtacatagagtagacagagggagagtcatccacacctctcaagtcagaaagaaagagaatgtggcaaggtgtggtggcgcacacctgtaatcccagcactttgggaggcctaggcgggcggatcatgaggtcaggagatcaagaccatcctggctaacacgatgaaatcccgtctctacaaaaaatacaaaaaaatttagccaggcttagaggcacgagcctgtagtcccagctactcaggaggctgaggcaggagaattgtttgaatctgggaggcagaggttgcagtgagccaagatcatgccacggcactgcagcctgggcgacagagcgagactccatcagaaagagagaaagagagaagagagagagagagagagagaaggaaggaaggaaggaaggaaggaaggaaggaaggaaggaaggaaggaaggaaagaaggagcagttttaggttcacagcaaagtaccccctaccccctacacatataatgcagacaaacacacacaagcgcgcgcgcacacacacacacacacacacacacacacacacacacacagctttcccccatgatcattcaacacagggtagtatatttgttatactcatgaacctacattgacacattatcatccaaagtccatcatttacattgggtttacacttgctgttgtacattctgtggattttttattttttaattttttttttgagacggagtctcgctctgtcgcccaggttgaagtgcagtggcgtgatcttggctcactgcaagctctgcctcccaggttcatgccattctcttgcctcagcctcccgagtagctgggactacaggcgcccgccactcggctaattttttgtatttttagtagagttggggtttcaccatgttagccaggatagtctcgatctcctgacctcgtgatccacccgcctcggcctcccaaagtgctgggattacaggcgtgagccaccacgcccggccattctgtggattttaacaaatgtataatgaaatgcagctatcattagagcatcacacaaaatagtttcactgctgaaaactattctctgtattccctccattcaatcctcccctcccctcaactcctggcaacaactgatcttcttactgttttcatagttttactttgtccagaatgtcctatagttgaaatcataaaggatatagccctttcaggttgagctaattttattttagtgataaaaaatgttaaatagtatgtagaagaatttagggatgctgacactgtgaaaacaaatatatttaattacgctctacttggagtttgtttaaatcagatgtaaatgatatttgagctgattataccttcttcaaatggagtcttatttgaaagtctagtatgaagagatattaaaatggagcatgtctgggcaaagggaaaaagagattaggagttccaacaactccacacctctccccacgcctcatcctccatgatggaccttggagacttacatgaagcctccagtgcttcatgaaacacagcattaaaaccagatttcagagattaggactttaaaaatttagtgaatttataatagaagtatgatgaaaatgtccttttcttccataataaaatgggaaggtacattctataaaactgtcaaagtttacctgatgtttgatttatgcttttaataccttcacatacactttcttgagtttgttcaatactaatagtcaaaattcaaagaaaattaaagtcaacatctttttacttgttgaacacattaagtcactgtgatctacatgtaattccatcctctccaaattaaaattaaaattaaagttggattgactggtatacagattacagttcatgaagtctcgttatataacctttgaaccaaagtttatcttataaacacgtaagataaatgtcaaacgggaaagtaaaaaagattttataaaggaaaatagaagaactgaaggcacaggataaatctacatgaaaaaaacaaagagcgtttttaaacacttcttcatgtgaattcaggtgataatacaatggagttattttactcttaagacagattgacatatttaaacatagttctgatgatgtggagatgtctacagaatatatttcctctctaatttaaattatttataattgcatagttagttacaaagaataaaatcaaattaattactaataaatgccagagaaacatgtttaaattgacattcacttccaaagtcagctcctgcataatcaccacaaatttttaatatttgctacaatatgacaataaaacaattgcgtatattacagagtagaagaaactccttcaaagataaatatgcatttattctatttagttgtagaatgataaagataatttttttagaatggtctaaggataactttttcaagaaaaaagatgaaaaatgttctgttcccccaaactatcataagcctgccagccacacctctgccttatcatattcaacctgagtagatgacagtcgccacttatgccatattgagaaaaactctgatggtctgattagattcattgaaatactttcagtattagtagctaaatagggttctttttaaagtttaatttaacctaagagttgtaaaaatgaaataaatattattttaaatattgtagaataagtcaaacacttttagtttcaaatggattgtcaagataactgatgtactccgtaaatatatacatctactatgtgttcacaaaaatttttttaaaaagaattggtaggcataggctagtaaattgaccaatatcttcatttgcttaaaataaatttctaaaaccaagttgttccttgagacatatgcaatatcttcagaatttcatgccataagattaactatacttgatcaataaactttgaaattttaaaataaatacagaaaagttctttctcaattcagaaataactactgatattccctgggtgacttttttctcagacaagttagaaaaccaccaatttgactagattgggaaattccttaaaaggaaattagtgcaatggccgagaccttgactctgggatctcctaagttagagtcccaggactacctaccgattatcaattaaatatgcagtcttggtgatatggtttggctgtgtccccactcaaatctcatcttgaattgtagcttccataattcccacatgtggtgggagggacctggtgggagatcattgaattatggggcagtttttcccatactgtcctcatggcagtgaataagtttcacaagatctgatggttttataagtggtttccccttttgcttggctctcattctatcttgcctgccaccatgtaagatgtgcctttcaccttccaccgtgattgtgaggcctccctagccatgtgaaactgtgaacccattaaacctctttttctttataaattacccagtctcgggtaattagcagcatgagaacagacactcctaatatacttgggaaaattatataacctctttaaacctcaatttctcaaagtgagggatggtgaacagcagggcgaggatgagaaagaagatgctagtgtaagtaatagtacctccttcacaaagctataatatagattatatgaaattatgtgtaaaatgcatgtaacataatcagaagtgttaggttttactgctactcatgagtagcttatttatttattttttctcattagaagaaaactttaaagcgatgaattgtcttggtgaaaagtattaggagactcttggctatgggtaaaaatgtcagaaaacaatctataggctagagtcagtgcaaaggaagttatgtttttggtagcctaatataaatgtaggtcgtgtttcctgatgtcagcaacattctaagaggcggtcagttactctcacacttggaactgctctacctgactatgtagtgggttttgggagagtcctaaaaaccacatcttataatgtgtcttctataaaatgttccacagagttttttataaaacctttaaatcggccgggtgcggtggctcacgcctgtaatcccaggactttgagaggctgaagggggcagatcacctgaggtcgagagtttgagatcagcctgaccaacatggagaaaccccgtctctactaaaaaaatacaaaattagctgggtgtggtggcacacacctgtaatcccagctactcaggaggctgaggcaggagaatcgcttgaacccaggaggcagaggttgcagtgagccgagactgcgccgttgcactccagccggggcaacaagaacgaaactccatcccaaaaaaaaaaaaaaaaaaaaaaaaaaacctttaaatctttatatgtgatctgtttatgtattgagttctgctcttattgatcatgtgtgtccatagaggcaagatagagcagtcaaattgtgatgaccagtatgagctgcatttgaagttcagctacacagaattttagaaagggatagaagagatattattcacataaatatttaaagactaattggacactatagggacagcatgtaacatggaggtgaggagaaggactcctcccaatgcttcaacaagaacacagctgtgtagataccatctaacgctgcctctttttcagaaaagaatatcctacaaactcaggttttactatcagtatcacaaaataataacattattatgaaataatgtgatttaaacaatatttaaagatatgaaaggtacagtttcaaaatacaaagtgttatacaggtccagccatttagagatagactaatccattatctactaacttctggtttttgcaaatagtatactagaattcatcctgtaagtattaaattttataaatatccaaaatgcctgtattttgccaaaaagtaaagccaccctatttcaaattttttaatctcagtacctacttttaggtaagcccattgtaaccacaaagaaaatacatacagagcagtgttccccagcctttttagcaccaagggacagttttatggaagacaatttttctatggaccagggttggtgggggatggtttggggacaaaactgttccacctcagatcatcaggcattagttagagtctcataaggagcacacaacctagatcccttgcacacgcagttcacaatggggctcaagcttccatgagaatctaatgccgtcactgatctgacaagaggcggagctcaggcgggaatgctcactcgcccgcctcacctcctgctgcatggcctggttcctaacaggccacagactggtaccggtccatagcctgggagttgggaacccctgtatagagcacatacaaaagaaaaacagaaagaaaaaaaaacaggaaaggagaaatgggacaaaataaatacaagacaaacaaacaaacaaaaaaggttaacaaaatggcaatagtaagtcaataattaccttaaatgaaaatagactagactccccaatcaaaagacagagtgactgaatggatttgaaaacaacaacgacaaaagatccaattaaatactgtctacaggagactcactttaagtttaaagacacacataggctgaatgtgataggatgaacaaatgataatctatgcaaatggcaaccaaaagagagcaggagtggctatacttagaatagattttaagtcaaaaactgtcataagagacaaaaaaggacactatataataataatatcagcagaaggaaggctaattcaccaagatgtaacaattttatatgcacccagcatcagtacctctaaatatatgaagcaaacactgatggaactgaagaaagaaatacaatattagaagacttgcatatcccactaaatagcagatagacattcagacagacaaatcaataagaaactatagaccaagtggacctaacggacatacacagaacatcccacccaacagtgacagaattcacatccttctcaaacacacacagaacattctccaggatagatctcatgttacgtcacaaaacaagtttcaataaacctaagattaaaatcataccaggtatcttttctgatcacaatggaatgaaatcaaaaataaataacagaaagaaaactgaaacatttacaaatgtatgaaaattaaatgaaatactcttgaacaatgaataggtcaaataaataaatcaaaagggaaattagaaaatgtctcacgacaaataaaaatgaaaacacaacataccaaaatgaatgcaatacagcaaaagcaattttgaaagagaaatgtatagtaataaacagctgcataagaaaagaagaacgcaaatcaacaacctaacatacctcaagaaactagaaaaaggaaaacaaacttagcccaaagttagcagaaggaagaaataatgtagattagagcagaaataaacagagtaaaaaaaaaatagaaaaacttgaagaaatattttctaaaaagataaacaaaattgacaaactaaaaaaaaaagagaaaaaaactcaaataaataaaataaaaaatggaaaaggagacattacaacctgatggcttcaatgctgaattccaccaaaaatttaaagaacttatgctaatccttgtcaagatcttccaaaaaattaaagaaaaggggatactttcaaactcattttataaggccagcatttccctgacaccaaagccagacaagaatattacaagaaaagaatactacaggccaatatccctgctgaacatagatgcaaaattccttaataaaatactagcaaaccaaattcaacagcatatcaaaaagatcatacaccacaaccaggtaggaagaaggatgtttcaacataaataaatcaattaatgtgctgcactacattgccagaatgcctaggaataaacttaagaaggtgaaagacttgtatgctgaaaactatgaaacattgatgaaaaaaattaaagatgaaaataagtggaaagacgtcccacgtttatgacaggaaaacttaatatcattaaaatgtccatactacccaaaggaatttagagtttcaatgcaatccctatcaaaattccaataacattcttttttctttattttattttatttatttatttatttattttgagacagggtctcattatatcacccaggctggagtgcagtggtgcgatctcagctcactgcaacctccgcctcccgtgctcaggcgatcctcctgcctcagcctcacaagtaactggaactacaggtgcatgctaccaggcccagctaatttttttattgtttgtagagatgaggtctcactatattgcccaggctgatctcaaactcctgggctcaagtgatccacccaccttggccttccaaactgcgaaacttacaggcatgagccactgtgcccgccccagcattttttacagaaatagaaaaaacaattccaaaactcatatggaaacacaaaggatcccaaatagctaaaacaatcttgagaaaaagaacaaagctggaggcatcacacttcttgatttcaaaatatattctgaagcttcagtaattaaaacactaaggtactgtcataaagacagctttatagaccagtggaaagagggcccagaaataaacctgtgcatatatgaccaactgatcttcaatagagatgccaagaacagacaatggggagaggatgatttcttcaataaatagtgttggggcattgtatatccacatacaaaaagaacaaaattaaacccttactgtacaccatacataaaaatcaactcaaaattaattaaagacttaaacgtaagacctgaaactgtaaatccttagaagaaaacgtaggggaaaatcttcatgacattggtctttgcaatgatttcttggatatgacaccaaaagcacaaacaacaaaagcaaaaacagagcaagaggtatactatgtcaaactaaaaaacttctgtacagcaaaggaacaatcaatacagtgaaaaggcaacctgtagaatgagacaaaatatttgcaaaccacatatctgataaggcattaatttccaaaatatataaggaactcctccaacttaagagtaaaaaagcaaacaaactgatttttaaatgagtaaaaaatttgaatagacatttatccaaagaagatatacaactgggcaatagatacataaaaagattgttcaacatcactaatcatagggaaatgagaatgaaaaccataatgagatatctcacacctcttagggtggctattggtttttatttgagggggtttgtttgtttgtttgtttgtttgtttgtttgtttgttttgagacagaatcttgctctgtctcccaggctggatggctattgttttaaaaaaaaaagttacttggtgttattaaggctgtggagaaattggaacccttgtacattgttggtgaaaataaaaaatggtgcagctgtgtatatatatgtatggaaaactgtatagaatgttctcaaaaaaattaaaagtagagttgccatatgatttaataagtccacttctggccatttactcccccaaaattaaaattagaatcttaaagagatatatggaccccatgttcactgcagcaatattcacagtagccaagatgtggaaataacctaaatgtctatcaaaagatgaatggatacagaaaatatggtatatatgtatatatgaatggatacagaaaatgtgagatagatagatagatagatagatagatagatagatagatagatagatataacagaatatcattcagccttaagaaaaaggaagtcctggctgggcgtggtggctcacacctgtaatcccagcactttgggaggccaaggcaggcagatcacttgaggtcaggtgttcgggaccagcctgaccaacatggtaaaaccctgtctctactaaaatacaaaattaaccaggcatggtggtgggtgcctgtaatcccagctactggagaggctgaggtgggagaatcgattgaatccaggaggcagaggttgcagtgagccaagatcgcaccattgcactccagcctgggcaacagagtgagactctatctcaaaaaacaaaaagaaagaaaaagaaaaaggagtcctgccataagtgacaatatagatgaatcttgagaacattatgctaagtgaaataagtcaaccacagaaggcaaatactgcatgattccatttatgtgaggtatcaacaataatcaaactcatagaagcaaagagtagaatgctggttgccaggggctggcaagaggggaatacggggacttgctattcaatgggtataaagttttagtcatgcaagatgggtatacaacgtagtgcttacggttaacaatactgtacacttaaaaatttgagagagtagatctcatgttacctgttcatactacagttagagtattagtcctttttcacactgctgataaagatatacccaagactgggtaatttaaaaaagaaagaggtttaattgggcttacagttccaagtggcttgggaagcctcacagtcatggcagaaggcaaggaagagcaagtcaagtcttacttggatggcagcaggcaaagagagagaacttgtgcaggggaactcctccttttaataccatcaaatctcattagacttattcactatcatgagaacagcatgggaaagacctgcccccatgattgaattactgcccaccaagtccctcccacaacatatgggaattcaagatgagatgtgggtggggacacagcaaaaccagatcaaatagaaatagaaatcaaaatagacaaacaaaaaactagaaagaatctgagagcctatacttcaaggtgttttacctaagagatctgaggaaattacaaacatgatcaccagcactgaaatcttgaacttggatcaaagtaaccctacataaccacaaaatgacagggatataagtctcagagactttaaatgaatataacaggttcttgtagataactcatatacagagatccaaaaatgaaaaacttgttttacatcctattcacaatatgtgtagtacccttttcccaaatacttgactgataaaaatacatacagatttttaacttatccagtctattacagtttatttgccaactcttagttccctcttgtgctacgtttaaatttataagatgagtacagagactttttgaataactaatttaattaatgaattttaaagttaacttttgtagagttttagatacgtcctttggtcatacagtttagaaattacattgaaaagtaatctaatgcaaagttttttgtttttttttttaatttaaaaggtttgagtaaatctttctttctttttttttgaggtggagtctcattctgtcgccaggctgcagtgcagtggtgcgatctcggctcactgcaatctgtgcctcccggggtcaagcgactctcctgcctcagcctccagagtagctgggattacaggcacacgtcaccacacctggctaatttttgcatttttagtagagacggggtttcaccatgttggccagaatggtcttgatctcttgacctcatgatctgcccgcctcagcctcccgaagtgctgggattacaggcgtgagccactgcgcccagccgagtaaatctttctttaaaaattactgaagctgagtttaatatactgtatttatttgcatcaactcaaaattgaattttatgccacctttttggtcagttgtgaattgaaattttataactgaaattgtttacaagattatgttaaagtagggctgagagaatgaattttaaagtatgattcaaggttatagattaaattatgttcttatatattttagtcactttttgaactattacaaatatctagtaaattttttaatgctctgcccctttaattctggtcatgtaatttaggactgaaaggtgagctttatcttggaacaatattatctttcatttatatgatagcaaaaaaattaactatactgcctttattcaaaagtgcttaaaaacaactatatgtttactctctccacttcattattttcttcctcagtgcaaatatgtttatctggaaataatgtatgcattgtagcatgcagaatgtcaagctattttaagagatgcaacataatgcttgctataaactcttatattcagtcctcatttcataaaactctcatgtttaacttgaacatgctttcatgtaaaagctcaacttaaaagtgtgcctgtttggatgataagaaaaaaaagcaaacaaataaaataactacacctatcttgtactctttaaaatatatatgttggtttttaaaaataattgcactaagctaaacatgagaacctctatattagcaacttacattaaaagcaagtcttttttgggaaagcaaaataaaattaaaagacacatgattttagatcactgatctgagtacacagatctaatctctttgccagggttgtgtatactgtacacgacatttattttatttttttttttttgcactcacttattttgatccagtggatcttgacctattatcaagagtgagtgaatattgctagaagtggtcacttcagtatgacttaatctgaagacagagaaaaactggttataaaagaggaaatatattagaaaggagagtatttttgtatctagcaacctggaatatgaatgtaaaagagaataaacagttcaacacagaatgataaagggtgccattgagagggtcttctggagttggttttgcttcattcaactatgaaatgactacatgtattcatttatccctcccctccctcattttgagggtataataaatgtgtttctcctttttctcctctttcttcaactctatctccttgaaagagaataaacaactaaaaacaatgctgcacccccactcaccttgataagcagcatgagtctattaaattaagcatgcttgacactcaaacaccaattttagggacagagtgctcaaaatagaaagcacaatggtgacatcctgttaccgtctctttgtgcccttggactcataaataaagttctgcaggtttctgtgctcccttgatacaaaataaagaaaagtgaatgagttagaacaagctctggcagccatcagtaatgttgcaccccattgctgcaggacaggagacatccaattatggagcaaggtcagcctcagtctctaccagtattttctctggtggtcaagagaccctcaccccctcaccaccaccaccaccaccaccacgattcccttctacctgatggtgctccgggactttatttttggatccttcactgcttgacttaagaggaggaagacatgataggccagtcagtcttggctgggttgtgggaaaagtgagaggacagaaccagattggtcagtttgtgaatcttgtgatcagctacttttagaatttatttgttgttaagtttgaccaacaaatttccatatccttcatgttttctcacaaagatctttaaattgcctttcccagcttcccacctaaatacattcaaccatcataacacattccaaaatacagtggttgcccatggtttgcccaatactgggcaataggcactcagatcccagttagtgaccaatatacctatgggacacaaatcatatcaatgaggcacagctgcagggtgcatgtctactaaggatactgctcatctgaaccctcagactatacattctggtaccttagttctgtctcttggtgccctttcctgcgggtaacccacattcttattctctctccatgcggcatgggcactctctctcctgcctgagtcatagttcctggagcagactccacccccatgtttcagatcctgcctgagtccactgaatgaaagcaacaactcctgcgtgtcactcacaattccctggatgatactaaaaagcaatctttctctcattttcgaaacccctttgagatattaatgacttcctagatttttttcaggacttagagattatttcagaaataatcatataataagaagcattttgaattggagactcaaattgctctttagatcatactatataatcttaatgatgatgacgatgataatagtagctaccattgaacaaatgcctactatgctaggtgccttctatcttaaccatggttaattctcaggggcagtcctcaaaagttaggatattgttcctatttctcaggtgggggaaatgactttcagcaggagtaactatttttattcatcttatagctttaaattggcagctagattttgaccccatgtctgactcgaatttcattttatttccacaacaccattcactgcgtagagataagaactgtgagctggtctaataattttttcttcctgcaatagaagtccttttctaaaatttgggtcaactctcagcactcgtaaaaatatgcatataaaaagggaaagaaatggaggaaaatattttcccattaaatactaagacctactatacactaagctacagtatttaaagcacacaatactaggaccaattggatggattatgataaagagactagacactgacccatacataaaagaacttggaatattatagaggaaacacgaagaattaatgaaaaaaggaaaataaatgatgttgcattaattgaatttcaatatttgaaaaagtaaaatagctttccctcctgaaacaaacaaaaaattcagggagatattggatctcaatgaaaagaacatttaaatatattaaaaaacaaaactttaaatatattacaggaatatgaagataatacctttatgatatctgggtaacaaaaggcaaaccacgtaaattaagtaaagcaggattttttttaagtaactaaactggtacaatttataaagtacacatactcctttgaaaaagtaggtctcatgtgaatctgctcaaattccagggctgtattcactttcaccaaacactaatgacctgaggctattgtatttttctagttttcctgttaaaaagagacatgagagtgttgactctcaggtgtgagatcttgactgatcccacacctagcccaactggaggcttaaggctactcatcacagagtccttctggagccaagataaatgcctatgaatctcaacttttattcacagctttcaatattagattttttaatattagattttaatatttttcaatattagatttcatcatttcctgtgcccatttccctagctcaagggttcacttatctttgataagtttattggctagatgtatgtacgatgactcactctccatcacataaaacatacaattttgacagttgataaaaagatgttcgcataaactataatcatataattaaatatgtaccagaaacctaaaaaatagggaagagggaagctgatagtattttactcacatttaactaaaaagccatacattttaaatctatgaggtaagaagaaaaatcaggaaatctgcctgaacccattagtgactattcatgtaggatttttttttttaattttattttttttgagacaggctgtggcccaggctggagtgcagtggcacgatctcagctcactgcaacctctgcctcccgggttcaagcgattcttctgcctcagcctcctgagtagctgggattagaggcacctgccaccacacctggctaatttttgtatttttagtagagatggggtttcaccatgttggccaagctggtctcgaattcctgaccttgtgacccacccatctctgcctcccaaagtgctgggattacaggcgtgagccaccacgcctggcctcatgtagaattttatggtcacaagcctgtagttctagcagggaaactcaacacataaaaaggaggcctttaaatgcattgtcaagaatgacgaaaggagctaagtatcattatattctgatcaaaagaaaaggcaagtgtccatttccaatctctctttctctctctctctctctcacacacacaccccccagcagatttgtaaagaaaggtaaataaatcccccatacaaaaagtttccttttttccccacttgggtctgagagttgttcagtttaacctgagttgccattagtgtccttcgaagctataaattttgcttttccatgcaattgtttcaaaacaaagaaaatctgtgactttaaaattactttagagccaagcatggtggcgggtgcctggggtcacagctactttggacactgaggcaggagcattgttttgagcccaggagttctgcgtggtagtgcactgtgctgatagggtagtcgcactaagtttggcgtcaatatggttaattcctgggagcgggaatcatcagtttgcctaaggaggggtgaaccaagccaagtgagaaacggagcaggtcaaaatttccattctgatcggcagtgggttccacctgtgaatagccactgcactccagtctggataccatagcaagaccctgtctctttaaaaaaaaaaaaaaaaaaaaatggctttagaagcaattttacaccctaacttaccaatataggtagcggtccgactttatcgccacaggaggaaaaaataaaaagcagagtaaaacttacagagcaatggtagatacaatacgatcaatacaatcttcaaacccaacttcactgagcatgagtttctacacataaaagagattctttcattatttcttttttaattatttatttatttatttatttttgagacacagtctaactctgatgccctggctttgagtgcagtggcgtgaacacaactctctgcagccttaaccttctgggctcaagggattctcccacctcagcctcctgagtagctgggaccacagacaagcgccatcacacctggctaattttttaaattttatgtagagacaagatctccctgttgcccaggatggttggtctagaattcctgggctcaagcgatcctcccacctcgggcaccaaaagtgctggaattacaaggcataagccatcataaccggtccaagaaaatcttttagaaaaccccatcaaacaaatcaccatactatttaactgtaagtccaaacaatagtttcaatcgtaatatttgaagcaactagtataaaaagagaaactcataagctagcttacatttctgttgtcaaagagtaatttatccttgctggagttggtttggaggtattaatagccggaattatcccaacaatattctggcaagaaactatacacgtactttctgatgtgctctgatgtggccacagtctggcgctgagagtagctccaacatgagggactgaagcaaaagggtttcccaaagaagcactgtgccccggagactggaaggagaatttgaggaagacattaggatgaggcatctcaggggtgtaagagagagaccctggaaggcatttggggccatgacttaattataagctaggaattgcgtgtgtagaatttacaaagtaaacaaaatggcagccgagggtggggatagttcacacccttagtaaaggctcgacattatagaatctgcctcatactaggattcccagtagcttttctggaaataggtctccttcctctcctgccagccctaaaataatattggtaacacacacaccaacttctagagagcactcacaaaaaaagttgtcaccgccaagtgacctcactgcttctccctggagagctttgcagacagaaaatagctctgtgtctttataaacaaatcactctgtgaatggcagtgggtacacaaacatgtcgattctcttccagagttcttactcgctcaattgccaggtttgcttctattttggttacagaattaaaatgtaattagttgtgtttttaatgagtccaaatgtgacacattaagattcagtaattactctaaaatgataagctgtgattgaatgtccccataaacaagggacatttaaaggcagtaccatttcttgctcagttgttactgcttttaaaaccgtcactctttcctgggtgaatacagttttaggatttaaatgattacgctggattattgcacatatttacagtcagagccagctataccgacatatttaaagtgtgtacgttctttgatcatgtggccatgtctacctaagaacctaataactgactttactgaatgttggctgtccaggttagtacctcattatgacttactggcttttaagacacgtttattttatgtggcatcagtttttctcttcaacctgatgcaagacctcactgctatttctgaggttctttatgtccttagtgtttggcagggctcacatcaggtctagaaaagtggtgctagaggttcaagatccaatacaacaatggcagcagtaattgatgcacttgccccatacggaaatctgatctcttaacccacctgtttcctaggctaactgaatcagcagcatgtcagtagctgccaatgctgatcaatttcctagtgacattggtaacttaaaaaacattgaaatagttaagttcgttgtagaagtaagcctttcatcctacagcaaatcaaaaacaaacaaaatggataaatgttttctgataacttttaaaacagtttacctaagaggaggaattgtaaaaacttaaacataaattgagatcatcccacctgattttttaatattcgtaggaagcctgttcatgatattccagtcaactactctagaatcctattttggtatctcagtatctcgtgcagcagtgaatagcactgctcaatattttagaggcttcatatttccttagagtcacaattgtcaccctaaaatttagatctaataatcctactactgtcctgtgtaggaaaaaatacagaaagcatatacttcttatttcccagccttcaagtatgtgaagactgctatcaagaccactgtgtcttactggccaggcgcagtggctcacgcccgtaatcccagcactttgggaggccgaggtgggcggatcacgaggtcaggagatcgagaccatcctggctaacacggtgaaaccccatttctactaaaaataaaaaaacttatctgggtgtggtggcgggtgcctgtagtcccagctactcgggaggctgaggcaggagaatggcatgaacccgggaggcggagcttgcagtgagctgagatcaggccactgcacaccagcctgggcgacaaagcgagactccatctcaaaaaaaaaaaaatccccgcttccaacagcagttctcctggaaccctaccttcccctgaattttgtcatatttatcaatgcctttcttatggcaaccagaagtatatagagcagttcagttcacaaagggctgtaaatacagtaggacaatacctatctcactttactttggacaaccagatgcttcaaaacttgctgatggtagattaacttttcatgtaactttatttattttactgttggcacacacggcatttttgtgtaaagttttctaatgatttttacatgaaatgatgtccagttataaatctctattctataccttgaatttaaaccaacaatttttttcacttaatcctattgtattatgtggtgttgtttttattattctaatctatttaaagcatattaatctcactctgaaagctgtataaaaacctctaaatctgggccgggcgaagtcgctcacgcttgtaaatcccagtactttgggaagctgaggtgggcagatcactagaggccaggagttcaagaccagcctggccaacatggtgaagccccgtctctactaaaaatagaaacattatctgggcgtggtggcacaggcttgtaatcccaactacttgggaggctgagccaggagaatcgcccaggagacagaggttgcagtgagctgagataatgtcactcactgcactccagcctgagcaacaaagtgagaccccgtctcaaaaaaaaaaaaaaaaaaaaaaaaaaaaaaaagcctctaagtttggttcatctgaaaatttcatgagtctgcttactcttacaagtccttgctcataatattgaacaaaaatcaccaagaatagacatgtgacacatacaccaacagaagtctctccccagcagttcaataagtggaaggtactctagctagcatctccatcgttcaactgtaccccagtatatcaacaaacacattatgagtggttcaaatgaatgcttttctgaaatgatgccatcctcaatggggaagtttcccagtctatcaatctccatgcagcataatttgtagaagtcctacctttcatttctagatgctaatcgatcttctattcaatggaagatctagcctactggtgtctcattttttattcttcctacaatttagaaaatcagatcagcataagaactttatttttaacaaatattaatataaaagtattacgtgtttttctactgcccatatctgttctgtccaagccatgtacattcatgttaaataaataccgtcttttaaaacataaatagcatggttactccacattgactcctgatgtcccaagatgttcaagatgcagtaaggagaaatattattttaaaacaattcaaagggagtgaaaatggtagcacacaaaggaggcagcatttcctgcttctcacaagaccatctgcctgtattgtgggcaagattttttaaaaatcctaactgaaaagaaaataatgttaagagacatatgcccatgtttacaagctgagggaaattgacaagtgtgtctgtttcgccagtatttttacagtcaactgttatacataatggggaaaattaaaatcggtaattacttttctagtctgccattgttttaaatgtgcttggaattttccttaagcatccattccaagtaattatttgtaataggccagaacacttaaagggttgtagggatggatacacagctattttacaaagtgaaatactttgacaataacaaattatttttcctcctttctctccccaatgttggctgagttatgtttatacctcactttgtagataatccttctagctacactttttttaggcacagccattataaaaatcttctgtttgggcttggcactgcttagaactagaaattgctatttgctgcctgccaattacagaataatttaaggtttgatgctcccaggcacagtttcttgaaatacacagaaaaaaatatattaaggtggatgcataatattttttctgcattgcatagcttcaattgcctgtatagaattatatccaaattgctaaacaaatcaattggagaaaaattatgtcttctaggaaagtgttttgtaatggttttactactctttcttttgataagatcatagcaaatattttacaaaaattttatattatttgcaactgaatgatttcaatctatgaaatgtgatgggtataaatattgatataattttaacataaaatttaaacttctaggaaataatagaggaagatgtgatttttttaaaatcaatttggaataattaagaagaaaagaaaaaagagagttaattaagtttcccggatcttttcaagtctaaaatgcaataatttttcatctttgtatattcgtatctgaattatccatcatttgcagtacgaagcaggaaagcggtaaagcaaagtaaatttgtgatttaaaaggatcaagtatatggttgaagactcaaaaagctttttatttgggacagtagaaggaaatgtgctgattatcatgagaacaacaaaaaagagaaatgagttatttatgtaaccctgtcatcatgcctacaacacctcgaagggcagtcaggcatagtctgttatcaggaaaagcaagcaaacaaaagcctttatatatatatatatataactaatcacaaacatgctcagactccagaagatggtaaaataaaataaaataaaataattttattgacttctttcacctaggtgccttggttgcactccctggaaaccattcttcgcattccccacttacttctcttttcttttctttttttttctttttcttttttttttttttttgagacagagtcttactctgtcgccccaggctggagtgcggtggtgccatctcggctcatggcaacctccgcctcccaggttcaagctattctcctgcctcagcctcctaagtagctgggattacagatgcgcgccaccatgctcggctgatttttgtatttttagtagagatggggtttcaccatgttggtcaggctggtctccccacttttcttaattcacccctgaaatacactacccaaacacgtagcaactgaggtctggaaacttcattcttgacttcttctaaggaaggccactttcttcaaaatacagcaagacaaacacatctagctcctagcatgacttcagtgtgaaaaggctgggcttgggagagcagcaggtagacatgcctattaacattgtgctgccatgtttactttttttttgtttacttaaatcatggacagaaagccaagtgtataagtgaaaacccaagggacaatgacatggggtagactgcagaccaagaataagcaggaagttaaataccaagatattcccccaaaataaaccagatagcttggtttatatggaagaaaataaaccagagtaccactaacataagcatgacagaaggttttacacaaaactttagcagaagtgggtccaaatttcagctagtttcaggaatagttggtcgaggatggttctccaaagagggtggaattgtgctgttgatcagctgccctcacatgagcgatttgcattttcttggcgagaaatagtcgctgaagtcaagcagaagagtacgtgagaaggaatagctgtgagaccaggacaagccaaggccacagtgggatattctcagtccgtctgggtctctagatttacaaagaagcatgttgaatctgtagaggcaaatgggaagctcccccttcaccctctaaaggttagctgaaaatgagtaaatgacaagagggggattaataggaggaaaggacatagagaaggtaattaacatgcttagggacaggggaatcacaggaggagaatgacccaataatccagtgaggtcctgacacttatttgtatacccttcttcacagggacagggttgatgaggagtgtagggataaatgacttacaggggaaatgaataagcccaaagcacggtggtctgggacaaagttcctctgagctctaggacaggtggagggaaggtgagtggttgagcttcactgtaatcaaaggttatcttattatgcagataaagcctcccaggtaatctcttggagctgtcttgagaagaatagatgaaaagtctttctgggtgcagtggagactcccagtgtctcctcttctccagtggttaatctttcctggttgtttgatgagattcctagggaggaggtcttaagacaattgcatttccttttaaagggttttcctagtcagataaggaaattccggttctggtacagtggctcacacctgtaatcccagcactttgggaggctgaggcgggaggattgcttgagcccaggagttcaagaccaccctggccaacatagggagaccctgtctctacaaaaaaaaaaaaaaaaaaaaaaaattagttgggcattgtagtgcatgcctgtggtcccaggttctcaggaggctgaggtgggaagaattgcttaagccagggaggtagagaggctgcagtgagctatgatcgctcaactgcactccagcctgggtgacagagaaagaccctgtctctaaaaaaacaaaaaataaaattccagcaagagtagctcccaatgcttcaggaaagaaaagagatcagagtggggcttgggagggaacactggagagaccttggttctgaggcttatttctgatgcctttaatttcctttaattcaaagcatgccaaagagccatatttttggaggagtattttctgagccccaagaactcctcacaatgcaaaatggatgcctggctttcatttttttaaaatgatttatttaccttaaaaataaacttggattcatttgatcttcataatccctgtagataatttaggcttccaaaggaaacatggtctctattggcctaattaccaataaccaagttaaattccatttctgtacagaatttttttaaaatttacctcacaatctagaaagaggagaaaaaaataccttaaaaattaattattttcaaagccatgtatatgcagatttggtcatggcttattcagaacacattagaattattttaaattctaagtatcctcaatggtgaacttaaaatttcattctagggggaggggggcatggttaatgagtagaaaaaaatagaaagaatgaataagacctactatttgatagcacaacagagtgactatagtcaataatgactgaattgtacattttaagataactgaaagagtgtgattggattgtttgtaacacaaaggataaatacttgaggggatggattccccattctccatgatgtgcttatttcacattgcatgcctgcatcaaaacatctcatgtacccccataagtatatatacctattgtatacccagaaaattattttaataaaataaaaataaaataaatgaaataaaattttattctagccattccaggaaaaaaaaaaagccccattttgcaaagatgattataaccatatatatcatatgattatcaccttgttttcatacacacaagcatatatgtatgtatatatacatatatatttacacacacacacacatatacacacacacacatatatatatgtgtgtgtgtgtatatatatacagttgacccttggacaatgcaggggttagggctatgtcctgcacagtcaaaaatctgcatataacattggactccccaaaattttaaccactaatagcctaccgttgactggaaaccttacccataacataaacaatcgactaccacatattttgtatgttatgtatattatatattgtaatcttacagtaagctacacaaaagaaaatgttattaagaaaatcataatggccaagcacggtggcccacacctgtaatcccagcactttgggaggctgaggcgggtggatcacctgaggttgggagtttgagaccagcctgaacaacacggagaaaccccatctctactaaaaatacaaaattagctgggtgtggtggtggatgcctgtaatcccagctactcaggaggctgaggcaggagaatcgcttgaacccaagaggcggaggttgcagtgagccgagaagaaccattgcactccagcctgggcaataagagcgaaactccgtctaaaaaaaaagaaaagaaaaaagaaagaaaatcataatgaaaagaaaaatatatttactagtcattaagtagaaatggatcatcatgaaagtcttcatccttcctgtcttcacaatgagtaggctgaggaagaagagacgaggttggtcttgctgtcccaggggtgaaagaggcagaagaaaatccatgtataagtggactcacacagttcaaacctgtgttgttcaaggatcaactgtgtgtatatatatatatatatattttttttttttaggtttattgcaggaacaaaatcctctctccaaagctataatcctgactggctcaagatgtcttaagaaacttagaaacacagctaggaataaattacagcccaggctagttggttgttctcccggaatgagcgaattcaaaaggaacctggttatttagcaagaaatagactcagtgacctcagcagcattctaatgcatggaaaggtcagagaggtttcgtaccactctgctgggtcagatggaagccagagaagctgttggggtctccttgaaggttgaccctgggctgcaggtcaggaaacccaagtaggattccaggaatggattgctaagaagcttcgaggagaatggcttccacccatgactgagaattgaattgaggtccaggtagaatgggtagtacctggtcacagcccataagaaataagaagaggctatgatttgaattggtattaataacaaagaagaaaagcagcatttacttcgggcacaaggccagccagcctgctctcagaagctaaatgcaagtgacattttcttgtcaaatcccaacttttacccatcaaaggcttggggagaaagggaatccattgcaatgagttggttctgtagatagccctgcagaatcctggggggtgtttcacacgccagagaccaggatgggttgcggaaagcagttaactaccaagtatagtaagggaggcacagtaactcacctggaattgactttgcaagctgaagactgttttcaactgtgactgtgccattaggattaatgcaattcatacagttggctagcacatcagataaatatgatgaattgtccttatatccttagtccagtgagaactggcttttccatcacagcttaagctatacacatagagaggcaaaaaaaaaaaaaaaaaaaaaaaaaaaaagaccttacagttttgtttattgtgcttatcacaagtgctggaaactcacattttcattgctaatagccctctttgaaagtttgttgacatttcagctgatctttaatgtgctctactgttataatacccttgggcaaagtcagtttccaataggaaaatagacagcttctgggtacccctgtggaagctgcacaaacacaaacagactggcaccccagcctgcaatacctggtgagctctgctctgtccgaatcacagaagggtggcagaatatataacctcaaagcatgccactttggcataaggattatgttgaagtaaaggctcttgaaaaatagcagatacaagaagagcactttgaccttcctttttcttcctaaaagcaggagataaatctccaggggaaagttgttgtccctgtattgggaggaagaaacattcttatcaccagagatagggagtgaaggtcaagagaaatccgtaccaaaaaactttgttaaattaaccttatctgtctcttcacttttctacaattaactgctctggcccaagcctctttgtcttgccatgttttcacaaggtgctcctcttcatccaacttaggatataagcatctgactctaactgcttctttgggtcttcattttcctatgtgaattcccatgtccatttaaaatctgtatactcctatcttggtaattatctgatagcgatttaattctcaggcccagccgaggactctcagagggcagagagaaagttgtgccttccaggatcactgtatttgggagcctggaagacgaagaatggagcccagtaaatagagagggaaggaaagacatttaaacaggttcctaaagagaatgtgaggacacgtaagaacaacagtaagaaaaagtacagaaagaaaaatttacaatctattctacagagcaaattgaggtatttcttctgtaatagggaaagaggaaagagaagattcatgactgaccatcagtaggctttatagtggagagagaattgtccaaacctccgtataatcaagcacatatcctgattcttagaatatatgttccaaactaaattaagaaagggtgatgctggacagaagcagttattaattctggggtcaacaggataaaaatagtcagaaatgaacgttgtggtttgggaatataagcagctgaattcaaaataagaattctaatagaaagtgttaaatcaaagagcagttcataaagtcagagctagaccttgggtggggggaagagcaattcaaaaatttagagcagcatgtatcttaaaaataaattttattgaaaaatgagaacacatggacacagggaggggaacaacatacaaggggggcctgtccgggggtagagggcaaagagaggaagagcattaggacaaatacctaatgcatgcggggcttaaaacctagatgatgggttgataggtgcagcaaaccaccatggcacatgtatagctatataacaaacctgcacattctgcacatgtatcccggaacttaaagtaaaattaattaaataaaaaaaaatgaaaatgaaaataaatgttgttatgagaactcatagtggcatggccccaattttagaaactgagcttaatacagttaataggtaaatgttagatgaatacctcaaactgaatgttaatgccaaaattaagatcattctttggttcaaaatatagagcatgtttatatcttaattaaaagcagtcatacttaaatctctccttttcggccaggcacggtggcccacacctgtaatcccagcactttgggaggctgaggcgggtggatcacctgaggttgggagtttgagaccagcctgaacaacacggagaaaccccatctctactaaaaatacaaaattagctgggtgtggtggtggatgcctgtaatcccagctactcaggaggctgaggcaggagaatcgcttgaacccaggaggcagaggttgtagtgagccaaggccacgccattgcactccaggcagggcgagaagagtgaaactctgtctcaaataataataacaataataaaataaatctctccttttcattatttatagaaaatcatagtattttggcacattaaattgaacatatttctttaagtaattaaatgtacgcctatcataatgtattcctcctggtacttaactatcatagattattagcagtttagtgtttaaagggaactcaggactgagagttttaaaaacttagactcacagtaagaaagtcatctcatgttgatgaagtataaatatgcacatacacacacagacacgtcacatgcaggtacataactaaaatgaaagcttcctgaaataatacttatttacactttgtacagaatcgaatgcactttatttcctagtctttgcattttaaaaatatacttattttttttaatgctgctcctggttccccaaattgaaattactatctaccaatgtatctcaatttacagtttggaaaacactgccttagggaatagctagtctaattttgcacctgagaaacgtagagatttagggaatattcccaaggtcacgtagtatgtggcaaagcaagcctgtgctgtcttctaagttctggcgtaatgagttttccccaatcttacattgttacattgttttcaagatgaatggtcatgtatagtgtactctttgcctctcaaatttgatgaagtaagcattattccgttgctacgtgtcttgctcactttgcgttttcttagtttcataggaagcatcagttgtgctaagttttatttgtgtgttccattgtctcttccccctaaactgaaagcttcctgagaatagtgtgtattcttatcaatatcccctaaaccaagctgagtagtgtgaatgattgaatccttagaaagacaagctcatgtagtcaaatagtctaaattacatgagtgggacaaaaatatcagcatccaggtagccacagatgctcttctttccttctaagaaatacgattctcattccatacctagatgatgggttgataaggtgcagcagaccaccatggcacacgttcacctatgtcacaaacctgcatgtcctgcacatgtatcctgaaactttaaattttaaaaaaggaaatatcaattctattggttatgctgattagagtaataagtggagagggaattgagaagttctaagacaagctgtgttagtatcctagggctgcagcaacaaagtaccataaacagagtagcctaaagcaacaaaaatttactctctcaaggttctagaggccagaagcctgaaatcaaggtatcagcagggccatgatctctctcgtagcttctggtggttgccggaaacccttggtgttcttggcttgtagacacatcgctccaacctcagcctctcttgtcacgtggcattctctctgtgttttctgtgtccaaatttcccccttcctattaggacactagccattggattagggcccatcttaatcaagtatgacttgattacatctgcaaaggtcatatcgagaagtaccaggggttagaacttgaaaatatctttttggaagacacagttctacccaccacagaagctacaccaatttacatgaaaaagaacctaagtagatctagaagagttggagagagaaatgggatagaagggagatgagcaggaagacatgaaagcaaacaaatgagttatcttcaggggagaaaagtgcttgtccagtgtactatggagagacgcataaatgaagatgactttaatacattctgctttgcatcatgcaacataactttttttcttttggtgcctctcacagagacctctgtaaatcctaaattatcttttaagactttgttcaagtcagattttttagagttatttcagatgttatgttattgcaggaagcagctcacaagtgacctagcattaaagataataaaagctaatgtttttatgtgagtagaagatatagcattgcatttaaactatagtttcaccattatacagaaggaaaagaagacagcaagcagaagagacaataatgatatattgaccttactgaaagatgatgacataaagcagtaggatttatcattttttgtaagttactgaacattgattcagtgttatgcatcttgttcttctatatattaagcaattatgtttatttctagcactgaaaagcatagttattttcagccaataattgctatttgaatgctatagttaatgtttttataatttttagatgacaattttattttaattaactctcttagaaacaatcatttatttatttgctcagcaatatgtgttcagtatccaaagtgtgttagacacaattcagtatatccgtcccctatatcgagagtctagttagagtgagttaacaaaagcttttattcatgggaatttatagtataaaagtgtacaatagtataaaaaggctgaaagatttctatagtgatttcactatgaagagatctctctgatatttttcttccctttcaccttatccagtctccaacgtttctgtaaaaaacagctacacccacttttttcttcctgtcaggtgaatccagatagtgcagcaaagttgagccaccgacactgaatttcccaccacaagtgaaacagcagaaaaggctttccaagttcactgtagggaaaataaaagccatgtgatatttattgcacatccaagtatatggattaagattaattcctctggagcaataatgatcacactttttaaatcttacaactcgttgatagtcatcaaaattgaagatccaaaaagcttttatttttatgagttttacatatcagaatttcatgtattagaaattaaaactgacaaactttaaatatttattttaagacaaatgatatactttaaatattaatttaagacaacattaaaaaccctctacttattagcataacatgcttttattttttaaaaaaactacattattccaaaacaaaaaaagattaatgagaagagtagtgttgttccattacacacccatgagtgaatgagagtgaaaaaggaaattgatgtcttaatattattatgaaaattatttggtccaatagttaatggatcccctgaaaggtattcagaacccccagttgtctcctggccacatttagagaatttcagccctagaatgttctgatatgtagtggaggaaattgattctatagtacagaatcagagggcaactcactggcctgctccccacctcagctatcatatgatgcacagtccctgaccaagtggatcggaaatgtctcctgttgtaggtcaaggtatccctgagaaccacaaactgagatatggacaaaagagcaaaagcgccgtgcacatatcttgagatgcaggttaaagaacaaaacaagaatgcatgtattttatctcaggacactaagtctccaaagaatggcttgtgatgggggtacagacttgacccaagaattactgactataatcaaaccacagtttaacagaggtgctatttatagtgaaaaattttcccccaagcaagaattccatagtaaagtaagatcacagttgcacactgcaaatctttaaaagaaaattccagaatttatagcttacttagcctacttagctacttgctttgctcatatataccagttctttcaactaccacaaaaataataactatttgaatatactcaataaacaggcattgtgaaatttgaattttacaacatagaatttggttactgttcctgttaaaacacaaaatacatgagtgaatatttatgtgtatatttttcaataatgttttccaaatgacctttggagaatatctcaagatgattatttctttggcagggggcaaaaaaaaaaaaaagctatcagtgagataagcacatcaatcgaactgttttcatttgagccatgtttaaatgagctaggatgcaaaatagaaattctggaaatatccaaaagaaagatgtacatgtcctctgatttctcctaagtctggacagaattggcagcagaggctctaatgaaatcttgcaattagtctgagaagcccattcagagagcttcactgtgttcagccttctgccgctgacacccttgcctgaagacacatgcccatatcgaagcacatgcagatgcctttcctcatacctagaccctgaaatgaccatggaccgcaggattctcatgtgagatttcagtttactgcttaatttttcatcttgattggacttttcatccatcatatcaggaaaagctgaatatacagacccagacatagataggtttggggacaggaagaagatttaattctacttagattgatcccattttttcttttcttttctagaaatgagtgagatcatttgctgatcctgaggtgtggagggaaaaagtcttggctagaggtgtaagagaatgtgtggaagatggaattgactaaagaaagtgatagggttgtcctgcaggtctgaggacccaggtgatattcatggtctccatgtaacgcataactggtcagcaccttttgtttgcttgtttttctccaagttttactgcttagatgcggtaaaataacatctggcattcccagagttggttttccaagtaatgtcacttactgaggcaggaaggagaaaaggtgtttgaggtttgaagagacaggggaaaaagtctgttaagagaaaaggagtgaaagtgaccagaaataagttagtaggattgacaggaactaaatgggttagcatgggttagcagagaatgagatgtaaactctgttggggttttgctgacaaatacgatggagagagctgaagttgtttgtttgtttgtttgtttctcaaagatgtgataattacagtgaaccttggaatctaaactaatgaagaaaaggagtgaggacaagagagtgaaaaagtgatagtcaatgaattgaaggtcccaggagaagaaatactgtatttgagaaccagagtaaatgaaatggaaaattaaaggcagtggtcagaagtcagcataactagaataaaagtttgaaaagataatgactaagtcaagggtatcaccaggggagtaggtggctgaagtgcaatcggatgaaaaaacagtgggaaacgagatgctcaaagaaatgggaggttcgtaggtcactgtggtccagaattgcaatgattatgtattcagttccggttaaccaagaaattaagcattttgcaattctaaaatcatcagttgatatactaaaattaaagtctaaaatgccatgaacattatgttagatacatatatattaaatggaaatcaaattgtatacgtaaaaaaagatataaagaagaaatatagggctagacatagtgtcttatgcctataatctcagcactttgggaagccgaggtgggaggattgcttgaactcaggagttggagaccagtctggacaacatgaggagactctgtctctaaaagaaaattaaaaattagccaggtgtggtgtcatgcacctgtggtcccagctgcttggaaggctgagatggaaggattgcttgagccttggaggttgaggctgcagtgacagatgtttgcaccactgtactttagcctaagtgatagagtgagactgtctcaaataaataaaccaataggacatattaataaatactgtgatcttaagcaaagacgctttaactttctagagcttagttttctcatctgtatcacgagtaatttgaattaaattatctagaagttaattctttgcctgaaatggtttgtttcctttatccaatattactcattgattataatgatcaccaaaaaatgaatacttacgtgaatactagagaaaaaatattgcttaattttgaaaatacaaattgcttatttgtagaagctattttggttttatttgtatgtttatttaaagtttgcgagggaaccagggttatcaggatcactctgatctgaaatctgagatttgggtaatctcacttctatccaaaaatctctaggacatcaagctcatcaaggtcttcagatgctcatgatgcattaattgccctttgagaataactgcctaagagatggatgtttatattgattttatggtagatattttcttcttcatgggagtggaattccttttacaggttgattcacaaacctagagccaaaaatataactgaactattacagatttaaagtatagattgcataattttgtaaaaatattatcatacaaattctaacatatcgtgagctgaattatactaccacaactaaaactcaattacttataggagtcagacgtatattctaataagacagacactgaaattgctatttttgtctgctggccaaattaactcccaactcatcagtttgcctcccattccctaaagccttgtgcatatgaattacctggcactattgctaaatacagatttttttgcagtaagtgtagggtggaatctgtaattccacatttctaacaaggtcccaggtgtgtcagtgcaacacatctaaggaccacactgaacataactctatacaaaaaggctccactttttattaaactgtgattctgaaaacccaagtagaaatcaggtttttaaaaacttatcattcctttctttggctgttgagacttgtatttctccatgccatatcagacaaattgcatttacctggttccctctgaattagcaatcttaggaacttcagctactctcagattctattccgttatttcagagttcccagtggttggctcaagtgtgagtgcacattcaggttttccagttgcctcatagcgtctttccatgaccttctcccttattccagctcctgcttgggtgtctctggcaccttcttaggacagatgtgggttgtccaatgctcaggacactgaatccagctcaagtacccaccatgagtttgatgcaaggcaagcgagccccaaagtggggcttagcccatgagggttcttggcttctcccaggaaagaatttaagggcaagccaatggtagggtagaagaaaacagctcttatggaagtggccgtgttacagttctgtgattgctcccacagagcagggctaccccacaggcagtgtgctgagagtagcaactcggggcagttctgcagtcatgtttataccgaccttgaattacatgtagattaaggagcagcttatgcagacatttctagaaaaggggtagtaactttggggtcatcaggtcattgccatgggaaggggtggtaacccccaggtgttgccatggcgatggtaaactgacagggcatgctggtgggtgtgtcttatggaaagctactcctgccccagtcctgttttagctagtcctcaacttggttcaggatctgagccccacctctggagtcgagtcccagttggtacctcaacttcaagtgaagaaagtcacttaattcagttttttgttgcccccttaccaataacttgaaaccatttgagtggcctctcatcctattcaaaactactcctttcccttaagcctaaaacattatccttggaataagcctcagcacctcgactctctccttcctttaggctcagagaactgatgactacttcatgccaatacatccttggcaagccacctagtaggctgccattcccacagcaagcccagcagaaccatcagagtcatggagtggttatagtttaggctcttaagttggaattcccaaggacactataacatagtgttcctgcatgggtgagggaaaaataataactggtttttatggagggctaggagaggtagatgaattacctggtgcaaagccggagtcagcatctgtaactgatgagtgagcaggacaagttagagttctatgaggaagctttatgccgtcactggcaaaatttgaggcagcaaaatgcaaaggaactcaataaatggtgagatgattaaccaatgaggtggtactgactccagcagtggtgttattgaaagttcaggtatattcaattataacacattttaaatcttggattgcctgaaatcagcctgccaaatatgagaataatccaggcagacaaggacaaagaacattacacaataatgatactaataggcagtgtcctgtacattgtaattgtacaatagtgacagtaataggcagtgttttccagcatcaactggagtatcatttcctatcccaagtaagttaaacacaggatgagctcaacatcctaaggtccagaggagagtggacggtagtgagttatgctgtctccctgtggtgcccagggactctctctctgtcaaagatgctgtatctaattacctaggctctttctttctcctttcctcctcctttcctccctctctccctccttctctctctctgtctctctctttctttctttatgccctagaaataagtctttttcttctttcccagaaatcatggtgataagtagaagcctgcatgcaggaaattattgaatataacaaaaaaacatagttggtgaagttaactcaagacaaaaattatatacaaagaggtaattgcatatagattagagaagtccagtgtattccctttttgtaaaacgccttctgaatcgagtatcttttgattccatacaattctgtctcccctcacatctgacctattcatgtcagagatctcctacctggctcctttttcatctagtaattaatttatatccctgtcctaacttctatctcctgctcccctcaacattatatctctttttataactaggatatactcaaatgaaaaaatccatgtatcttactatcttctgccttcttctaaatagttgtgcttccttttgatctatttatttgctacaccaggaatatttgacatttcctggagaagtaggaatctcttgtatgctcatttgaaatgagctagtgtggttatttaacaaatatgcagagcaacaatgcacaagatgatcaaaagatatacgtggagaaggaagttctctatttcacaccactgagttacattttaagcatggggcttgtgaactaataccactgttcaccttctcaaaagggcatggtatttaggaatggcattattacagttttctacagttttccaatagaagacattaaataaatgagagaacatttctattgggcaatattaaaacctttacttccacatccactgctttcgccagcttgaacagattagttattcccagtagattattctcattggtaattctgtaataaaagattctagatattgtgcattttcatcactggcattacaatttttatttcagaatcttggtcatcgaatattcattatctaattataataaaaatgcatgattcccttaggaatgcctataactaaatgaatatgaactttattaaaggaattaaattaggagattaaaattattcaaagggggtaacaactttattcttaaagaactgtaggattgcaatactaggaaagaaagagaataggaaaggcaacagaaaagtagtaaaaagaaacagaaacaaaacagatagatccctgatgtgctatgatggggaatagagtattaatttaattattcagttataaataaactaaagcctaagcctagtaaattatgtgctccttgaagattagagttaggactgattaatctttgcattccccaccagaccaggcagtgcctggaatgtagtggacactcaataaatttttgttgaattaataaggaagcaaattctatatgaaaatgataacaagtttatgagtactttttcaagtcagtttgcagatacaagtttaaggaaattcatactcggatatagttagaatgtgtatactgaattagaatgttagtctatgtgctttgggaattaattttgaagctcaggaagctatgcaagaggcagccaagctcagaggaagggtgagagacttgatcagctgcccctccctgtcttgaactatttcctgttatagatggaaatcatccttcattacctgggaaaaagtatgagcccaaagcagaattagccttctttatacatgtgttgaatttgtgttcccatcatattaagtattaaaggaaatgattatgagctgtttgttggacagtaaagggaagtgataatgataattttaatatagttaacattagcttgaaacacatgaaactgatatttttgtgtgtaaacacctaagtgaatattgacaatttcacatggtttaatttaatattgatcaaatgctacgtggtaggcactgtgctaagtaatgtatagtccattaatttgtttaaatttcatccaaaaagctttgtaatagatgaggaaattaacaataagttagggaacttgcccaacatacaaagaggacatagaaggtaaacagtttaacatcagagtcccttttcttaaacagaatactatcctgccagggaaaatatggatgtcataaattatgttatcaaaatcttgccttccaatcacttatttatgtcaacaaaaatgtgacaataagatataccatggttaattcacagtgcgaagtgtctgcttctagaaaggtgaaatttgcttataatacagttattattataccactgcaatatcgaggtcaagttctatggctacaaaatgacataatctttactcaagaaggtcacattgcagtaaagaggacataattataaagagtattacatcactagagttagatttttttttgttggtcaaatgactcaatccaaaaagtaggatacatagtaagaatgtgctatagagacaaagagataaatatctgaaaccaaggccccagaaaattaacaatctatgtcaaccataactgtattatccatgtgagtcaatttctatgggaaatacagttctgttatctatggataatacagttcttcctagaggaagaagcaattaattgatcttggaggggtcagggagagtttcatagaagatataacaactttacaaggcttgagggatgagtgggattgcattaggcagagaaaagaagaaagacatcctagaaaagggcgcaacatgtacaaacagaggaatgtgtgacagtaaacagtcacgttgaggaacagtaaatggtttatgtggctaggaggcaagtttgataccacattatattctgtattcctaaaacacccagacacgcgaaatgctgaaacagtaacttggactcttttgtgaagatcccaggactggaaatttctactgtgtcctagaaagcaatgataagccaacgatgctgtttccttctcgagctataactttcatagagggaagtgcacacatcttaaatggacagcttaggcattgttacatattagtatacccatgaaattatcacccagatcccttgcttggaagaccaaatgtcttttttcccccctcagaaatttattaccatttttcagaattaatattttctaaaacccaatataaaacattatatataaccattatggactgaactgtgtcctctgaaaaactcatctattaagccctaactcccaacatgattgtatttggagacagggtcattaaggaaattatttaggtaaaatgaggccacaagaatggggccttaatgcgatgggggtggtgcccttataagtagaggaagaaacacaggagaggttcctttctccactttagttcatggaaaggccatatgaggacacggtgggaaggtggccctccacaagccaaggagagaggcatcaccagaaaccaactctaccaacatgttgatcttggacttcaagctttcaaaactaccagaatataaatgtcgtctaagccacccgatccatggtgtctcaatacggcagcctgagcagactaatccaacagtctcgaagaattaaatttagaattggtcatcaagattttgttcacctcaaggaaataaaatgactcaatcctccacggatttgtttccatcattttcctttcctattttcagattatttgcaacctggagactgccctgcaaaagcacgtggcaatttccccttctggatcctcacaggagaaaaataaattcacattaacaaatattcagatgctttatttattctgaaaaaaataaaaaagtgaaattgctaaattgctaaattgagtttttcactggtcaaaatttacatagcccaataggtgtaggctccttactccttttgaggcattttctctctcttgattaacagtgatggatttttattgccccacttctgagaggaggatttatatgtcttttaatctgtgtaagttggactgaatcataaatggttcaccctctaaattacagagtaagtttgccaatagagatgaccttgtttattaaaatctaattaactgaagttttagaatgtccctgagtgggttgctgaatttctgattttctccaaaccaatatagatcaaatatccagctggctggagttaaccacaaagctctgaacctcactgtgaaattatctagttaattcctctttcagacattttttccaaaggtacaagcccaagaatcctttaatatgttggccatcctatttcagaaaagccatgtgcccaattatgagttggagaaagaagcccaggtgctccttgttcactgcaactgaaatgagaggaccctggagtgtaactttcattccccagcaatggtcagtcagaatgtctctgatcatgtgccacttttcatcttctggacaaagttctatgctgcctatacacataaggcagtaatattcatgactttttactgccaaccttggaaagcaatgttggcaaattgattacagacatatgggataaaacataattaattgattcagttcctagtctatatacaaaattgcttaatgctaaaactcctctagtttctgccctattgcttcttccatttctcattccaactttaagagtttaaggtttgtctcttctctctcatctcccatttaattatcagctattgaactttttcttcatgacattactagatccctttgtgtcccgtccaccgatgatctccatattgatatagctgatgtacatgctttaattttttgataacggacatttttgcaatatttaacataatataccacctcactcccaccccaccctccagaagctctctgttcccttggcttatagtacatataattcttttggttccttcagaattttagatcctgtattttcaacttctttggttcattcttcttctttcatgctgacactgacagtgctctcaaggctctttccatggctgcattctgacttgcatttagtcccagtcactgagagatattttgaagttctgtttttatttgggccacctcaccctgaagagtaagtacttttcattgttgtagctgaggtggtgtgcctttttcaaacgtctacgtcccacagcatcttcgagatattgataacataaaaacaaatatcgatcatcctaagggccttacagacttcagagatgggtaaaagaaaccacttccaccttcaaatcagtcttttgtatccactaggggagcaaaatgacctgctgagttgaagtgggaataacaaagtatctcaaagatgatgtgatgtttgtagagaaaagtttgtggcagtaatcgatacaggaatcacttatatggatctgtgttacttggagggggctttagaaatggcatcaagaagaaaaaaagcaatgcttcttggtttaaaaaataatgcttttatcattgaaaaatagtaccttttaagatggccaaatccccaaaataaaaattcaaagcatattgtacttccttctgaggccaaatgcatcagaactaatgctcttttgagaaaaccatgctatttaagcaaaaatttagggagtggagagtccgattattgtttttcatgagtgttgaagtctatggaaacaatgaaggaatgtacagaaagtaaattagataaagatttgatttataaaaattgtccaggtttagaaatttttatatatccaaacagaagtcatgaattaggtttccccaggctgtgaactagactaaggtggcatgtaccctcacattccaaagctgagtgccctctctgtccgtgtcacccagttaccctccttgggtgacataagagaagcccaacaattcctgggggtgtctcagagtccagcaggaaagatttatttgcagagttgagatgtcagcatattccgtctgcccacaaccatcatcaccatcatgggagtggactatcgctgtttagtttcaagggaaagaaacatggatgtgtggaatgaagccagccatgagcaacctttaaaggcacccacccaggggccatcaaggcaagagtgaggaggagtgtgaactgtgcagaaacagaggggagttgtcagtggctgggtgcacatggcattccagtttctgcacttatttattggttataaataacgcttcagaaacaccgagaagtcctagactattcactctaattttaaaagaatactgggccattataagggaagattttccccttgactacttttgagatgccaggagttggccattaattgctagatatgaaaacacatggaaatggcaaagaggctacacatcaagcattccctctactaatcatgcaaatgagtcatgatgtacaaaatgtaaggaactcctgtttagggaaaatatgaatgtagatgcacaaagtaaaatgtatgtagtccaaattagtcttctagccagtaaggcaattttcctatatgataaaaagaatggatttttatatcatttaaaggaaatacattgaaattattttagaatttaaaaaatgtaaacatgcatctttccttcttaaactctagagtatcggagatttgatctgtttttttctagctcagctattaactggttgaataccttagtctaggcattgttttattcctagtctattacctctgaaaaatgagggtagtaattagattatctcccaaaatattactgttctaattgcatgtggggaaattgcgtagaactacaaagtcttgtcatacaacctacattaactggttgagtaccttagtctagacactgttttattcctagtctattacctctgaaaaatgagggtaataattagattatctcccagaaatttactgttctaattgcatgtggggagactgtgtaggactacaaagtcttgtcctcaaagggctcacactgcatatctacgtgaagaaatattggcccagataaactaaccaacttacttttacatagagacagagccaaggtagggtttgcctttgcaaatctaagtcttgtacccctttcaccacgttaatgagatatggatcttctaattaaatattaatttctaaagaaataataagccccaattacagaaaaaaaaagatactaaaaatatttcaagagcattcaaggagcttcaatacaagaaaggcttgttgttgggtttttttcatctctctccattgatagttaagtacatacgggtagctattttagagctgcgcctagttaacgtctatgtttattcatgtatttattcaatcatgaaacacgtggagccggccacttttatttgaatccactttaaataaacacttttgtgttgattgtacaaagttccatgaaacaatatatctgccctcagggaacttgctttccagaaaggcaaatcaaagaaaaacgttttgcaaagaatcccgaaatggttacaagggctttctaagagaagtctaaattgaacagataattgtctcacattttgtaaaaggcctagactattctcactgaaaagcagtaattgaatctgtaattactttcatttcactggggacataggcatggattctaaagatctcattgtcatggttgttttcttaatcactctcattgcttcctagcaacactagcttccttccttccatgcaggaaagctcaacagtcaatggtgggcaaggacactatgagaaacatttaatggcacccacccaaggcccatcaaggcaagagtgaggaggggtgtgaacagagggacctgccgcttatttgcctttctgatgatccagcccctgtttgttttatgaacaaaggctttaacttctgacatagaagcgatttttgaaaatgaacgtaaaggaactggcaaactcagcccatgggtttcccttttaagaacatgaaatcacctcctcataatcatttcagtgatgccaggaacgttcctctctctctcccattcaccctccaccattcacagagatttgatttctagaattttgtcaaaagacaaaattgcacaaaaaattaaagatctaattggcttttattagcaattctcaaattgggcaacaccccactctataaactggaatagctgtcccagtgccctgagtagaggagattggctttataggcagaaaaggtctgaagaaagcagaaacaaggaataaaaagtggattggtcatttcaaagttactttccttgtagggttaaaacagggggatctcttatcatgccagctcaggcaaactggtctccttctctctttttggttttgacaaaatgtcttgctctatatggtggtatgatctcagctcactgaagcctcgacttcctaggctcaagcaatcctcccacctcagcctcttgagtagctgggacgacaggcatgtgccaccatgcccagctaatttttagtatttttggtagagacagggtttcgccatattgcccaggctggtcttgaactcctgagctcaagtgatcctcccatcttgatctcccaaagtgctgggattaagggatgagcccccacgcccagccaaactgggccccttctgattgatgactatgactctcctgttatttggaaaactggtggctttcaaagttcacgttagttatgtggcacctagcacaagtgattgcatgttggtttggtctgagttgttgggacctactgcagggcctactccaaaacaatggcctcccataaaccctgtatgacagtctcattaaggcattgcttctacttaactggtttgttaagtgggaggtttaaggtttgtcacctttttctctgagagcaggttttagtagagacttggacagagggcatgtagcagagaggatacagaaagatggagctgagaacaaaataaatacaataaactaaaaattcgccatacttttaaaaatatttaacaaaaactaactttggcttgagttataggtttcctctcctgttttatgtgcattagatacacacttttaacaattagatagtttttggtattaaccatgaagtagcatcttatttctgggtaaagtctgtctatttttttaagttgttttaaacttttaaaacattttttagttatgaatttattttattttattttattttatttattttattttatttttgagacagggttctgtcacccaggctggagtgcggtggtgtaaccttggcttgctgcagcctcaacctcctgggctcaagcaatcctcccacctcagcctcccaagtagctgggagtattgatgtacaccaccatgcctggctaattttaaaattttttatagagacagggtctcaccattttgcccaagatagtcttgaattcccacctcagcctcccaaagtgctgggattacaagcatgagacaccatgcctggatgtgaatttttatttaagagatagaaagaataagaacaacccaaagattatttaatagaaataactagacattaatcaaaaatctttagtgtaagccattagtaaaataactttccaggaaaattcttataggtttttaccttttgacctactttttctaaacacttgctatggaaaaagtacagtgtatttgaggatgattgttaggaggcagaaaaggtggagaaaagagaggctgggctcagtggctcatgcctataatcccagcactttgggaggtcaaggtgcgcagatcacttaagtcaggagttcaagatcaacctggccaacatggtgaaaccccatttaaaaacaaaaaaagatggagaaaagagatacaaagatttagaggtaaagtgaacttaattgtctgaacaagaaatcaaacaaaagactccaaaaagtttagaagccatccttgagatgcagatttaatgctaaaaatgttggcattttcagaatattacaatgatgaatgttgacagtcaaacagaattttattgttaagcttgtcctggaaaaaccaagaatgtttgattgtctgtgattgagacacagtccctaaatctagtttggaaaagtgacagatgtttcaggttgggatacaaaagacaaattctaaataaggaatgaaggagagaaggaaacatggaggaaattggtgggacattctgtgccatttaaatatcttgactcttgttaatgaatgtctatatagaggtcaaaggtgaggaaaacagacaaatcatgggtatctaagaaaggtgtgttttctatccaggaagaaaggtcaatggaatacataaatatagtgatataaactttaaaggtaggaaaagcccttaaaaacagagtcagtaaagattttgtagtccctggttcatagtcacaaagtagaagacaccaaagccaggaaatacaccactttgtagttcattaccctgctacttctagtgagatgtgtgcaaaacacttgtcagaccttattgccaattggcatttgagactatctacagttcttttttttaataacctcattgaagtataatttaaataccataatattcatcgattttaactgtacattaactgtacaagtgtacaggtttttttagtaaatttttagaaaattcattgagttgtgcaacaaatcaacacaatcccaacttaggacatcaacattatccctatacgattcccggttaccatgaatttctgtttctactcccagcccgacaaccactaatctcctttctgtcctggtagatttcctttttcatatcagtaaaattagaatatgtgatttttttgtgtgtctggcttctttcacttagcataaggtttttgaggtttgttcatgttgcaacatgtattcagatttcattcctctttattgtctaataatatttcattgtatgtattaccatacttttatccattcactagttgatgggcacttgcgtgatttccactttgggcctcttatgactaaatctgctataaacatctacctaaaaggctttgtgtgaacatatgctttcatgtctcttgtatagatatccagaagtagaattcttgagtcatatggtgtgtctatgtttaactttttaagaaactgccaaactgttttcaaaaatgactgggcacagtgtcactttagtgtaatccaagctacttgggagctgagacaggagaatcatgactttacagcccaccccccgagcaatgtgtgatgattccagtttctccaaatccttgtcaacacatgttattgcctctccttttgattatagctatcttggtagtgtgaagtagcatctcaatgtagttttagttacatttgcctaaggaatgatagtattaggcttcttctcatgtgtttatgttgtatttgtacttatatctatgagatatcttctgtagctataactttgacttcctgaattctgtccagaaatttctagtttgggtgatgctgtgatggaaatgcatgaaagtatgcagagtaaacattttttaagggttactaaataatcctgaaacttcacaaaagagaagtccatctactctgctagaattactgtataggaaaactcagtgtaatcattttcataatatttggtagaagagcaggcttattgtaaaaactggggatgtttatttttctttagggcttcatttttctactttttcattaagctaaggataagattaaactgcctggaggcttctttgctttctcagcacaataaaaaagtcaaggaaagacagcaaagcaagacagaattcttcagaaaaacaatactgaagggaaataacagtaacaccaggttagagaaacaaaatccatagaatcaagctttacttgagtaacaatgctgatggaaatagcatgtaagagtcttagttcagggcctattggaaatggatgatagaatttttccaatgtacaagcccactaacagatataattagcttattatgctaacatgataaatagttactgaatatctccctaaattagattgacctcaatctgtaaggatcgtaactttcaacaaaggctcgttttgcttgcaaaaagattcacacaagatgctcagatggacaacataaaggtatttcagaggacccctctccagaaaccaaattggttgtggaggctaggcacagtggttcacaccgtgaagccaggagtttgggaccactctgggcacaaaagcaaaagcaagacctgtctctacaaaaaaaacatttaaaacagtgggcgtggtggcatgcacctgtactcccaactactcaggaggctgaggcaggaggatcacttgaatccaggttgagcctacagtgagctatgattgcaccactgcactctggcctgggcaacagagcaagaccctgtctctaaaattaaaaaaaaaaaaaaaaaaaaagtaggttgtgctgtaggatcacaaaaactttgtgctggttaaaccactttactgcctttcatgaattagtttccacaactaatgtagagtccgcttctttgagagtttcacatgccattgcttgtggctttccattctctggatccctgtttagatctttggtcaaaagtgaccaaggaggcatctttatactattttctccttttattattttctcagctgacaattctttccctcttttgttgattgggtaaggaatatctgagtgttattactactagctatacggcaaccttttataaacttcaatatagcattacaaacattggttgatttgggcatgaggtagttctagaattcttttttgcttagtatggtatattgatagattaggggtaaatgtgaataaaacattgcagatatctttgaatttatgacttacaagtaacctcaatatttcagcctagctaaagacatctttaaaaggtaattttcacctcatctataaatgagagttaaaaggaaaattcttttaatttacatagtggtgttttggcttatattctgttttggtttttcccctttttaagacgaaaagtccaaggaggggatccagatagtgtgaatctgaatccagactgccactggtaaactttgtctagctaaattctctgattctcattcttctcatcagtaaaatgagaataatgtacattatctcacttaatgattattattctcacttaatgaatcatgatattaaattttcagtatcattgaccaataatgcaaacattttcataaaacgtggcttataaatttctatcatccctgatgttaatcagtttttcttgcaaaataattaagtaatgcctgcttttagtattaaaaatttttttaagttcaaaacctactaaaagtctacatttataaaattattacaaacacttaaaaattatatttccaaattatgagagtgtgtagatatgtgaattcctataaggttatacacatatcaatttgggcaatacaattacataataattggaatatttccaaacacttgttttaaaaatgctttctcctagcactagtttcataagaaggtagtacactgtcactcatcatatataaaccaacattactggctgggtgtagtggctcacacctgtaatcccagcactttgggaggctgaggtgggcagatcccctgaggtcaggagggcagatcatctgaggccagcaccagcctggccaacatggtaaaaccctgtctctactaaaaatacaaaaattagtcaggtgtggtggtgggcacctgtaatcccagctactagggaagctgaggcaggagaattgcttgaacccaggaggtggaggttgcagtgagtcgagatcgtgccattgcactccagcctgggcaacaagagcaaaactccatctcaaaaagaaaataataataataataaaataaaccaacattaccaagtgctgacaatgatcttgagcaacctgaattttcatacatccctggtagaaatgtaaattggtacatgcttttgggaaaactgcttgaaattatccactaaaattaaacatgtgtactttatgacccagcatttctacttttaggtaaatgcttgacataaatgaaggctaataagtaacacatctataagaacattcatagcagctttattcataatagccaaacactggaaacatccaaatgacaatagaatattcattcttattgttgtattatattttatttatataatacaatcttttgtattatataatacaaatacatgcaacatgtattatacaattttttgtattacatataatacaattttttgtattacgtataatacaattttttgtattatgtataatacaattttttgtattacgtataatacaatttttttgtattatgtataatattttttgtattatatatactattttttgtatcatctaaataaatatttaaagttgggtagaaggagctaggcacaaaggaatgcatagtgattccatgcacataaaggtcaagaacaggcaaagctcatctatgatgacagtagacaaatttatggttacttctgatggagtgtactgattgggaagggcatggggggtgcttctagggtgctggagctgttctaaatcattatgtgggtcatggttgtacaggggtgtgtgtgtgtgtgtaaaattcattgaactgtacctttcagattttcatgatcattattcatttcattacagaatgtcatagagattccaccatttaaagaccttgtttttataaaattacccatactatcttatagatgctggaagggttaaacaatgagagtagccacaagtagcagagcaccttctcttcctacaggatagatctcacttgtaccaaagctgacatatgactgcctgctatgtaatgcacagtaaatttaaaaatttattattaattaaatttatttctcactgttacaataaataaattgaagtgtagatggtttctgtcctcttgcatgtttctttgcatttattctcagtacatatttttgccccctctttggtcccttcccaaaccccttgctcaactttggaaacttgattgagttacacaacagttgcctaccatgatagtcagtgggatatttgctcaataaatttctaaagcaaaaatggacaattatgccccattatgagttagaattggcaaactctataaaggaccacataatatacattttagactttgggggggtcttatgtctctgccatagcttcttacctctgtagttgcatcatacatagacaatacatttttttaaatggctgtatttcaataaaacttttttatgaacactgaattttatagcatcacaaaatattttttcatcttttttaaaaccatttaaattgtgaaaattattcttagctagcttttgagccatacaaaaagaagtgatgggcagaatttgggtctcaggacttagtttgcagagctctgatttagagtcatgtaattttaagtaataacttgaatctcaaccttcagttccatcatttctagtaggttatcaaattaccatatgctgttagagagtgcttttatttattgttcctttaagaagcactaaatattaagtttaatatcaaaggctttgtttcctctttggcatgattgtaattcataagacttctaataaaagagggtgggtttgtaaaaaattccacagatatttgaggcctagtcattagtagctacagtgtcaataagaatcacagtacttttctgcattatcttaattctgatttgataaataattattttttaaaaacccttcattttgaaaacaatgaaataactaaggcagtatataatgcatttatttgaggccaactggccaagttctgtgactccttcctgggtttctatgggtcctgacacatgaggaaacaaatattcactgacattcaagaaggtcagaggtacaagtaactgctccacactgcatagcattttcaagacaggcctccaagttggttcctctccattccctgcactatttgctaagagacatgaatgataaatctttacatcattgaactgtctgtctcattctcctgtcatccaaaaatcagggtgggatttttctgatgagttctatgtgcaatttcaaaattgttatttctattcagactgaatagtaaaaaatcatctgaaagggtaaatttgaggaatgacatcacactgctttgtgcctcccacccattcactcccaaatgagggatccctcagccacagcagcagaaaaagaggacaaaaggccactgattttccatgaaggtgaaatctgtgctgcacgggctccaaaactcactgcacataactcatcttaagcccatctccaggaacccctcctgggtttctatgctccattctagagtcagtactttgcaactagccttgtctttcctcctttaggatggatacagggtagacttgggagacctgaaacaagataaatatagagtcaacagaagaacaaactcaggaggaaagccaactgggctcaaatctcggctccactcttcattgtagatggaaatagacacttattgaatacctgttctgtgctggaaacttcacataaactgttccagttgttaaactaaacaagaagagaggaaggaacaaaaggtgtcccttatttaactcatgtacaatagggaagaaaacttctgaaggaactgcttcaaatagggttttgtttcacatattattcaagcgaccaggttgactttgttgaacttctgattccatgacaacagcaaactctgcatgtgtgctcagggtttgacatgctgtggtgtactctctacctaaaagagtacgcagcataatggttgtgaatctctggaaatcagggtgtcgcttctgttttccagaagatgaagatgccagaagggcttctgagcaatgtgctatgagaccacctatggaagagagagaacaactctttaactgtggctttacttagtaaacttccaaacgattactgaaatgtcatcattagacaacgtaagcaactagcagaaaattcatatgtctaatgcagcctcctcattctttttctgtctttccctgtgatccaggaggaaggatgctggtttcttatcatacaaagatcacctgccagtgagccaagtggtggttggagatactgaccgtcaaggctcagaagccaaattgagcgtaggtcctctgcgctgccaaggagacagtaagtttgcatagcagctatggcttgcactttcttatcccatttaaatattgtttccaggctcctcagaagatgcctgcaatcagacttgctctcctgtagctcctacagaaacatcacacaacccaagcagagataacttagaggaggggaacagccataaagcctccagtacaggagccgagatttgggcataaagtggggatatccatctttcctctatattcatatgtaacaagtttgactacctaagtttatgatgatattaatagcaatgctaatagcataaatgcagtactcaacagctgtgattccacggagtgctgctgttaatgccattaggatgactatttatatcaccataaaccgagtttatggtgatataaatagtagcattatggcttaatgtatcattgtaaacttggattatggccatataaagtttgacattattgctatcaaacttcatcatcatcagagcttgatggtcccttgtaagccaaagattgtttctgttaactatgtcttgctttcaagattagtcaccccagagaggaatttggggctgctagcttggacagtgggaggtaagggagttggagtgatggtccctcctaattaagggcaccattaggattttatgttgtttgatacccttcggtgtgctttatgtgcagtcagagggaaacagtgacatggttgcactgtggggattctgcagcgagcatcctgggcatcgttttctctcttctttctgggacacgtggtttaggcaactctcctgagagttctatgcttttgtgattgtgtgctaggcatccggagacctagattctgctccccaaatagctgacttgccaggagacctcaggcaaacccctccattgtcttagctgtggtaatgagaataccacacacatcccaattcctcctggggaggctgtgaatattttagtgcctggatttggattcctcctagcaaagcattatgtgagatggaatattattaccactttgtaaatcaagggagaattagacctacttgataataaattatagcgtccactcaaagagatgtcctaaggaacgtaatgatgcatgcttaacagtttcctacttagtaaattgaggttgtcagcaattaagcaatgccatgttcctaatacaaaagggagatggactttgtactgatttttctctacttacattgaaaatgctacctgtaaaattgagactggtcaagatctttatcacgcacttattgaacaataatacttcatttgtttagtcaggcttagtaaaactgtgcagaagaaatttaatttcaactgcctaagaaaaggatattcacctaaagcaatagtatatatgcattttaaacaaatattataagaaatgaaatacagtgttgctctaaaattaggaagactgtcatgtgttgtctaatgaaaatcatttttgttatggaataattactcattagcatataaaggtaaaatatttctggcttaccgattctaattctgaagttagctttgaatttgagaaagtgttcccattaaataattgattaacttaatatatttataaaaattccacttctgcaaactttttttcttgtctgttttgttttgctttattttctttttttgagacggagtcttgctctgtcgcccaggctggagtacagcggtacgatctcagctcactgcaacctccgcctcccaggttcaagtgattctccagcctcagcctcccaagtagctgggattacaagcacacgccaccatgcccgactgatttttgcacttttagtagagacggggtttcaccatgttggacagactggtctcgaactcctgaccccgggtgatccacacgcctcggcctcccaaagtgctgggattacaggtgtgagccactgtgcccagccttctgcaaacttttattaccattcttaaaaaaaagattctaggaacattaaatagtagatgctgcagtatatgagcactttataattaatattagcttatttgttcttaataaatcagcctcaggaagaatttattgtgaggctgtcattcatctagaactttcctaggtgctctggaaagtaagaaaaagaagttcaaaccatgttatgtgaaatgaacatgaaaaaatattggaaaacacaaattggcttataatttaattttaggctttgtaatataaaattattgcaactgataatcaagaaaggagccatagaaggtgtatttcaggcagactttctttttaaaaaagagaaaatgagaaaagtatagtggtcattgttcatttgcatttctattctagggctgttgttcttagaaacatttttagaacctattatcaaaataaacttatttattcacattacatgatctcagtatacttataattactgtaacttcagagaaactcttttaaataatattttacctgatatttcatgaaagcaaaagcagtcaacagttaatggcaattatgtagaatacttttgtgtctgtgtgagagagagaaatctcattgttttccaggcaaccgagaataagtatcctacctggtactcgaattgcctggtagcagtcagcagttgtgaagcccatgttccctttaagaatgttctcacggccgggcgcggtggctcacacctgtaatcccagcactttgggaggccgaggcgggcggatcacgaggtcaggagatcgagaccatcctggctaacgcggtgaaaccccgtctctactaaaaatacaaaaaaaaaaaaattagccgggcgtggtggcgggcacctgtagtcccagctactcgggaggctgaggcaggagaatggtgtgaacctgggaggcggagcttgcagtgagcagagattgtgccactgcactccggcctgggtgacagagcaagactccatcttaacaaaaaaaaaaaaaaaaaaaaaaagaatgttctcacatggacacagtagtgatagagtgttccgtatcaactgcattttccagtttttatacatatgtgatctccctggttacacacagcctcctgtgaattgggcagggcaaatattagtctttctgccttacaaatgaagaaaatacttctttgaaaatggcatttacacagcaaatttctgagcatactttcagcctctgagaggcttcaggacaaaagatggaacagagaatagaaatagctgtgtctgtacaaggtcagagttgttttcccaactgtactctcatccctgagccaattgttgattaaattaaaatgccttaaaatgtttcatttgggttttatcccaccactagcctcagccacacatgtcagttaccaacatagtacaaacattatagggattacatttatgtaatttaaaaagtggcatagtgcatttttcctgctgtttatagagatgaacttactttgtgtcatttactgaagtctgttcaaacctacagcttataaagactaaacctattgttgaaaaatatctttcagtttgaggagttgagtgatgacagccctcagaacctgcctcttgaattaggccccagttccatcctctagtctcagagaatgaaaccatttttgtgggctctgcccaaccatttcagcagttttggttgatttcatcatgcctgctgagtttcatttttgctttgattcgtctgaactcagacccatataatcaaaatgctaaagaaaatcagtgcatgccactcagatctgctgcatttcccatatagttctgtgaaatgcttatgtccttacaggtgtgtgtgtgtgtgtgtgtgtgtgtgtgtggttttttttttctttcattctttcttttttgcaaagcctatccaaatggaaacttcaaatcaaatgacactgaaagtatgagtggtgacggatggttcgctgaaataaaaagtgctgtgaaaatacaaatccccctcttaaactacacgtacgcacctagaaagaaacaaaagaaccatttggaagattaaaaatcaatgatcaggtagacattgtttcaaattgaaatatgtaatcatctttgcagatggctgccaaactttcatactttcatgaaattagttaaaaaaataaaagacttccactttttggaggtagaaatctcatactatatatgacgaatataattaattgtaggaatatagtatttgctagacaattgctttattttcagccatatgatgtaaaactttactgtactcctctagggatacggggactgtaaataaatactttggagcaagtttgtcagaaccataggaaaggtttaaaaaaaaatcaaatgttttcagtaaacctgggtagaaacaattccagaaaatgtcttattcaagggcttcttccaaggccatgccagaaacactggctgtgaagctggcagacagagcactggagtcacactgcaggattaagatgcaaattcagtttctcagagctacggaggtgacccagagagacaaggaaggaaaggcaaggcagtagtgacacatctagttctggaacactcagaggacagacaaagctgtgtgtaaacaaataaagatactgatggagattcatcaagatgatggtgaatatttgttctttgggaaagttattttatgtgccagactaataggaaggccattatcttttttttgcaagaattttacaaaccaggatcataacctgccattcccttgacaggagagataagatggccaggcatggtggctcacacctgtaatcccagcactttgggaagccgaggcaggcagatcacttgaggtcaggagttcgaggacagcctggccaacatggtgaagccctgtctctaataaaaacacaaaaattagcagggtgtgctggtggccgcctgtaatcccagctactcaggaggctgaggcaggagaatcatttgaatccgggaggtggaagttgcagtgagccaacatcgtgctgttgcacttcagcttgggtgacagtgtgagactccacctcaaaaaaaaaaaaaaaaaaagcaaaaacagacaaggcaataaggcaatgcctcggtctccacgttgtttctgtaccaatgaaacatttccaacaggggcgcacatggcagtaactctctttcagaagataatacccacgagcatacataggccacatactctgtgcagtgaatagggactgaaggagaaaccacttctcatctgggttcaggaagcaattctccttattgagaggaagcagctctccaggctccagagaagagttcaaaatttatttatctcctttttctttgctgcttcaggcttggaaaaggcaagaaaggaaaagggactagcatgcaggttctaaaccaatcactttcgattcattttctctcttgattctctcaacatcccttaataggtgatactgttgacaaaaaaaaaataaaaataaaaataaataaataaaaaagtaccctgtaaaatatttaaagaggtttatttaagccaaagatgagtggccatggcccaaggtacaggctcaagaggtcctcagaacatgtgtccaagggctacaatttggtttttatatgttttagaaagacataagacatcaatcaatatatgtgaggtatacattggtttagtctagaagcaatgtgagagtgtggcttacaagtcataggtggatttaaaaatgttctggttggagattggttaaaagagttaagttattatctgaaggtctggaattgatagaaaggagcatctgggttaagataaggggttgtggaggtcaaggtacttattatgtagatgaagtctcctaggtggctgcccttagagacaatagatggcaaatgtttccatttagacctttaaaaggtgcttagactctcagtaaatttcttctggattttgagggcctggaaggggaaagatctagttatgttgatagagattattcatagatgtgaattttcccccacaaaaaaactgcttagcagggtcatttcaaaatatggcaaagaaacatgtttgggtgtgaaatctttttatttcttcctttttctgtcatgtgatgttatgctagagtcaggttaaaatttggtatcttattgctacagtctgtaaactgtcatggccctggtggaagtatggcagtgaggacaaccagaggtcactcttgtcgccatcttggttgtggtgggttttagccggcttctttactgcaacctgttttatcagcaaggtctttgtaacctgtatcttgtgccaacttcctatctaatcctgtgacttagaacttctaaccacctgggaatgaagtccagcaggtcttagccttatttcgagatggagttggtgcttagatttttagttttggttcacagtacctttgactccagtgtactgatgaggaaacagaaacaatgttattaggtgctttgccaataagtttcagagttcagactggaatctacctagttccaaagtcctcctttctactctattcaatcagagctgatgttaggataaaaatgggaagaaaaaaaaatctcttatgctctcggggagtggctgggtctagctgtttgctaatgagggggtctagggaaacatccctattgccctgtgaagggtcactgaaaaaccaactcacaaggcaggttaatagaagaaaaggcatgcaaattttactacagggagaatcacagaatgatttctcaccccccaaaggagttcagaagcttatatatcatcctggaaaaacaggttttgggagcaggggaggagaggaacttcactttcactgtcaaaaggactatttactggctgggcgcagtggttcatgcctgtaatcccaacactttgggaggctgaggcggatggatcacttgaggtcaggagtttgagaccagcctggccaacatggtgaaaccccatctctactaaaaacacaaaaatcagctgcgcatgttggtgcgcacctgtaatcccagctgctcaggagactgaggcatgagaatcgcttgaacccaggaggcagaggttgcagtgagccgaaatcacgccattgtactccagcctgggtgacagagcaagactctgtcaaaaaataaataaataaataaataaataaataaataactatttacaagttcatctctgttcctagatccatttattctctctggtaatcccctcaacagaattcctcttctctccactcccataatctatttttccaggatggtaaataagcttctgaacccccactgggggtggggggtggggagtggtaatccctctggggctctccttggttctccacatgtacatgttaaatcaatatgtatgccttttctccatttaatctgactcttgggagttgatttatgtttttactttttttttttttttttttgcgaatcttcagagggcaaaggggaagattccattggctcttacactggcaagctgtgtcttctaacttactcttacatgaagggctggttctgaaagcagagataaaaaaaggataggtgacaaaaactgctcccagtcccatgcttagtggagaaaagatcccccttgattttgcacccctctttttgacaagtcatcaaacaactgatctttttccacttactgcatctattttggctcccctaacagtgtacttcttaaaagtaaaaacaaaatctaattcacttgtatattctcagtagtatcacatgcctaacacctagaaaggattcaacaaatgtttgttgaatgaggaagaaaaataatacatcagagcagagggagagtgataatgccaggtttggcctgaaactcagcttctgcccttagggcactcatcaccccaagcagagaaatctcagggcgctggggctttggagttctctaatggagccacaggtgctgggccaactgacttcctacatgaaatctggattttagaccctgttttcctagacccctcatttcctgcttgggtacagctcttgcctctgccttttcttttttaaagttttcattacactgtgtactgatttctggctcactttgcttccctactattgttctgaaagcttatctctgattcagccccacccagaaaagagaggttgcctcaggcaatctatgtaggatgataataggtgtattaccagcatagaggaccactttctctctgtctctccattcctgccctggccattaattataatacattcgatttacttgggtttggtcttcagccctcatgcttttgcaacatcatgatgggctcatacatgatttttaaaaagagcattaacatcacaaatctcagaatgggtaacgtttgatcattcccagtaactatttcctgagaagatgctctaaattgtttttctttccccattttttcccacaaaatgtggctgtatatttttgcctcacgtatagctcaaaacaagaccaagaatcacagtgtcctaacagtggaagcgtcttagagatcaaccagtgcagaacctctcattttacagatcaggggtctgggtctagagaggttaagtgactggcccaaggtctcagagctggtatacagcagagcacatcgagaaacagtttaatacagccttcatccttagtaattccccagggccaagatgaatgttgacacccaaagaggaaactttgacctggaacaatgaccttgggtctctgcctatcaacagctgagtgggtatcagaactcttaatcttactccatcatgagatcaatcatctggaaatcttgatagaaaacctacagccacagaagtgagggtcagtggcagaaagttgatgacttctgtttttttgttatgttttttgtttgtgtgtgtgtgtgtgtgtgtgtgtgtggttggttttttttaactttttagggttgataatagaaggcatgaaaaaaaaaacaaaagcaaaaacgccctggagtgatgtgtagaaatcattaagctctattttttcttaatgtcccagccttcactgctattgccatgggctactaacaactgagaagcagtagtgggtctaagaacaagcagaaatagtgaaattttcaggatcacaacctaggctgactcccattaatggattgagcccaccgggcatttctgaggtcaggtccaattacaaatgctgtagcttttacaagtagatggaagccttcccttttatcttccagattccagagtgactttaaacaattagaagaaatggacaattcctgcgaaggaaatcagctctttaagattactcagttactcaacttcagctgcaaactcactgttgaaatgggacgtaaaattggttacagtttggaaaaaagtctttctgttttacaattgacatgatatttgtgtgcgtgtgactgattttcttacctgtcctttcaaataccatttgtatttggaggaatcgtcacatgccacagaggaattaacgtgaatgagctgatgccagacttggttctgcaggtctgtgttgtcaacaaagagtcaaattctgtaaaatatttgaagacatttattctgagccaaatatgagtgaccatggcccatgacacagccctcaagaagtcctgagaatgtgtgcccaaggtggttgggacacagcttggttttatacattttatctattttatgttattttattttatattttattttttgagacagagtcttgctctgttgcccaggctagagtgcagtggcatgaccttggctcactgcaacctctgcctcccaggttcaagtgattctcctgcctcagcctcccaagtagctgggactacaggtacatgccaccacaccccgctaatttttttatttttagtagagacagggtttcaccatgttggccaggctggcctcgaactcttgaccttagatgatccacccctctcggcctcccaaagtgctgggattacatgcatgagccaccacgcctggcaggttttatacattttagagaggtatgagacatcaatcaaatacatttaagaaatacgttggtttggtccagaaaggcgggacaactcaaagcggagggtggtgggggtaggggttccaggctataggtgaatttaaatattttgtgattgacaatttgttgagtttgtctaaagacctgagactgatagaaatggaatgttcatgttaagataaaagattgtggataccaaagttcttttgaagtcttatagtggatgcccttagagacaatagatgacaaagtttcctattcagatcttaatctctttaggattgggagggtctagaagaaagagatctagctatgttaatagagattctttacagatgcaaaatttcccccacaaagaacagctttggaggcccatttcaaaatatggctaagaaacatgctttggggtaaaatattttgattttcttccttgtctcataatgttatatgagtcaggttggaaaataagtcacaatatataggttaaataaaacccatctgatgaaaatttattatttgtagggcatgactccccacacctcttagataggaatttgggcaagacttaaaaaaaaacaatcagagtttagtcctcagtgtggctggatgggttctgcctcctccatgtcctctctctgggtgcctctcccttcctgaacttgttactctctgcagaagaaacagcatccccagatgcaggcgggagatttctctgcaaattgaatccccgtaatttggtttctctgctgaactctctgaccaatctctcaccatttgaagagaattagtcttggcctattggatctaaacatccacagtgtggagcatactttggaagtgacagaaacacggagtgaaatagagtctaacctattccaggatcagctcctgaaaacaaattcaacctaagagactttattgagaaaaacgagacatggctctgatcctggatcagtttatgtttcagtgagggtgaaaattttaacaaagtggaggagattaggatggaagtttggattcctagtgggactttgagtggaaagctgagaggcctcatgtagttgtgctttacaaacattaatgtacttagaaaccacctgagatcttgttaaaatgcagattctgattcaggaagtctggagcaggacctgagatgctacaaggtgtggctgctgctagccaacaggccacgcttaggccagcaaccttacatagcagcatggtgaacagcacagactttggaatcacacccacctgggtccaaatcccaactttctccctcactaaccatgtgcctttggacaagttccttaacctctctgggcttctacttctcacccagatccttacctcagctgcaaatgagaataattgtaacatcactgagtttgctccagtaaagcctgattgtccccagtccttgcacatagtcagagctctctaagtgttagccaacatcatcattcttatatccatttgctgtggaaaaagtggcaggcttgatatcagaaaagctctgcccatcttcctgctccatgttcctgtccctgtacccttgacttcatgccttttcttggagaagacaggcctagtctcaggtgacagtgtagcatccagccatttagcttctcctaatttggaggtgctggccacaatacctgattagagctcaactgcattttctgagtccccagggacaatgtccttccacataagcaatctctcatttccttctcatcatgtggatctcagcttcgatgttaattcttctaagaggacttctttgtccactcagctgacatagccactcacacctccctacagcccttcttaattttcttcatagaatgtgccactccctggaattatctctgcaatgcacaactcaattctgacaccaactgccctgagttagcacagccttcacaagttaaaagcacagtccccaacaaaacagccttctcttcacacaccagctgcaaacttgggtggctctcaagccactcacatttctgaccaactgactacaaatttggggttgctactattctttcagggtcaataattcactagaatgactcacagaactcaggtaagtgctatacttataatcagagttttgttataaaggatacaaatcaagtctagccaaatgaagagatgcacagggtgaggtcgggggaagcttcagagacaagagcttgcatgtcctctccctgtgaagtgagaattgtaggagttaaagaaagaggaaagaaacacaaaaggcagctcaacagtcaaagacaggtttattttggagaacaaacctaagaggggcttctggctgatttcagtcaagagcactctctcttacagactaagagtatttaagggttttagggtgagagagcttatcacaggcttggactgtttctgtgtggaagagaagtttattgcagggttgaaatgtctctggttggaggggggttatcttggggctgacatctctccggcctctctggccagaggggagattatcttggggctggcatgtctctggctggggaggggtttatcttggggttggaatgtttctgattggagatatcatttgtggtttatggtcatgctgaccttagcctgatgccctttggacttaggcgatttttttatcaaggggaactttaaaatggcggtgcttgtccaagatggtgatgctcctgctctgtcaagaattccctactcttctggtacaccagtgtgcatcaccaaccagtgacgctcacccaggctttgggtgttcaatgatttattgggatctcattctgtaatcatgattgattaaatcattggccacatgattaaatataatgtttagcccccttttcccctcctccctggagatcaggctgatatcaggaagctcaaagcctcaaccctctatcaggtggctggtcttcctggcacacccagcccccatcctgaaaccacctaggggcccaccatgagtcaccttattggcatggacccaggcatggtccctggcgctcactatgaataacaaacactcctatcacttgagaaagtcctagggtttagaaacttggtcccaggaacctgggacaaagaccaaattaatgacctgttatgagtcaatctcttttctctatttatttgctttattgtcaccattgtccctaacagtagacgggaatctcaggcagaagtctgtatcatggtgccaaggacaatgcctgccacattgaggcactcagacatgtgttcattaaattaatatgaatggttaaataaccacaaaagatgatttaaattagcatttccaagtaacaatggaggcagtgcatgaggcacttcatgataaattgcagaaaacttgcacagacaataattgttataaaggtccaagagaagcactatcacttgatttatatgcacaactatttttaacctcaacagggttttgcacatttattcatcttaactaaatgaaaacttttattcctttgtaccttgaaaatcccttgaatctgatgattatctttaaattaaggattaaaaaaaaactcttttgctaagtttttatacattctttggcaattctaaattaagatgcacatgaagtattaaatttatataactcattgtttaatctaaattagattaacccccttggcccttcagagatccaagtagaggcttccatacttttgtttatccatgtctcaaggttattactgacaaaattacaattagtcagtacttcatgtccattgttagggtgctaagctgtgagctataaactacctcactctggcataattaaaaccgtgttccagttcacctattttatgatacctacttggctttccataaagcttcttttcacactcctaactatgtgcaggtctgggaaacttgggaactttactgaagaaaactttaaacataagcttcttcttgaagtttgctgatagttctgttatagcagtcttactatcatcaggataaaaaaattgtactaaactattgtaaaaacataagatttgtattactacctctttttttttttttttttttttttttgagacagagtctcgctctgtcacctaggctggagtgcagtggcgtgatctcggctcactgcaacctccgcctcctgggctcaagcaattctcctgcctcagcctcccaagtagatgggataacaggagcatgccaccacacccagttaatttccacgcccagttaatttttgtatttttagtataggtgaagtttcaccacattggccaggctgatctcaaactcctgaccttaagtgatctgcccacctcggcctctcaaagtgctgggattacaggtgtgagccaccatgcccagcctctattactacctgtaaaataaatcctaattcaaaagtcgccatgtgtatgtacataggaaatagtgcatttgaactggcatttacctactggcataacaaattgctctttggaatagatgcctagtcccaagttaagaagaaaaggggactcctgtgtcccatccatagtttctcattaagtccaagagccaattgtgctaaagtaaatgaatatcttcaagctaacctataaggggtggtgggaatattagttgctagaccaacacttaatcaagaatctctcacactgtctaagggtgaatagaacaactagacttgtagaggattgcttaatctttttatgaaaaagtcatgtgccaattaagattctagccatacctccttcagggttttcttgacttactcaagctttagacaatgaagtggctcaataatcttttctgtaatccctatgtctaatgtattaagtattccttaattcaatttggtagattaccctaatcgattttgttttctggtatttaaacctttagaatttaattatattatactgaataggatacaaagtaggacttgagcttaaaagatggcctttcatttcacagaaaagaaatttatatgtcaagtattttgctgtggtattctcattgacatagctgagatgataatgtaaccagttcacgacgtcaggattgctatgagagaaccccgttactgggtgcttgatttgctcttttggtttatccaaagatactgagtttgctctgactgcctcggttttctccattttaacaaaggcaaaaaccaacactttgtattaaataacctaaaccttggcattgaacttgtcaaaagagaaaatgacctgaacattagagccaagaagatactctgttgtattttactttgttacttaggtatctttatttattctttacttatatatttcaaaaagacatagccttcctttatggaaaaattcatttgttattatttaagtacaacagatagatagatgctccaaaattaagtctgagtgttttctttgcctgcagaactgacagtttgcttggcttatgctgataatccccaaaaaagtcgcttgtgtcttgaacatccataggaaataaaactgtagttccgggcagtgtcgataagaaagcaaactttacaccttcacttaggggttgagaaagagaatgagctattgattccactctgaactttagatggccatatcacatctgaaaccagtcatttcgtggtgggcagtattaaacccgactttgtcttatgactttacaaattagcgaattatgttgttatgataagagaacccaacaaaagtatctgagtttggaacatcaattttcaggatgttatatatttgagaacacttctccactgctcctctaactcctctagcctacctaactttaatagccaggcctccttcctacctgtttccttcccccttcacaagaagcacctattaaggaatcaagaaaaaaaaaaggatgacacttactttcggaataaagtaatatagtctctactatttctgctttcacacagatttgccctcctttctggcacaattacacatacacacacacacacatgcagatatacttacgtatgcacacatgcaggtatgcttagaatttagcattaggctgggtgcattggctcacacctgtaaccccagcactttgggaggccgaggtgggaggattgcttgagccccaggagtttgagaccagcctgggcaacatagcaagaccctgtatttacaaaaaaataaaataattaaccaggtttggtggcacatgcccgtggcccaactacttgggaggctgaggcaggaggatcactggagcccaggaattcaagactgcagtgagctatgattgtgccactgcactacagcttgagtgacaaagtaagacctgtctcaaaaaaaaaaaaaaaggaacttggcatttgcaatcctgaacctactttaacccaaggtaatatggtttggctctgtgtttccacccatatttcatcttttagcttccataattcccatgtgttataggagggacccagtgggagatgattgaatcatggggacaggtctttccagcactgttctcatgatagtgaatggctgtcagaagatctgatggttttaaaaatgggagtttctctccagaagctctctttttgcctgctgctatccatataagatgtgactttctccccttgccttccaccatgattgtgaagcctccccagccatatggaactctaagtccaataaacctctttcttttgtaaattgcccagtcttgggtatgtctttatcagccatatgaaaatggactaacacacaaggtaaccacaactcagggcttaaaacttctggacaccagtgtagttggaagatatagagaggaagctgaagagaaatgagaggcagccttggaactcgttcctctcagataagggggaactgctatagttgtactcatgggtatgactacagcaaaaggatacaaagcaaagtcagcaaaaggaaacgtgcatgagatgaagtccagaggaaaccaaacacaagcttccaagagactcccactggagtccacagaacacacttaattcccccagctattagttgtggcatcatgtgtgaaatgctgtctacaacagaggctcactagagactcagcacccaaggttttattgggtactggtcacaaaggcagcccctaccaggcatgcacccaaaacccagactcccagaagaaaggcagttgtttagcacaaaccacattgtttgtaccaacagttcagcatagtggggcattcttattaatcagttaaccctcctgaaatctaacttggtgggccagccatgggaagcacttctccagcacaaggatgctgcctctctccttcccctgctccccaaacccttctccacactcttttccctctcccttccatagaagtattaagaagatgtgggaacatccagatcttcaacctcacaccaccctgcatcacactcctgacaccatcatactccacttccacctggctttgtcctgcctcttctaattcttttgttgtttttttttttttgagatggaatcttgctctgtcacccaggctgcagtgcagtggtgcaacctcagctcactgcaagctcctgccattctcctgcctcagcatcccaggtagctgggactacaggcgcccgccaccatgcccagctaattttttgtatttttagtagagatagggtttcaccatgttagccaggatggtcacaatctcctgacctcgtgatctgcccacctcggcctcccaaagtgctgggattacaggcatgagccactgtgcccggcctccctgtccgaattcttagagaaggaaaagaaaaaagactgtgctcttttcccttgagctgatcctttgtatctcatggcctgcagtttctgctgcatccattccccgggcagcaccagctacataatttgcaaagtccagtgaaaatgcaaatgcaggaccatttgtattgtgaattttaaaagagagacaataaaccaggtgccaggcccttctgaggctgtgagggtcacacacctatgtttctacgtgctagcgaaagcacaaggtcaaccctagattctgaatatcactggggcatggcagaccttgcagatgtggatctgcaagcttggtttctctaatagctttgaaccacaagaaacatttatgtgatgaaaaccaaactatatatggcaaaaatatttaacacaggggcttcttatatgtactggcaaaccatatcatattattgagttttccctaaacttgattacagaaattacctggggttcttatcaacatgcagattcccacacagctcccctagagattttgatttggattctccagagtggagcccagtaacctgtttttaagaagttttctagaatatttttctgacagggaaagtgtagaaacttaggctcagaatatttgggggcagacaggcctatgctgaaattctccatttatcagcagtgtgacattgggaaagttatttaatttcactaagcttcaatttcctcatctgtaaaatagaaataattgtgctagtacaaaaggttgctatgggaataaaatgagacaaatgtctgtaaagaacttagaacagtgactgctacagtaagctgtcagtaatcgtagttataaatattacagaaaaagagtagaactcatttaaaaccctcagttttgtaatactagatgaattaagcttaaatgcaaattgctaaaggcaacagttatttctgtcaaattaaactcattcagaaataataaattacaatctgaagtgaacaaaaggctcaatcagtcatcaatggtaaacattttgagcactgctatggtctgtttttgtctttccaaaatttatatgttgaaacctaatcacccacatgacaatatcaggaggtggggctctgggaggcaattaggtcatgaggccactcccattaatgggattagtacccttgtaaaagagaccccagagagcttattggccctttctgccatgagagacttcagctggaaggcacgatccataagccaaaaagtagaccttcatcagatatcaaatctgccttaatcttggacttcccagcctccaggactgtaagaaataaatttctgtttttcataagctacccagtttacgatattttgttataggtagcccagacacactaagacaagcaccttgtgttggcagtgtcacgatgcctccgttcttgtcttcttagtttaaaagaatttaaacagctgggtgtggtggctcaggcctgtaatcccagcactttgggaggccgaggcgggtggatgacctgaggttgggagttcaagaccagcctgaccaacatggagaaaccccgtctctatttaaaaaaaatactgaattagctgggcgtggtggcacatgcctgtaatcccagctgcttgggaggctgaggcaggagaatcgcttgaaccgggaggcggaggttgtggtgagccgagatcacgccattgcactccagcctgggcaacaagagcaaaactctgtctcaaaaaaaaaaaaaaaaatttaaacaagagacgcacagtgaagcgggtgcagcataatttattgcaaaagaaaaagaatactttgaaagttaagtgcagaatagacaggatgctctgagagagagaggagtcagggtgggctgccggggaggatgagacagaaaagattggcgggagggagactccccttatgggagtcttacctgattattcctaaggaggtgaaaagaggtgttaccagtaagcatgttctgggtggttctctgggtgcacatgcgcagtagccgcacatgcgtgttcatacgtctcatgtctcattaacatcttaaatctccacctaggggtgtattttataccattataatgaacaaagggtcagtctgaggacggatgaaatcaaagtgcgcatactctctacagggggagtccctaatgaagatagctttgcttgaacgagctcaattaccaagcgaatgctggggcttattgtattgactgtgtggtcaccacggttgctgcgtcctaagaacatggtcatttcttttttcttttttttttttttttttttttttttgagacggagtctcaccctgctgcccaggctggagtgcagtggcacaaactccgctccctgcaacctctgcctcccgggttcaagtgattctcctgcctcagcctctcgagtagctgggattacaggcgcccgccaccacgtctggctaattttttgtatttttagtagagacggggtttcaccgtgttggccaggctggtctcgatctcctgacctggtgatccgcccaccttggcctcccaaagtgctgggattacaggcgagagccacggcgcccggcccatggtcacttttttgactacctatcctgcctcattgatagcaggctgcagatacagaggcgtgaccgatgatttttgcaatcaaggaattgatcatctatttcaggataagttagagaggtgagaagatgcatctctttaaaaggaaacacataaaggttaaagggcaaagcaaagagaatgagtaaagaccattttccgtggggattggtggagtgggtagaaggcttgagctggagaatattagacaatgattagccaaacgtaaagaagcaaaagtttcctgtagaaaaatatgcaaacatacacagtaagcattcagtaaatacttgaatgagaaaatgagacctgagttggaaccagaaaaaccgacaaatgccaataatcccagagctgaagatagtctgtagacagtggggagtttgttagccagaaataggaggggtgagtgggaaatctttaattaaaataaaacctttaatctttaattaaaatattaaactcttcacttgtgcttagttgcagagatctatgcctatgtagttttttaaacaaataaaacaaacattgccaataaaatgatgtaattcaataaagggcttacagtaggttccacatccaacaacgctatactgaaaatacacaattaaaacttattgttatattctcattatagaagtctttttttttgagacagagtgttactctgtcacccaggttggagtgcagtggtgcagtctttgctcactgcagcctctgcctcccgggttccagtgattctcctgcctcagcctcctgagtagctggaattacaggcacgcaccaccacacacagctaattgttgtatttttagtagagacggggtttcaccatgttggccagatggtctcctgacctcaggtgatccgcccacctcggcctcccaaagtgctaggattacaggcatgagccaccatgcccggccagtagaaatcttttttaagaagacttttaaaagctactcattttagacaagcctttcttaattgtgtaagaatgcttggaaaaaagtagtattttactatttttaataaatctgtaaaattattgatgactgctagcttttctgttttgcttcatttataagtgaatgaacagtgattgttgtgggttgaataacattccccaaaagagatgttgaagtcgtatcccctcatgcctgtgaatatgatcttgtaggaaatagggtctttatagatataatcaagtcaagatgaggccatactgaattggggtgggccctaaccctatatgaccggtgccttataagaagagaaagcgcacacacacacactctcacacacggggagaacactatgaaaaaatggaggtagaagttgcaattttgcagttgccctgccttaagccaaggaacatgaaggattgccggctactgccagagcctgggagagaggcacgggtgaacattctccctcagaatctgcagaagaaatgagccctgccaacttggactgtggatttctacccccagtactgtgggagaataaatttctgttgatttgagccacccagtttttggtactttgttaaagtagcctgaggagcctaatacagtgacttcctaatcaaagaatgtggaggcgcaattcaagtggtcttttcaactccaagaggattgggctgtgtttgttatggttaaaggaccattagcagttgttgaaaggataaagggaaggtacttcagtctgatgcggagtcagtgaggacacccaccgctcccctgcagagcagtgtcttgagagagaaagggttctcctctctgtaggagaagcaagctccattcctggtgctcctctgtatgatgggcatggctacctatgcctgccctccagaggggaagaagcctttgtgtttaggaccccgggatgatgttgacagctatgatcacataataataattgtatgataatgattgcagataacatctgttgcgtatctaccatgtgtcagatctagttaagcacttcacaaatcaactcatttaatcctcgcaagtatatagtccatgaaggtcatattattacccttattttacagacgtgaaaaccatgatagagattcagtaatttgctccaagtgacacagtgaatgacagagctggaatctaacccaggcaaattggctccaaagcccatactttcagcctttacagtttagcaaggctgcaccagaccccaacaaaaactagttcttttgtataacaagagaaagattccctggctgaattctagcagactagattcctcagtgccattacgggctgaggacttacaaacatgaggaaaagataatggctagtttggttttctaggtctgccttagcaaattaccacaaacttggtggcttaaactagagcgacttctctcaacagttctggagccagaagttcaaagtcaagcatcagcagggccacatccctctgaaggatctgggggaggatccccttcttgacttttccagattctgggggctcacggcagcccttggcttatggcagcaaaactcccaactctgcctgtctccacaaggatttcattgtgtgttcaagtgtcctttctgtctcatgtcaggaaagtctcattggatttaggacccacgctaatttagtgtgatctcaagtgatccttagcttaattacatctgcaaatacccagtttccaaattaggtcacactctgaggttctgggtggacatgaatttgggaatggggaatgatattcaacctgctacaatggccaagaaacatctacctagttcaaaagagaacaggatctactggaaagcttctcagctcttggagccccacaactgtgtctcctgggtcctagccttcagcctggctctcagcacagctctttgcggataacatggctctacactgcgtcgaacagatttggtggcagtgactcacctagcagagttctcagcagcccacctggaaggtcccatcacattgttgttattgcagatagcactttcactgttactcaattttttttctagtatcttgtgaacaatgtgtttcaaagtataggacgacttggtggttaatgtcacaaaagcaatcattggagttgtcaatcacagaatgacattacataaaagaattaggactcttcttgctcaagatgctttatacatgagcataaattgagagttatgtatatttggatagtagaaaagctatacattaatgtgcatcttaatgaggatgattttcttcttttgataaccaatgtgtctatgaagccatctagctaggtactggtgagaaaaatgtttcaaataaagtatttttattggagcatataaaagagttacaaaaatatttctgtaaaattttctggtctatttttttcaggttggtactttttaatggtttagctgttaaataagcttcatctattaacttgtattcagaaataagcttaattattcatcaattcatgctcaccttatattttatggttttccaaatggatgatatcttctatgtctgtacattttttattaaacataagtcattttatgcccataaagcttattcctgaaaaaattattttgctactaaaaaagatcattaagttcacaaattttctctccatggcttgatgctgctatctttctgcaccataattagttgcatgtatagttaattattatgagaaaagcagaacatctcccaatttctacaagatacttagagtttgatggtttaactatgttttctccttcatttctcccatccaccctccagccacgtgtattttcatggtaggaagatgataagcatacgctttttcaaaatgacagcaaaatgttcatcaggaacttcataaagctttgatagactgaatatatatttagaaccagcatttcaatggctctttaccttttcttaagaatttccttatctatgaccctcattgctagaaaaaaaatgcgcacttttatataaacacaacatttttcatataattttaaagagatttgaaaccctctgaaggctatatgtagtccccatgccaagaatgccagatttgggaaccaacatttcttatccatttataatgctaattaattatttctcttaaaaaatactctagttagcctgtaaaattcatttagatgacacatttaattttgcccaaaaccttgatttttttggaggaaaaaataatgtaagaaaatacattattttaggttaggatctttaaattctcacagtcaaccaccatggtttctttgtacgacctaagctcattcactggtgggcaagtgttttggggaccaggagtggatctgattcatctctgtatctgccacagagcctagcatgatggtttagacatggagggagctcaagtaatactgttaccggtacacttgttatttaattttaaaaattaggaatggctactgtgtaagtacataaacatttaagttcataaatttgtttacagttgaacacaaaaaggccatttgtgttcagatatgtgacctggggaagaaagatgaaatgggtattttgatcagcacggggagcagtcagtgggcctacagagaaggcgattagaaaagccttgtgctgacagtgcaggttctatgatatggaaagaactagtgaggaagatgcacatgcttagtagctcctaggaagagttctcaaggagcatcaacctctatgtgtccttcccaaggaagcagtgggccctagattggaggaattcaggataaaacacacagtcctgctaaccatttcttatcccagtcacctgaagggatgagatcagaattactagggaaagactttgcagtgggatagatatgcttccaaggtacttctcccagcccctaatacttcctgtttgctaatgcttaaaatctctctaacctaaaatctccctaacctaacctttcattttaacattagaggaaaaaaaatttgctaaatattgactgaaatttattcaccctaaatttaatcacaaaagtacaagagcaagcatacttcctctctgattccgtgaatgagaagtattgaggagccaaggttggagaaggggttaccattgagaatcggagagggcaccagaggtcaagactggggaaaaagacaaattgaaaagacattctatctttccctaggattgttccaattatcaatcctattagataagcatatgtagaaacctggtataaaagaaattattttgtatggctaaccactctccttcaaaaaacttcacaatttgttaagtttagataaagatttatcctcttgtttgattagtttccttagaaataaatttcattcttaggggtttcactaattaagataaatagacaattagcctcttggcagcagaagctacttcttatttatctctgtattcccaatgcctaggccagtgcctagcataaatattgtgcttaatcaggattataatatgtatatttcttgaatgaagataacaaaaatatctattacaactctaagtgatttattaattgatttgagaaaggatttatgttaacttacaaaagttcattcaataagaggttacatcaaatatttaaatcattgcaagaggaaattagaagtaaagccaatgaaatgaagttatatagctaataaatcaatttttcttagttgtaataagtatacaaaatctttctgcatgtaatgtgtatgctatcagcttaatataggcatgttttaaaccatgataaagaaaatattccaatatctcaaattctttcagaattatgccaaccctagaacacagtttctagtatgtgattaagccttctattttttaaaaaagtatttctcaattgactgctttacataaatcatataggtgtaaatttgaattattactacataaatttttcttagatttatgacagaattaaaatagccttttaagtcttaaaaatattaataagaaaagctcaattatgtgaacacagctaataatacattcattctggcaggcattgtgcaaagttttcaatgaatatgaatatctttatgaaatatgagaagctttgttcatttacatacaagttccttagtctcctacattaattattttttctcattttttcatgtggaaccttttccagtaagttctcataagacaacaaatgacccagtggagtacctatttaaaacattataaacaaagaaagcttctttcttcagccctgttctttaatatgtaatgaaaatgcttcatctttcattacagaaatgttttatgttctaacctcttaacctcattattatagtttggttagatttttaaatagaactcgagtttttctcagtgtttcagacaggaagaaaggtggagtacctgacaacctgttccaggaaagaatgttcaataatcaagcatctatctcctcttcctgagttaatccagttagcttatgaggcaagcatgggggagttgcaaagtaaatcaaggtgctgaattctactctcatcctgatcctaaatggattgagttttgttctttcttatgtactatccccatattcacagttacagactttgcaggtcacttgctgtctttgtcatattgggatgctctaacataccatagactgggtggcttataaacaactgaaatttgtatctcccaggtctggagaccagaagcctgagcccaggctggcaacaaggtcaggctctggtgagggcactcgtctcggtagcagtctgccaacttctccttatatcctcccaagtgggaagaaccagagagctcgttagggcccctttttataagggcattaatcccactcatgagggctccatcctaaagacctaataatccccaaaggccccccttctcatgccattacattggtgattagggttttagcataggaatttgtgggggacacagacattcagttcatagcagtggaagataaggggtgctgtgcagacatcatgggctctatgtgtcacataatgtagcatctcatacagggtaaacaatcgccactgttatctcttcccaaagccctgctgtggggtctgctcaccggccctgcatccagtcaaggaaggggaggtggagaagggcacttgaatgctgagtggcaccaagaggaatgtgcagatgtcataaactggaaaattggggctaaaggtgaaacagcatcatacaaatgtcttccctccaaaagctcaatcttattttagaaatatatgatccatgaggactttatcataaattggcccaaaacagccagtcagctactgagggtcctcattttccaatgagtgcatgttttgctgcttcagtggtccagcacgatttggaagtattattgctttgttactgaagagacctttgttttgattcagttgccaatattctctaagatggtttaatgtgagccatggtacttaggtgtaatcctgtaaggtttcttttcctgggattcacagtccctgctttcaatagagtctcacgagggtctatgacccttccagacagcactgatttcaagtctgtatcactttataaaatcctacacatagtcgtgatcttagaaaaaaaatggacacaatatagaacacaaaaagatgaacccattactaacaaatctccatatatccattgtatctaagtcatactctatgagcccaaaggctaataaaaaaacaggatcagacccaggtacaggggcaacagtgccaacttctgaaagcagggatattggtgtagcgaaatagagaatatgaaagaaaaaacaatactctgtgagaaatagcctagtagcctatactttatgccaataagctttataggaagttctttttttttttttttttttttgaaacagagtcttgctctgttgccctggatggagtacagtggtacaatctctgctcactgcaacctctgcctcccaggttcaagtgattctcctgcctcagcctcctgagtagttgggattacaagcatgcgccaccacgcctggctatttttgtatttttagtggagacaggatttcaccatgttggccaggctggtctcaaactcctgacctcaagtgatctgcctgcctcggccttccaaagtgctgggattacaggcataagccaccgtgcccggccataatagtaacttttatatcccagacaaaaaaaaaaaaaaaactgagttaggcttacagacttgactctgaggggctcatgataataattttcttttttttttctttagttcgtttgttttagcatgtgctcagaggaaaaagaaaaagaatttatggaagaaatctctaaatcatattccgttctttcatgaaagtgggcaattcaaataatttcactcaattttcaagtgagatattcacagtaatttgtatcttcaggttgaggctaagcttcattgcacttcatgggaatatatagaacattctagcaaatctttcttagactattacatctttgacttacatgtttatgaagaatcatctgtgcctctgattggccttatataaatacaagggtcatttcagagagcagttcttaactgacttggaaaagcctaagagccaaacaattcagcagctcttccacattgatggcaccagccacatgcagtacatgtgctttacgcatttcattattgcatctctttgtcttatgagtttattgatggaaaattgtgccttgtcttttatcaagtaaacatatttcagaagacatctacatgctatcaacaaaacagagcaaattcagaaaatgtaggacttcgttgtacttgggggattacttcaattgccttaatagtctaccagagtagaaatattacattctttaaagttcagataaataatttgtgctgcttatgtaggaagtaagctattctccactgtaagcagtcttttatgttgacaatatagaaataatctgtcttataagctacactgcatctaaagccctgacactacagatttatgcatacttctggctgaaaataatattgaaatgtgaaaatgaaatctttcaccaaatctctgggaacataggtttgaggctggctttggaatcactaaaaattcattgattcccaaacgtagactaagtaccataagaactgactagggtacttgattgagcttgtgctgtatggtttattacactggtggtaggaatgtgtcaatagtgattatactgctctaagtattttgttttagggtatgattctagcttcccttgtatcattactcaaaactccaaatgaagtgtgtaagagtatttttcaaccctggatttacttgcattccatactcattaaatatatgacacaataaaatgtctaggtcttatgcaaggaacttcaactcttctatggctcctggcctaaaaaggtatctgtgagaggcagaataatgtccgccaccaaagatgtccacatcctaatcttcagaacctgtgaatatgcgaccttacatggcaaaggggatttagcacttatgactaaattaaggatctataaatgcggagattttcctgcaattcgctgggtaggtagaatctaatcacatggatccttaaaaatagtaggaggaggccgggcacagtggctcatgcctgtagtctcagcactttgggaggccgaggtgggtagatcacgaggtcaggagttcaagaccagcctggccaaaatgatgaaaccctatgtctactaaaaatacaaaaaaaaaaaaaaattagctgggcatggtggcggttgcctgtaatcccagctactcgggaagctgaggcaggagaattgcttgaacctgggaggcagaggttgcagtgagtggagatcacgccactacactccagcctgggtgacagagcaagactccatctcaaacaaacaaacaaacaagcaaaaaacatttgaagcattgagattaaagtgttttctttgattaaaaatctgtcaagagtaattagaacctgcttcctttcctcttctcattgtacagcttacaatatggatcaagaaattgtttctattgacatacttctttccatgtttagatcggcttccaagatcttatcctttccactttcaatgtcatgaaaaatcattgagagttcctttaatgcgaaatgttatgccagtgtcacttcctgtgagacagcttcatcctttttggggtcacaaccaccttccttatttgtgtagttcaattcatttaacctgagttcctctggctacaaatctggagtctctgaaacaatgacacattcagctattgcttctataactccatttacattcatttcacatttcactttcagcatcatcactctctgtttcttgatgcacttttatcttagttagccaattctcccttctcgtgtccagttttgtaaagtgttatatgggcttatcactgggaaacaaggaggcaacataaccacatgctttgctgtgtgtggaaagaataacattatgtggagtaacaaacccttaatagattttgaaagaagtgacatggttggtcactgatcatgatgcacatctgttatttctgtatagatacttctgaatgcacaatgaggttatgtcccaataaatccatagaaaacacatagttgaaaatatatcaaaagttgaaaattcgtttaatacacctaacctaccaaacatgatagcttaacctagcctaccttaaacatgctaagaacacttacagtagcctagagttggaccaaatcacctaacacaaagcctattttgtaataaaatattgaatatctcatgtgatttatagaatactgcactgaaagtgaaaaacaaaatggttgtacaggtactcaaagtacagcgtctactgaatgcatatggcttttgcaccttcctaaagtacaacaattttaaggcaaactgtcataagtcagggttcatctgtagtgtttttggacaggagagctagtaacaaaacttgaacactatacatatgcataattaaatttgtatattatgcaattactcaaacttagtatagcacagtaactaaaatttgaaccatgttgggagactggtatatttacctatactatagtaactgaaatttatgcatattaaagtgtgtgcaaagcaaggactgcctctttgtgtgtgtatgtgtatgtgtgtgctctgtatgttttgcatattttcaaactttaaataaatgccatcatataatatttatccttttatgaacttgctatttacattcaaacaatgtttctgattattcttattaatgtatgcagtcaccgtttatttctttttctgttttatgatattccattcacatgactatactacacttcaagttatttatgtattctttattgaaaatatatattgctttcagttttttatttttgcaaatatgactcctctgagaattaatttattgcttccatgtagtcatgtgcaagaatttctctaaggtaactatatctaggtgtggagttattcagttttaaaccttattagatatttccaaattgttttcccaatttacactttcaagtaagttttaattttattttgactcaacttgctccataacagttagtattggcaaattccattttaccaatctgatcacataaatgaatgaggctaaactaatttaatttgggttttcttgattaagggtgagactgagcatattttcaagtttcctcaaatatgagttatctgtatcttttgataattatattaatatatattatttacataaaccaaatattaatgtttataatttgtatatactgcagctgtcatctcctaatctttgtcttgtctttttatttgaattatgatatattttgatgtgcagaagttttaatttgaatatagtagaattcatccattttcctttttggtttatgttttgtgtcttatgtcataaaaatattatcttttgtgcttcatgccttttttcttttatgatgtcttttttcttttaaaagttttaaccgttttctatgtttgggtcattaaaatacatggaactcaatttttttaatggtataatctaagggttcagtttcttatttttgacacatatacaaccaaattttccatcatcaaacatgggaaaaattctttctccactgaactgtaaagccacctctgtcatacatcaaggtttttttttttttattagactttattttttagagtcaatttaggttcacagcaaaactgaatagaaagtacagagatttcacattcaccctctgcccccacatatgcacagtctcccctactgtcaacatccatcaagtttttatacatgcaagggtctcttttgggctctatatttttttcctttgttcacattgtcaatgctgcacaaatttcatactgtgctagtgatacatcttcataatagaacttggtttctgatagagtttagtctacagtgttgatttttaataaagttcttaaaatttctaactaaaattcatgcaaattttgctactgcaaatagtatcttttaataaattactttttctaatgattgctgatagatagaaatgtaattttttgataatgtgagacagaattcacattacatataattcatccatttacaatgtaaaagtcaatagcttctgttttttgaaattatatgtatatatataatcatatagtgtgaattctttgtgtctgacctctttcagtcaacgttatgtttctgatattcaagtttttgtgtgtagttatgtccatttatttttatcactgtagagtatcccatcatataaatatatcagtatttgtgtatcctgttttcagtttgggctattgctgattatacatcattattctagaatttccttttggtacattttaaacctgcccactctctagagagtattttattattttctcacggttttcatttcttttggtctgtcttacaagtgtcttaagtatatttgttttgtatcttttttataattattacattaccttgagggtttagagggtttttctggcactttttcacagtggcttatttcctcatctgttttggtatttttgttatctttctgcttatcccttgcaccttgcaatgtgtgagactcattttgtcttaggttgatgttgctctgtctcaacaggatttggatttgcttatacacgtgctttgatacataatctaggttgggtttatgttcatttattggcttggcttttcttggactctcaagtagtgtatactcaaactgtagacctctgtgagggcaggcctgtggttatgaactctcaggagaatagctcttccttattcagtattctggccaagacagatgacagacatttcctatggccagtagtcagctgtgtttcctagaacatcctatcattgaagatgtagccttcaggggcctcagccctgtgcatcctctagattcccaccacaggggagcccagggcactttcctgtccctggaatgctgtgcaattcaatcctctcgctttccaagataaaggaatgtccccagttaagggccagctcaccactctgatgttcttccccatttttttggtttttgcctttttgtttatttctttgtttaagaggggatgttgctttgttgcccaggctggcctcaaactcctggcctcaagtgatcttcccccctcagtctcccaaagtgtcgggattacactggcatgagccatcatacccaacccttccccttctttttctaccattgggatttatcttgctctttcgagtccccagctataccttaaaaaagacacttgttaatttttatgcagcatttgtgggaattattttagagattttcagaacccctagtctgtcataataccaggatagaaagtagaatggtgctggccagggcctggggagatggagaaatggaacattgctgtccaaccactgtgaaatttcagttatgcaacaggcataagttctagggatctgctgatccaccttgtgcctgtaggtaacaatactgtatggtgctcttcaaaatttgttaagagggtagatctcatgttaagtgtttttaccacaataaaaaaattgttttttaagagttgaagactattttctgaataaaaacaaaatgaaacctcataagtaaattcagagttgcctagtaaaatgtgtcacacgcataataaaagtgtaaaacattcacactcctcactctcatttaattatcaagaattaattaagcttttatttttcttccataaattccaagttcccgatagctaacttccaaagctaaaagtaatgttacttttgactcttttgctacaacaaataatactacactaataccctggcatgtattgtgtggctatgtagagtatatctgtaggaaatgttggtggaggtggagctgctggttaagggtgagagaaattttaattttctagctttcaaattataccattcagcctcccttttgtaaactgttagtttaaatttgcttttctgtaattgtacgtgagtgacaattattaaccccagttaaatgaacaaggagttgatcatctgggggtgttcacagtgctgaaattatgaggaaaagatgtggttcaggagaagcttattaaatgtactttcctttttctccacccccacaccaacatgctgacaatagaaactcattctcaaactgaccttattcaaggtaagaaggtattgttccagtgtgttggtttcaaggactttcttccatgcagaataaatagtagaactaaaatatcactaaacctctaagtaagcagattatgtgctgtcaacggtgaatgcccaatatatccacagcgcaagaacttaagtagacagaggtattaactgtcattttatttgaaggaagccaaaaaatcttgtgctcacatcatattccttaaaacctcattcttccagaatggctaccacagtcccaggcatcacctggagacagagacataatacccagcagaagaaaagagtttattattttatgatctctctgtttgaagaagaaaaaatacaacactttcttaaaaatttctaagtggacttcctcttgtgtattattggccaaaattgaattactgaatcatatgccaaccccaggaaaatcaattattggtgtgaggaatagaattcccctgatcaccttagcctaatcaatttgtatccatgacttacacaccctgcaacaaaggaaaatgtaggacttgctattgattacgtacacaagtgtgcctgatgtggacagcaaataagtttgatggtattgtttgtcataaagttaagtaacagcatgagtaatatggccctctgtggaatttcttggtggcagttgagcaaaatttaaattgctctgaaatggaggactgtgatcacggaaacaaggtagagttagctgatataatttggtacaaggaaattaaccatggttgggtttttgagccatagatatgataatactcagaaatatatgtaataatgcagcattcccaaatgattccaatgttgagttctccacacaaatcatttcattttctttcagttggtgttaaagatattggagtcctcatttggaagtcactcactatagcatttatgggaaaccgagctctgaattacaaacatcgagttgacaaacgaaaatctggaacagaacccactcaccagctggcgaccacccagtattatttgactttaaacttgatacttgaacatgattttttaaaagaaacttaagcaagtaaacataaaaaaaaaaaaaaaaaccacctctctttgacttggtcttgcaatgggctttttaccgctttgaaatggaatacagttttatttccaataaacagcagccgtaacaaaacttcacacagacacctggagaaggggcatttgatgaatgcaatactatcattgtttattatagaattatttactagaatctggcagagatcctaaacaccatttaccataactttggccaattttcctaaatccatacttcaaactctactgatataatgggctgctttagccaagaatgatagctctgttactccccaaatattaccaaaacaaaggcgtggtcacttcccacaaatccacctggagtatgagtcaccagctgccccttgttgatataaagagctcgaagaatgaacagttttgaaatccattagtgaatcactgagaatccactcagtacagcttggagatctcaacagaagccaataataattaaagaaagaaaagctctgggttaaaggaaagcaagcaatccagcggaaccaactagaaaacatcagccaactgcagcgccttgctggaattagggcagaccacagtctagtgcctgctagagcaattgaaggaagcccagctgagagagaaggcttcagtaaagaaaattagggaaggttttatttttatgtgaagttcttgtgagaaggatgttaagagaaagcattatctgttattatttatgattgttgagccccacaagcaagcctttgagtttttataagcccacatagcatgtttttttgtttttgtttttcctgagggtaaacacttttatttgtaacagcattgtccatggctgtcaatgtatctgatggaaaatacctgtccataagcatgaaggaaatccatgatcttcccctttaatttgcagaacattacatagtatttttttaaaaaagatgcaaatagcagcctacttctttgctgctaaagagctttaatggaatttttagtgaatcagatgtgtaagggctgatgtcctccaagctgagctggatctccccagttcttcctaaggttccttttgtgtcacattcaactcaacagacaggaagcaactctcctgcagtgaaggccgcacagtgggctctgctcctaaatccaaggacacagaggagcgcctgtgtccccaaatcaggaaggcgggcatcggcgagacccagtgtcacagagaacgagcatttttgctgctactgttctgtgcaagtgatcacagcccagatgtacagtatgatttggaacctccacactatttagcatcccttaatttgtatccagtgtgctaactgacctggaaacattagaaccccatttccaagtttctcttaaaaatccccaggtcccaacacacaccaaccactttcatcctcaacagggcatgttacgccagagacagatccttctgcatgcattttgccttaatgccagtaagaaaattgattttttgtttcaggatttttcaatccagaagacaaagagattagtcagcagcttttaaaatgaaagtttccaggtgagagatttcaacactattttgtagatctggtgaattaagatacatattttcagtattttaggaattcaaattctaatcctttccaattcaccaactccctttatccaaatccatggaatcagagtctaatgaaaggggtacttagcatttgattccaagctttcccttacaactacatttacaagaaagtattttgaagctgagaaaactgacaggtcctgtggttgatctgcacagttctatttcctttgggctccaaatgttaaagcacatgccctggcaattcgggcaccagttttgaatgaagacacccagcatcttgcacctgcctgccaatctccacgtcctttgtagaggaccggggtggacatgcccatcccctcctggggaagtctgtttacactgcaaactcctgacttctgcatggcggtagagctgattgtgatacctctgtccacctatgccagcccaggtgcctgacttgtgttgggttaactattctgatagctttgatatggccttcccacatgtgccttctcctactgtggccgctgtcactctgtctccactcccatgacacttggatgctccagtgacaccagctcctgcacagtaccactcttcagcagcgttcatatcaaactgtgcatgtctagcttatctgggggaagacactgaagagaggcagaggtggagacgtgaaagaagacagcaaaatcacagagcttcgcaagagaaactgcttgcttaaagataatttcttcttctgattacaaaagttacacatgctcattgtcaaaatgctggaaaatacagagaagtttaaagaaggaagaagttaccataatcatactacccagctaacatttcggtgtattggtagtagggaaatttctggttgtcaaggaggaaggtatatatccctaatcacagaggttttttcatgctcttaggtcctaagttatagcattttaatgggagatttctaagacggaaggtatttctggaatagcattccttccctttcttctgcagatctgtcaaattgttcagctttcttgactaatagatgctatggatagagcatccctctctctctaaaaatctcaaaaaaagcaagtcttatttattcaggatttgaagagaaatattcaggaaggatatttcatcaaacctgattcatatattatgcactgtaatgatgctagacacaaaacacaagatttcttgatagatggtcagaataaattacaccaactgcattagctcagcagcagtcctgcccggatctcagcacctgagcttctcatctgcgtatggttgctcagcttggtcactgagacatgcaaaagggaaatgggcattttccctgaacacctaaatcctttccaaaatctgtcaaaatgtttactaaaatgtagcttctttgtttatcagacgaactgtggtaacagcagttatgaaacttatcacagttcatctgataaactacattttagtaaacatttcaaagtgaagcagatatgagagagaacaaaattatttgtgtttacatgagacttggaattgttaaaatttttatatctagcatacaaaaaggctgcttatgttaaaaattgatagtaactaaatatataagaccaaaagaatactaataatgtgaattaaaatgaaatcttagcttggtttataaactatgaaatttgactaaaatctattctgtatatatgttctagttttagaatataaactagaactagaatctaagtagtagccaattggtaagtagtgtctgactgggatctaaaccagttcagattaaaccattgcaacactactcagaaaagcgtatggtcaagatcttccgctatggagattaacaagaaatgcccatctatgtaacagtaatttaaaaactgatagtggtatattacattccagtgaatgacgtaaataatagcctttttaaccctcttgcgaatatacatggtatttgagaaaaacgttgcttcagaacaggtgaaagaatatgcctggccaaaataagttcggctacccaaaatggtaatggcttaagccttttggtttttatctttgttaaaggcagcgagtgacattttaatcttcttgtgcaggtttttctaaaacacaaaacgctttctgttaaaactcgccacaaaggcagaaagggaaaagcattcacagatgcacacagattccaagaactctctcacactatctcaggaactcttactgctccctagaaactgtttttcatcagaatggggaaaataacacgactggtacctgcaatttctgacaccaatttcacatctaacctctgtaggtatttaacggactcagggcctaactgaaactgctgctaactattgatttgttgaggtgttcatcccaggtggtttatggggactctgtaaatatgggctgataatagtaatggtcaagctcccataatttcttaatttcagtttatttatttataatatttatggttgtaagatcgaatctggtgattatctgtgctgggggcagaaatttcatttctaaaggatggcggtaaatataagcatgttgttggttgaatgttcaaaaacatatttcaaaaaccaagtactaacagctaaggggaaaaactcacacaatgaaccagaagtgtatgaaacaaggaataaaatggaaaaggagaaggcatgaatgttggagggatttaagttatggatgaaactacagtgaacattcagggtatgttgggagatgaaaactgaagcatccttttactcggtagcaaaagtgaccgggatcaagggtcactcccggatacaggtatcccggagcacctccacaatggcttccagcccagacctttgtcgtgggaaggagtcccatgctctcatttttggcacaaacagagtttgactctcaccacaaaacagcatcaaacaatgtcacaggctgtgcttctcacaaggttttttgtttgttaagttcattttcctgaactcaaacattgtgggaagaagtaggtcataatatccatttccctctaaattgatccagagcttccagaaatctgaagaccagtgaagccaaggtttcttccaaacatagagttgtgtgaaatcactatgtaaaactgtcagcattattttggtggcaagttctgtccccatcttggctctcctccctgcctctcccacagcctggtacagtcagctatagagttcagccctgaatacctgctggatttacacctagcaatgcatctgttgatctcactgatgtgaaaatcattttacaaagaattcccactgcattttctttagcatggcattcacattcccccatagtgtggtcccaaatcactcctggtcttcatcttctaggttcctcagaggggacctcctagcatcagtctgggaattctctgtctcctatgggatccaggacctggaccacccagtgtccttccaacaggcctgaaaccttcctatgtgcaggtgtggaatgctgctttcgcttcttgcctcccaatatcttattgattcttcagttccttgttgtaatctccctcattcagagttgttttgtgtttgtgttttgttttgttttgttttttgagacagagtctagctctgtcacccaggctgtagtgcagttgtgatatcttggctcaatgcaaccaccccccaggtccaagagattcttgtgcctcgggctcctgagtagctggacttacaggtgcatgccaccatacctggctattttttatatttttagtagagacagtgtttcactatgttgcccatgctggtctcgaactcctggcctcaagtgatccgcctgccttgccctcccaaagtgctggggttacaggtgtgagccatcgtgcccattctcagggtattctttttttggggggaggggtgtgaggggagggtgaggagaatggagtttcactcttgtcactcaggctggagtgtaatggcgtgatctcagctcactgcaacctccacctcctggatgaacgattctcctccctcagcctcccaagtagctgggattacaggtgcctgccaccacgcccagctaatttctgtatttttagtagagacagggtttcaccatgttggtcagtctgtttttgaactcctgacctcaggagtggtccatcagccttggccttccaaagtgctgggattacagacatgagccaccacacctggccagagtattatttaattctctgagtaaccagaagccaaaggatattgcttcacctttagttgccatgtaattgaggcatacctcatcatcagcagtacacttggttttctatactggattacacaccttttggaggcaggggctacttttattcttctttaaatcttcacctgcactagcatgctaaaacaaggaaaagaaagttttatcttctatactggaaacaaagaaaaacaagggtaattcatcttacttttatcactagtctccgattaactacatgttcaagtttactgtatagtatatctatgtgatctaggcaggcatatttcccctcaaatatataatatggcaaaataaagtgcaagttgtgattggtgaagataaatgactgaacttttactatcatattctcactctgctgataaatcatctttgagaattcgtattaattttggtcaagaaatacacaagttaaatccattttattcttttttttaacattgggaggactaagtgaataaagaaggagtgaattatatgattgtctaccccacagtttcagtaaaacgatattttttcctgcaatatatttatgatctgccttaaaaccatagaatctggcttaagccaaagcaactgtatcttcctttattttttaacaataaacacctttaattatcttccttccgactactttgttgtaacacacaatgtgtttgtctcctgaggtgagcataaaaaaggagcccagcatgacttgaatgctaccgtaattaaagaaaagctaaaaaggtcaaaaacaagaatgtggtaaatcttaagcaactccccagaacaggcgccacctgccactttgtgctgacaccgtcaatcattgaatcggttactgaatactttcttgcatttcttcttctccaccttgtgcccacgttaagcaggaagacatcatattttcattagcacctgttttgttttttcaccttctgtagactgttgagtgaatttctaataataaagccaaaaggaaaaataatggcaatatgattggacaagcagtttcagaatcaaggtaggatgcctttttgttggtggaggttttttgtttttgttttgtttttggacttattctccctcatatcaaataaatttattaaacacacctgaacacttgttatgtgccactgtcggccacgtattagggacacggaagaacaataagacatactccctaccaaaagaggcttatggtttagaaggaagacacagtcttgtaaacaggtaagtaaaataaaatgtgagctgcactatgctggaagtcagcccagggtggcccaagtagaccatagccagtctacataaatagggagacacgggggacagctttctagatgtccctaacgctgaatcctaaaagatgagaagcatttctagggtgccagagtggagaaaacacctgacttgtgggagaacggaaggcctcgtgttcattcaatggatcaactatcattgggcatctccacctgcgagagacggcgctagcccctggggatccagtccccggtgagctggaaagctactctgtgctctcagaggacttggaacagagaatgcagacagggtggcaggaatgcaggaatgtgctcacagtgcaggaacccggtggctcgcagagaagggcaccaaacttagacctgggagatcaggaccctctcccccaaaacctggaggattgctccaaagctgtaccgagtcagtggcggaggccgggtgagcgtggggaagggcatcagacacggtatacctgctccacctttcccttttgttttgttgtcacaagaggcactacttcgctgcctccgtctcctctgtgggtggaaaggatggacccaaaggaacagaaggctgtggccactcgacgatggttttgatagggacttatcttgctctctctccctggacactctctttctaggcctgcagcctctctcctcccttcccatttccaaagcctctgccccaacctgatccaagtattatatgtaaacctgtcattagggttctttaaatcaaggctttttgatgacaaaaagagggtttaaaaaaaaaaatgtggctcacgcctgtaatcctagcactatgggaggctaggcaggcagattgcctgagctcaggagttcgagaccagcccgggaaacgcggtgaaactccgtctctactaaaaacacgaaaaattagccgagcgtggcggcaggcacctgtagtcccagctactcaggaggctgaggcaggagaattgcttgaacccgggaggcggaagttgcagtgagccgagatcgtgccactgccctccagcctgggtagcagagggagactccgtctcaaaaaaaaaaaaaaaagaaaagaaaagaaaaagaatctgtaagaatatccagtgtggcttctgcctctggaataagtaatagtcttagtgaccatggctatgggagtacccgggttccatcagtgtgccctgtgtggttttggtctgggctgcattggcgtggcctgtttttttgtttttgtttttgtttttcccttattactgttcgtggagtgttttagtttgcttttttgtttgtttggttggtttttttttggactctgcgaatggatgtctaatgctctcgtctccctggcaggacctccttcctgtgtctgcagtttctcttgtagccacaccgtctgcccgatcatcagtgctaggaaaataacgatgagaacagacctttcgaagcccgattatcagaaagagtgtcttcatgcttgaaatctgaatataaaacagacgcccctgaagtgcatccctgtgacactgcctgtacagcaccgttaaatatctcatcggcagtaatagcttaagactactgtgctcagtcacttctttgggtgtcactcatagcaatccccatccctgccatcatcattatcacacagcactgccataatgacaattataaagatgttagaaagctgagacaagtcattctgaattaaaccgcagctcccataggtcctctgaaattacccgtttccaatatctccattgtttccctacccaaaagcaaaaaggggagacaaatgtctcttgagcgatgcacaaaatacattataagcctgggaataatcaaagctaactgtgttcagtagagagagatgcactgtgactaagtttcactgaattttaatggcataatttttagcccagaaagcaagctcatgtgtgccggagtgattaatgatacagtttatgcagctcattggtcatacttaaattagtttaaatattcatctgttgttttgttataatgaatctccatgtttctttttatttctgttcccctgagtgtttcctcttgtctggttggaggatgtttgcctgaattgggaaagaaatgccaatagccctgtaggtgacaatgcacccaggctgctgaagatcaggggagatgaggcaataaacgcttcatttcacactgtgaaatgcacacacagctgcaccagcttcttgagtgagatgtcttggtggattctgtgaggtgccaggtcagagattaaacttactgatttgtggcacatgaagccattggatgaagttggatgctgtttgctgtccctgggacttcctttaaagtccacacatcaatttttataccaactccctgaaagtcctccttttatgagcattcataatttacattttgagttggaaagtcctgtaactctaccttctgggattttatgaattttcctcccaaatacaaaactctctagatgctgaaattgcatttgtggtgaagaagggaaaggccataagagtaacttaataagacttcatgttacagaactgaaagatctttcaaattcacataaaaggaggcctgcacttgacactgtcctgactatataacaacatctagaagtagacagtgttgcctttttatgctatatccttgggagtacaatttacaaatagtctactacacacttcttgcacttgtgaatcacccatatagatcaacctttaaagtgtaaaaaaaaaaaaaaaaaaaaaactttataacatcctgagaattaatccttggagagctggctagatacagaatgaaaaattccagacaccacaagtagttagagctcagcttcctggataaatcagttaatttggaaattgtggcctccatacccgctaggcatgtttgttcatccattgttctcctccctatctcctagccacagtgaaagaaaacgaagtgtggtgtacacacacttctagctatgaaagcagctgcatgatactggaaacacagtgtctccaaatgtttcagccttgggggcttccctcattattactatctgaataaagtgcttcagtccgctatgatactttactctaggaaacccagctttgttcctcacattatcaatgacttccaggagtgttcaggaaggacccaacttttacactcactattcaacatgttattaccatgctgctaatgtttagctttcttctacattatttgacccccaaaacagacactataacccaactaatataattctgttatagcatgttacaagtttttagcaaaggtgagaatcatcaaattgcatacgggatgttattattcttcatatccatcaaagtacaggaagtccttcacaggcagccatctttttctctgggccacaccagagaagccccctgccttctcctttctttgagtttcaaggactgaacttcatgtctcacaagcagtcagaggtggaagcaaatgaaattgcctttgcaaaaattctaacagtgagaggaatctcacctgactccatcttgcttctaacctcacaagctagctgactttgttagctttaaaacaaaaatgatacatcccttcctgaaactaacccctccttgcttagggactgaaaccatgtttgtaagtctaatgaaaggacataagattaggattatgggaggggcctgaattctgctaagatatatgcatagttaaacaataaccagctattgttccagaggtacaagatttgtaacttctccaactgctcctttagataatatccatatggtcaaaacctaagattgggctttgaggtattttccagacttttgcatttggtttgaccagctgatgccacctgaacccaagactcataccagggaactggctcaaccagtcctgtgaccttcatccagatactgactcagtgcacaaagaccattttggacattcctatgatttaatccccagtcaatctgcagcacccattccccatccccctacccaccaaattaccttgaaaaacactagcctccaagttttactatctctcatccttctcttggctggccctgcaataattaagttctttctttgctgcaatacctgctatactcaatgcattgacttttctgagcagcaggcaagattaacccatcaggctgctatacaaatacttcctgttaccttagtactcaaaacaatctatggtccctcttctcaacctttctttcttgattatttaatctctgttaccattcttacacttacttacttgcaataacataatacttactctttctgtaataacttgcaggttataattggatcatgagtgacctctccccaaattcatttatctcatcttaagcctaatgaatgaaaaaattatccataatgagagaaaacagcaggatccttttcataaagagatgtttgaaaacaagtatttttggaaataatatattaagatgcatatgtggctatatgaccgattctaatgtgtttaggccttgctaatatatcggtatgggacaatctccttcttaaaattgtcacactgtattgtttgcttcagtccaggatagcaggactttttgacctgaaaggaaaaggtaaggcaagggcagaggttggacccttgtcccttaggacaaagcaggcagatttacatcactgccttccaggaaatgacagcttacccccaaaagtaaagaaaaagtgtactttaaaaaatactagccaggtgtggcggctcacacctgtaatcccagcactttgggaggccgaggcaggcagattgcttgagctcaggtgttcaagaccagcctgagtaatatagtgaggcctcgtctctacaaaaaaaaaattttttttaaattagtgtgatggtgcaggcctatagtcacagctactcaggaggctgaggtggaagggtcacttgagtccagggggtcaaggctgcggtgagccatgattgtgccactgcctttcagcctgggtgacagaacaagaccccgtctcaaaaatatatatatgttttatacttctcactatagaaaagccatttaaagcattctgtgtagggggaataaagtgagacacaacctgagtattataatgagcactgaatttgtagtaaaaagagtaagtcagattcttgatttgcctcctgcaggctttgcactttgaaaaaattatttacattctctgggctttggatctcttgtttttaaaattcagagtttgaaccagatacccgcccacctcatacagcttgaaaactctacaagactcaagtttaaaacttctgcattccaataaaagttagaaccctaatcctcttgctacaggctagcaagatttctcgtatgaaaataatgacactgcaaatcagtacctgaggtctaccaaaacctcatgttgtcaaaaccaaattgtcatctaactatttgaaacccgccacaaccctttctcgtaccattaatgtcaaagcacaccctctgagcagaggcagcagtcactgttttttgttgttgttgttgtttttttctgagctttctcacatactaacagaggctttgatgcaaaatatagagcagtttccgacctaagggactttggaccaacagatatcatgctagccctaattttttctgtgggttttcacacgactgtgtgtgagaaaagcaagagatttcagatctaaacaagacccactatacgaactaatgaaaatattgggtgtgtggtctacaaaacagcctaaataagtacttctctctgaaagatccctttctccataggcctattcagattaatatctagttttcttcacattaaagtgtatatgacagttgtcatgataacttagtgaaaagtttagccaatagaatctatgtagcacttttaggcttctcctgctgtctgaattttttcttaattttctttctctcaaattcagcccacctaaagtttttgacagtctgtttaccaatcaggaaaagatttaattcttatttgtcttaaggcagacatccaggatggacagtgattatgggttcatggaatgttacaactggaagagtttataggattcatctggtccctcattttcctacttgtcaaatgaaaacaatcaccagggaatgtgttgaaaatatagatttttagtctccactccaacctgttgggtcagaatctcaacagacacaagagaatctgtacttttaacaatcataccatcaagcaaatttgagaaacgctgatataatcctatgattttattttgtaaagaggtttattttgattatacatggtcatatatgaaaaaaagaaaggatttcatagcctttcgtgaaagagttgactgcttcatatcagttataaaacataaattgaaaattattcctgaggttgaaacactcaacttgggcctctcaatttctgaaactcttgactttgatgatcgtaaaatgacaatgattattttatgttaattacagaagtcaccttccattctctcccaacctcaataacacctatagatgatatcaaatcgaggcatgtagagccacacactattttaaaaatgtagcattccttcatactcataaacattctcttaaccttaacatatgaaataatctccaaattctcacaaaaatgagtgcccacctgaactaaagtttttttacacctttaaaaatgtaattgtacagacgaaatcggtgtcataaggttactttcactaaaatagtatatccctctaaaaacaactttcacccatttgcaatcactggaaagtcatagaaggtgactagagtaactgatttctctcaagagcaaattcatgctctccaaaggagatcagggtctgtttagaaaactgaggtctaataatcaaggttgccacctggtagatctcatgttccacacatttggatgacttggctgatttcaggaatatgggaaaaatcagtttaacccaggctctctgaaccaatgtctcagatcaaactgatgacccccggacagcaaaaatgtgaccaaggtggaaggatcacttgagtccgggaggtcaaggctgcagtgagccatgattgtgtcgctgcctttcagcctgggtaacagaacaagaccccgtctcaaaatatatacatatgttgtatacttctcagtgtagaaaagccatttaaagcattctgtgtagggagaataaagtgagacacaacctgagtattataatgaacactgaatttgtactaaaaagaatcaggcttagccttcacttcacaacccaggttcacatgggtccttcctgtgcatcccaaggtcaggtttaaccacatcaacctcaaagccttccaaacagaaagcatttggaaacaacaccatctccccagatcattctacagtatgaagccgtgaaactgatggctctcggttcccctattcctggaacacaagtcttcagtttcagatttgggggaagagaaatcatcatagtatgacaattgggagaaaattacgtttttgttttcatatgtctccaaataaaatcccaatcatattttgtacaaaatttccatttttcattattaaaatttcattattttcaggcagccattgaaaaagattgtgccctaccagaatctggatatccttttgggcaacacacttttaacctctcttaggagatgttaatttgagtgagttttcaccattctatctactgcattcgtaaatttccctttttgattattctagtcatgtaacagtgagctcagcaaaacaaacacacgcacaactccaaagttctatgcttaatgtcagtgataaatttcaccaagtagctagaaaagcagctataataaagaatattctaattagtcttagaggcattatgtggcagaaaatatggaattttttttcttatgccgagtttgctaattgcccccaacaataggtgtgaatctcttttgttatacttgcagaaaatatataggtttgacttccatctgggacactctagagaaatgaaggagttgcataaaacttttaatgctgtgaacagctagacacaagttacatagctgctgaaatgaaactatacaacaatttctctatataaacacattctgaaaacacgttgggtaaatggagatattgttgccaccctagaattgatggtttccataaatatcagcatagcatccatactatcttttaattacaattttaaacctgcgaatataataccttgactcgatggtagtctcagagaatgtatgactatattttattccaccacatataaatttgtagaatagggtcttagtgcttagctctgtgagaactatctaactgtctgatgataaaagttgaggagttgtttctgtgaccaaatatgaacataagaccaattatctgcaaatactcctgtaaggtatatttccagtactgttttatgtttggcaggattgtggtggagaagaacagggagatgttctaagtgtttaaaattatttttacatcctagaatcaatgtcttcttaatatcatactctctggttggaaatcttcagaggacagacactcagtgaataacctttaactaatttccaacccatttgagtatgccaggaaaatagcatcttccaagttctagtctagttgttgtatctgtctgtgttgctttccggctgctatagcccagttaaattaccaagtgctgctgatcctttggagcttttcttaatcctcttttgacctctctaatttgaattattctgtgtcatcaacaaagatgtaacagttaggtctctgtgaaatcacaaactagaattgcaattagagtttcttaatcgttgtgcatattgtattgttgcatggggaaagaaagttttggaatttaattaaaagaaaggggaattgtcaatgtacttaatatgccattatattttttcttttaaaatatggagttaaagaaaagtttgattgtctttaatagttgcagttatctaccaatggggactactgaatacatatgctggggaaattcaatgtcaaggaataatgtatgcttgaggaaagtgtcattaaaaaagaatcagaggattagggattctctaagtttttaaaaatatatatattcttagttcttccggttctgggcccattcctttgtttgtagagttacaaaaaacatgattgtttggtagtaattttctttatccagctctttttttttttttttttggcaggtggtaaagtttattcttgtaatttcttgagaagcgtacagcatattttcatttagatgaagttcaaaaacaaaaataaactattaagtgagttagggctacaaaatgtggtcaactataaagaatatcaagggaaccataaacctgaaatctgggagagcagtttcatctgagtcaggaggaaataagtggatggaatcaggcggaagcacgtagcgtaaaagaaaaattgcaccagacactcattaaaaatggcagagagactttctttgaaacgattgtaatatggattaagactattgcagtaggggagagattgaactagactccattggcacaaaagactggaaagttttcaagcatgaagtgagccagagaacaggtactggaagatggtgggacgatgtgattaggccatctgcatttcctaattggcacttccagaatttaggctccttacccttccacagagactgagagactggggccctcccttcttgataacaacatttcaaagggatagctcccgggtccttaagaaaaacactcctgggctgtaaaaggtttacctctcaaagggcagagtaagaatttacaattgcaagttttctaatgtaagtgctctaagaaaagagaagtcaaaggcctagagtcaggaagaaagctgtctgaagtttagtcaagctgaaaggaacttaaagcctccttggtcaacagtaagcttcagtgataatgctgaagtcttgttttctaaaattaggtgggaagtccgctggtcattgtatcatgacaccttacaccttacacatactttaaacattttctttagtatttggtagaaacagaaatactacttaagtgctacttaatagaaagtaaatcaatagtattcaacagaagcagaaatgtatttaatagcactaaatagaagtattaatagcatccagtagatacagaaatgttcggcccagggtcagtggtgttgcccaggggaatagccttcctgggtaacatacgctgagattgctgagtggacaaggtatttccatgtgccgaatttacacagtgcacctctttcctttttcctggctgcactcggtctctctgaagtgaatggcagtatttttaccctcgatttactgaggaggagactcagtcagagaggacattaattgtttcttcctaatatcacaataaattctcattccctaaggctatgtcactccctagaactaagttatctacttagggaagatcattcgtcactgccaggtctccagggtaacatcaaggctttattgttgcaagtcgacaaatcgcctcccatctgtctgccctgactctgtgactgcagccgcgcggtgccctagatgtttccccagtggtctgaaagaattaatgtgcctccctaaacatctaacttaatgctagggaggggcttaggcaatgggggaaatccgcctggaagagatgttctggatgtcagtaggttgtgctaatctggctgtggtcatggctctattggggagacattgacagtccatctatgtctcactgaaagatctttgtgatatctacaggggcactggggaactaacatttcaagaaaataatagcgccagcaggtacagatggtgtctcagacaaagtttctgggctctccctgaagcttgacatcacatcagtgtgtgtgcaactctgcatgtggttggtgagtacaagggcaagagacagagagggtaggagtcagaccgaaggagctaccgtgctggagcccagtgaaaggtgccaggagaactcatggcctctctgctcagatctcaaaatcagaggaaatgacaaagaaccagaagaacaaaggagaagtgacatatgggaggagacacccaagggaaacgttcaaggtcccaacatgacaccttatttgcagaacatcccccaaaacaaagaaatcctctgcacttgttcagaggatttctgatcaacagcagccaacccacagaagcagcagcccttgggcgctaagcagaagagagaaccaatgaggagccattcacctcacctgctgacgcgaaggctgcttgccagttttaggggttttctatgttgatgagcactttggattgttctgagaaattccccctcaacacaaaacacactctttaatgaagagatcccatattcctggctcaaaaatttgacccttgaatcatttatatcatatcattttgttgtagtccatgaattcatgaaaggcacagagtgacccagggctggatatcagccaggttccacgcagacagagtgactgggatgactggatcccaacactcggtgactctcccattcaccaagctccctagtggtctagaataatacccagccacacacctagcgagggctcatagatcttaaaaagttaaagaactactgccactgagcagatttttcatgtctgtatctgcttgcctgccagatttccttcctcttccatctcattgctgaatttaaaaatacttctaagtctatatacattataattgggtaaaataagaaattcttcgtaatttagaagatgtatctctttcctgaagacttcctcctactccacccccaatctccagagacacatttttacccttaagatccttttttttcctttatttcttctaaaaaaaaaaaatgggatacatgttcagaacgtgcaggtttgttacataggttacatgtgccatggtggtttgctgcacctattgacccatcctctaagttcccttcctctacccgccactccacaaaggcccttgtgtgtgttattcgcctcactgtgtccctgtgttctcaatattcaactcttacttatgagtgagaacatgcttaatcctgagattctgagcaagacaacctcctttagagatgtctattgcttggaatgttttaatctgttagatttttgactgcacatattagctttaagaaattagaattgagcattaacatgttcagtttgttttcactattaatttctccataaattatgttagattgcattttttatagtatgtgcaagtgtatgtgcatatacgtatacacacagagagaggctttgagctaaggatggtggattgcccacatctgtttaaatctccctaccaggaaactagcagcaagcatattacttcttcttaccccctcctatattcctgccaaggagggaatttaaaaactctttcaaggagaaacaggtagccagtgatcatcaaacattagagaaagcattcaccgtgacagaggcaggaaaaagaaaattctaaaagaaaaactctagaataaacaaagacatagtaggaatcataaaaaaactgttaagtgagcaatgctgacatgcctgctcctggtaccattattagcagaaaagtagatacaaaatgctttgatataaatgagacatctatatctatcaggttaacatagagataaagtgaacagatgaatttcaagtgatagaatttcctgtgtgtagcacccacattagaggttataagaggataaaatttaaagtaaatttggaatcacccagtcttacgtcctcattatcagggctatggtttaattgttccccccaaagtgcatgtgttggaaggttgacccccaatgcagggatattgggaggttaagcctaatgggaggtgtttgggtcataagggcaccactctcatgaagggattgatgctgttatcttggaagtggattcatggtcttgggagtgtatttcttataaaagcatgagtttgaccccctcttgccttctgccatgttatgacacagcaagaaggtccttacgagatgccagcaccttgatcttgaacttctgtgctttataaattacccagtctcaggtattctgttacagcagcacaaaacagacgaagacagaaaatgggtaccagagagagcagtgttgctatagtaaatacctgaaaatgtagaagtagctttggaactgtataatgggtagaagcctggaaaatttggaggagtaggctgggaaaagcatgcattgctatgaacagaacatttagggtaattctgttgagggctcagaagagaagaaatataggggaagtagagattactaagttgttgtgatcagaatgttggtagaaatatggacaataaagggcattctgatgaagtctcagacagaaatgaggaatagcttattagaaactggagtaaaggccattcttgttataaattggcaaagaacttggctgaattgttcatgccctagggctttatggaaggcagaatttaagagtaatggactcggatatctggtggaagaaatttctaagcaaaatattgaaggagttgcatggttacttttaactgcatatagtaagattagagagaagagaaatgatttaaagacagaacttataattaaaaaagaagtagagcagaaagatttgggaaatctgtggcctggccatgtaatgaacagccatgtaaaggtgctgccaagcaaccctttaataaagggattagtacagctagaaagaagccaggtgctatttatcaagacagtgggagaattacccgaaggtgttttggagatctctgaggctctccctccatcacaagcccagagctctaggagggcagaatggtttcagaggagagtctcagagtgccctccttggtttctctgcccagggcggcctagggactctactccctgcattccagtgtagcagtcctcgaccactccagctgtggctcaagtgggcccaggtgcagctggtgctggtgctccagaaagtataagggtaatctttggtggtacctatatggtgcttattttgtaggcacacaaagtacattagctgtggggccatggtagcctctacctagatttcaaaggatgtgttggacagcctcagggcccaggcagagacatggtacagacagaagtcatagcagatttcccactatggcgatgcctggtggagccgtgggggtagggcaaaccccacaaccctgaccccagacctatagagctactagcatgtagccccagcctgggagagatgcaggtatgaaactccaacccatgagagctcctatgtgggctgaacccagcaaagctatacgggtgaggctgcctgagactttgagggcccaacctcaactccagtgtgttcagcacaagaagtcaaactttattctggagtcttaagatttagtgttcaccctgttggctttttggacttacctgagaccagctacccctttttccctgcttattcgtccttttcaaaatgggcatgtctatactatgcctgttttagttctaggattatattttggaagcacataacttgtttaacttcacaggctcatagctagagggaaatttgcctcaagtgaatcatgctgttagtctcaaccatttctaatttagataacattctggactttggactttgagttggggctgggatgagtgaagagtttagagtctattgagatagattgaatatattttgcatgtgagaaagacatgaatttggtggaccagggatgaaatgctataatttgaaactgttccccaaagttcatgtgttagaaacttgatccctaattcagcagtgttgggaggtggggcccagtgggaggtgtttggatcatggtggcactgccctcatgaaaatattagtgccattatcttagaagtgggctcatggtttctggggcgaattgcttataaaaggatgaatttggcctctcttgctctctcttgtgatgctttccatgtgatgcttttccaccatgttatgacacagcaagaaggccctcacaagacacggatgccttgatcttggatgtcccaggctccaaagggacgttttcattccaatggaatgaaaaacaattccattctttatacgttactgagtctcaggtattctgttataacagcacaaagtggactaagacgagcagttatgttatttacccataatcatataatatattagctgcagaatcaagtctagaattctgattcctaatttctagtcccatgtgatttctattacctaactccataaaatggatggaaatgtctgattctataaggaatctcaaagttccacagagtcaacatatagaacacataaagccaactttatgtgtttttttaaatgtaaatgtgactgatatctaatagctaaaaattcttatcaaatagctaattgttacataattagcacaagtggtaataattctaattactttctttcagattttagaagagctatgttgagaagatttgctaggcctctttaaaattttatcctaggaagttttaaatgggggctttacttttctcttgttaaattttccttaagctcagaatccagtattgcccactgatcaatattttcaaagatagatggcatagcactcaaacatttgaagacattactaaggccttgtcttgtgagttttcagaaagcagaagtcacttatatcttgctcccctcccccatcatctcaaactatgtcgaaatccttccaaaatggcaatcttcatgtaaagaattatttaaaaggagcagccattggcttctgacttaatataatggaaggaaattataaggcagatagtatgtgtatcagactgtctctgggccatgtccaatccgcagctgtgtgcccacttgttgcttctcttggtttgtaataaattttaatgggttacatctaggtcaataataaaaaataagcacaatgatcattcaattcactgaactctaagtctagctactagtgttccaactcgtataaaatctgtgttgaactataaatacagtagtccccccttgtccgtggttttgctttctgcaatttcagttacctgtggccaaccatggcttgaaaatatacagtattttgaaagagagagagaagaaccacataacataacttttattacaatatattgttattatttttctattttattattctcataatctcttactgtgcctcatttataaattaaagcttatcatagacatgtatgaataggaaaaaaacatagtatacacagatgattcttgatttacaatgttttgacttaaaaattttctcagctttacaatggtgggacagcgatccatgttctttgacttacagtagatttattgggatatgaccccattgtaagtggaggagtatcttttaggatttggtactacctgtggtttcaggcatctactgggagtcttggaacatatttcccatggataagggggaaactactgtacaattgtaggacttcagtatgtaattaggaaaagaaaaattaatttgttttcataaacaaatagatcattatagtttacatctgtaaacaatcatggtattcttctgtcaaaacctttccatatcttcttattagttacaaaatacaatctaaactatagagcatggtcttcaaggcaattcagtctgatgcctcaacctgtccatcaaccccatcaactgtattgtttcacttcaaccccagatgctaatcactccatatcatccagactgccttgaacgctgtatgcatttcatgaatctgtacctttcccaagctgcttccgcagttaaaattctctgatcctttgagactcagttcaagtatctatgatcctaggaaatctcttcaacaccccctctttgtcccctctcgtctcagcagaatccattgtttcttcttcattaaagttcccatagcatctaattctatttttatgaaagcatttctcagtcacaccttttttgccatttctgtttctgtttccctccccaaatggtgaatcactagaggaagtcaaggatcatcttatagtatccttgtgtctcaagagtttagtctacccctccacatgtttggtacccattaaatgtttctttaattggatttatgtaagagcttaagagtatttcccatgatttcatttgatgcccatagaaactccattaagcaggatggtaactgactccattaaagcaagtaatccaactgttttaggcttctccaaagagagagagagaagcaataggatggatggatagatggatggatggatggatggatggatggatggatggatggatggatagatagataaggaatttattaggggaattggctcatacaattatgaaagctaagtcccacaacaggccctctttttgttaaatcctttttgtattagttaagggcctccagagagacagaaccaatagaagatatacatctgtatctgtacatatgagaagagatttattaggagaattggctcatgcaattgggaggttgagaaatcctacgctaggctctctgcaagctggagaaccagggaagctggtagcatggctcagtctaatctgaaggcctcagaaccgggaaaattattggtgtaactcttagtctgaggctgaaggcctgagaacccaggtggccattatgcaagttcaagtccaaaggccagacagcctggagttctgatggccaaggacaggagaaggagagtgtcagcgctctgggagagacaaaaaaagaatttgtcttctgccttttgttatctctgggacctcagcaaattggatcatgcctgcccacatgagggaggatcttcctcactcagtccaccaattcacaccccaatctcctctggaaagacccttgcagacacacccagaaataatttttaccaactctccaggtatttcttaatccagtcaagctgactccttaatttaaccatcacagcaactgggcaccaaaaacagattagtgatttacctccaggtcatgtggtcagtcaatggcaggaccagtaccaacccctaggttttccaatcctccatcgcatactttgcaccatcgttgctcagcacctactgagaagtggggacatggtaaagagctaaggatgcttgcaacccaatattcatgtcacttcttgaggtttcagcagctttttcatgcatgcattggctccatggtcacatacaagaaccctctgctttctcatctaagagtttcagagatgccaaagtaacaggattgaggctgaacaatcaccttcatttctaatgtttttcctcacaaaccaattcagaaattcagaaaacatcttactatagtagttgtttcctgaattactaaatggaagctttattaggaagtattctctgttctttctaccaaggcagctttgttccttgggcataaacaaaactatcccttctctctctaaattgaccacagagccaaccttatataaattagaacttgttagttttggcttcagatgccggctctttctcttgaggttttcacctacttaaaattcacttgttgccctttaaattcacatctagcttaaggcaaatgtttgaatttctaaaataaaaccatgtgcccaaaataagcttagggaaaaaataactgaaataaatggaaaattctccaaaataagcaaaagcattaaaatgataatgctttaactttctgaactaaactgaaaataatgtatgctcaagataagcttacaaccacggagagatctctcttctacaaagccttaaagaaaaagcaggaaattacctcagatgaaacttcattacatggcatttccattcccaggatccatcctcagacacgttgacttaattgctctggaaaagagccccagcatcaatatttttcaactttctaggtggttctaatgtcggtcacaatcaagaaatgacatgaacaatattctgaatcatttcagtagatgttgactgcatgactgtgctttctaccagtcctatcccacaccccgcctttttcctaaaataggtatgcatgcagtgtgtgctctgcacacatgcacatacacaaacacacacacagtttcattcatttgtatattcattcaatcaataagttgaattttgccttcgtgcaaggaaccatgactatcagcacaaacaagaaactattcctgaccccaagagattcccagtctaggtgtggagaatatgaagcacagaaatgggaacaactctaggtaggaaatggaaagagagcaaatttttttttttaagaggcagctgggcacagtggctcacacctgtaatcccagcactttgggatgctgaggcaggaggatcattggaggcaaaatcaagtgtacctaacagttttagaaaattgtacatcgtatacttccactttccatcgtgacttctgttcatagtttatagatgtacaacataaagacataattcctaaataaacaaagcttctgtgaaagcataatgtgactctgcaggcctgctggcctgtcttattattgatctgaaaacaagattgacactactgtgattattctttagtgggaagggacattcatacttatttagccattgctatgctttcaggcaaatcaacccctcagtaactccaggcaaatgaatataggcctttcataaaaagtgtcttggagagaaagcccacaactgcaattaacaggaaatagctgatgcagtgtgacagcaagtccccaaacccttaatggaaggattgactgtcatgtgcatggagatgtggttagagaggaaataagttactgggttttgtaaggcaccaacttgaaaaacatgaaaagctgtggcaggccacaaacatggagcccatttggagtagaggcaggcaagtagaacggagaaccgtggcatttcaaccctagattaatctgagtgtcgcttttgctgccactacttaacaagagtagctgtagagagtgaaacatttttcctaaaatgtcatattttctctggtagctcctgttttcttctttgtatcacattatagctccacaaagttcatgcaaatgcataactaaattttgattatgagaggtctcagaatgcaacttgtttatgggaagaatatcattagtatagtttcaggcaattccttgcaaactatccccagtttaaaacagtcacaccttagtcaacaagcatctattgagcaacccactttcgacctggcattatggtaggtgcaaaggctaaaaaaaggtagaatgagatagaacctccacggaatatatacaataacaaattatttttttaaaaaactggatataacttgagaaactcttctgtacaggcattctggagtgagctgcaatccatcattattcagaaatgcattcatgcattacacctttgtcaagccaagttccaggttctgtgcttggtgctgggaagattgaaaggtcagctgaagttacagaaggccacgatgccagcacagctgctgcctactctttcgcctgatttatttctgttatttcttttacaattgtgattaaaaaaacacataacaccaaattgacgatcttaaccatttttaagcacaagcagagtcacgttcagtgactccacttcagtcaagttcagtagcattaagtagagtcacgtttacgtgcatctggtctccacaactctttcatcttgcaaacccaaactctataccatgaagtatccaaagtactcatatgtatcaaaacagagagtaggtggttgccaggttgccagggcatggtggagggggaagggaggagttgttgcctgatttctttttaaagctcagtcttccctttggcttctggttctaagcgtgttagcatcacggccccttttcattatcctaaaggacagacccagccctggttctgcaggtgctgaattctacttgactccaaagaggctcagcctctacctgcacccaggttctgctaacttggtctaccctctgttgtttttcctctctgttttgttcccatttgtaagatctctgccaaacttacttatttgctgcttttcacagacactagaccataccacctcctgggtattcacgatccatgcctggcccagctgactgttctcttattccaggctgttcgctgtttacctcgtccctcttcagcatcctcaatatgcctgcataatgcatatccatttttctccccaaattaaaagctatggccactgtatgttgaaaaatgcttaaaaccccacctaaacattccaggaagcaggaagccatgaatgactttaaaccaagaacagtctcaaaaatgttgtggtttccagtatgtgagtctcggacttcagcatattgctgttcatatgccacacaaatgttctgtaaagtcccattgagaattatgtgcaaatttaaatgctctccagacaatttcaaatatcagctttgatgcaagacttcacctgctaaaagcatctctttatggtttgacactacatctctgacattttgacgtgatacatattccatcagcctgatacattgccacctcccagtgagtcacagtgtcactaactcagaattaaatatgttgctaaaccactttacagcccttgcaaagcacataaaggctgtttgacaattacccccaggaaggcaaataatcagtacacctctgattctcttattattaaccattataaaatcatgtgctgtgatcaaggtgtgtaacaaagacattgatttttataagactacccaggaagcaaatacatattcttgatatacgaaacacacaggaggcctcttcattttcctttgtgtctttaatttgctcagagctgctcctcatacagcactggctttcacctgtcaagctaaggctttaattactgagttatggaaaaatcattgccaattgccttaactacaataataaagaatatcttacaaaggataagaaatcttttttcttcggctctgtagttaaaagactagttctagttttaatctgaacttttctatttctctccctatatttccctttcttcctattttaattgctggttagataattaagtaggtacctgacctgcaccaaatgtgcttgggaaagtctctcgtattttcgttttgctttgttttgtttctgcatgccattgaaacccctgtgttaattattctttccttacttgaagtatcttatacaacctttcttcaccagtatccttttcactaggccaaatacttattttggagtctcaaggatgattttctaaatcttttcataaccgcttttagcccttactcagttttattgtgcctgcccctcattgcacaaagggatatatttgactattccatggcatatttgactttgtaattcgtaaattatttttcatgtcttacatggttaaagatacgtttcacttgagcttgtaacagacataaaaatgacccatggtaaacctgtcgtattagaaaatcaaacaaaaagcataaggagataacacggtaaaaatgaaaagagtacaagctttagacccgtgtggatccgagttcatatctaacttggccaactaatagcttgttaattatgttaccttaggttgtattttttttttttttttttctaatttagtctcggggtctccgtgttctagctccgacccaagggggttcccgggacgtggttgtggatgttcagtgtgcctttaactggatacttctttatcctggcagacggcctgatgcccaggtgtgacttgtggccaggtgtcccacaaacaggaaaacctgtttacactggcagatggccttgtggcgtgctatagtctgaatgtctctatcctcctaaaatccgtaaattgaaacctcattcctaacgtgatggtgttaataagtggggcctttgggagatgattaggtaatgagggcagagccttcatgaacaggattagtgcccagacaaaagaggcccaaggaagcttgtccacctttgtgccatgtgaggacactgctggaaggcaccatctatgaagcagagagtcggccctcatcagacaccaaatctactgctacctctgtctcgggcttcccagcctccagaactgtaagcaatctgctgttgttgttgtttacaaattacccagtctaagatattttttatggcagcccaaacagactgagacatggcttttgtctgctctgtgtctagtgtatgttttgttttggttcggttttaagtttgtttggtttttggtttttggtttcgctttgtttttgtagacaacatcttactatgttgcccagactggtcttaaactcctagactcaagcaatccttcgcctcagcctctcaaagtgctgagatgacaggcgggagccaccacgcccagccaccctgtgtctagcttattcctaccaagagaatcactctctgtgaaagctctgagcagaaggagagttaggttcgcgtgtgttgctcaggtgagacaaagaggagatcatacagcaaaacacatgaaataacagaagcagcgtttgactcacagatccagagcagagagggcagcctgcctctcagggccaacaggaaaggggagctgtcctggacacgcaggctccaccagtgtggggagcaaaagagatcacaagagacctcagggcctaagactttgttggggtctcaggagttacccaagcaggtttcctgctgagagttctaatgggggtgggtggtggggggcgttacagcaacaattaccagtttcatggagccacactgtgcctgagcggtagtaactgtggcatctccatgcagtccatgcagcgggaggggtcttgggcgtgagtcaggtaggttgtattgagctgtcccctggggaggtgggcactagcagatacctggattgaccgccttgaggagctaggaggaagcagagaactagaaatcatgtcaagattcactaagccctgcatctgctatgagaaagtccaacttacaatcaaaatggatgcccaggcaacataaaattgtaagatttcgctacgccttaggcaatgaaacttggctgccttccagtgaatatttactgagcgtctagcttatttgagaaaccataatagacactacagggactgcgaagaatgggaaataaaccaattacacaatcacccacatagcagcgatacaaggccagccatatcaaacaacccaacagataaacagttcatatgttatatggtgtcagaagtaagacacatcaaaaaatggtaaaatacgtttgatactactgtccttataaaatcaccaaccataggaaaaatgatttttattaatgacagggatataatgaaaatagtttatgtgtgaaaacacataagtaattacataatacattatgatcaaaattagatacagcattgctgggcaagacctttttctcctctaatgctgtccttcaatattattaccaaaatatagcaccagtttttgtttttgtttgaggcagggtctcactctgttgcccaggctggaatgcagtaatatgatcatggctcactgcagcctcaacctcctgggctcaagtagtcctcccatttcagccttccaaagtgctgggattacactcgtgagccattgtgcccagccagtacctggttcttaattaactatatgaaaggcaaaatctgttttgctgctgagcaattatagtactatgcattatgtgtgtgtgtgtatgagtgtgtgtataacatgtagtttatatccatatataaactacatatagtttatatttaattgagtgtagacaatttataggttataatatctttagttataacattcacatgggtgtaattttttatactattctaatttatcattcctttctgttttaccttcaactctggttgaagtaatgtagttactatctgttttccgagttagacttccacttttcctctctggctacctgacaccccaagctagtgtaggtggctatatcattgcctggaattgaagtttttaagcctctgataattcagtctgtagaagctacccagctcaagaacaaaggggaaattacatatttcataacatgcttcaacatgaatgcatttaattagtatttataaatttgaatcaaaatgcaggaaatattctaaaaatataatttctctagaagagttatataatctctattaatgtaggccaactgcttctgtttcaaacacagaagaatgttcttcaatttttcatttgtgaaactgaatagtctcttctgaaagagtatatagtatttttccttttgggaatacaaaagcttttacaaaatgattatactaatcatcagatataagagtagtaccaattctctacctagaatagctgttaaccatggcacttggtgaattgggaatagacttaaatgatgcttctccttgggcccccacctccccaactcctacctttctcgaaaccaggctatttctctccaaatctcctttccttttgattcttcagttcgtgctacatgataactacttgccattggtcattaattatggtcgacgctcattattcacaggagtatgacccataaaatcactgcaaacactgaataagttaatactgaaccattgcccctagagggaattcagggttaagttcctgcaagcctctggtcacagtatattcatcaacctatcaatacataacgttattttatgcatgtttctgctttaagacatcttacttaacatatgtttttgattcattaacactgaactcatggccaacagctctataactaatgtctgaaaaaagcttatctaataggcatgttttccccataaggcacatcacagccttcttgtgcttaggaacactggacgacactcaacactgcgcttgggggccatttgaaacagtaatatcaccaataaaaaaaaagcacaaaaatgtcagggggaaatgtggcagtaaataggctgtgaaaaagacatttgtttgcagtatgagctaaaagaaggcagggcatcaccttgttctacatcagtagggatcatgagtgttatgccactcaatttttttgccagcctgtgtgtacacgtgtcctcaaatgaccatgaaagcactgcaagtatagatttggggattacaaataaatttcaacaagtagatgagtttgcaaacatggaatccgcaaataattactgttgactacaccatccttttgaacaaaaataaaagccacaattcaacttgagattggttatagatggcaactggcatttagtgagcacctgctatgagctgggtgccttacttttttttttgttttgagacagagtctcgctttgtcgcccagtctggagtgcagtggcaccatctcagctcactgcaagctccacctcccaggttcacgccattctcctgcctcagcctccccagtagctgggactacaggtgcctgccaccatgcccagctaatttttttttttttttagtagagacggggtttcaccctgtgagccaggatggtctcaatctcctgacctcgtgatccgcccgcctcggcctcccaaagtgctgggattacaggcgtgagccaccacacccagccactgggtgccttacttttagtaacacattgacctgggatgtgatcaactcgagaaccacatcactgtcatgtagctgcatggagctgtatcactcaacttctgggggcttatgtttcataacaattatcttttataaatgttcaatttaaaaatgaaaaacttccccaccccaatcaccacctcctttccccctctcccttccctttaatgaaccatctaagggaaggacatgtgtgcttctttgacatttcttcacagaatccagtccaatggcagggaggctgggtgagggtcagtgtcagcctagccagtagggaatccatggagctggggcatgtcaggggagtgtctcttactgagaactctgggtcctcttggatcaaagaatgtgcaaattgagctaagagatagaggggaattcgagaagatcacctaaaatgggcaaacaggaggaagctagatccaggtagcctgggagtcaagaacagtgagccctgtgtgagctaaaaaaccagaagcaaaccttggccaatggctggagctggtgtttttgctcaagcctggctttcatgggctccccttgatgtgagtctcagagtagggctggttaagtggccaggacctgagaaataaaatctcccttatatactcttgagagaacaagtctaacatatcagtaaggtaatagctataaaaatgtggctaggccgggcgtggtggctcgtgcctgtaatcccagcactttgggaggccgaggctggtggatcacctgaggtctggagtttgagaccagactggccaacatggtgaaaccccatctctactaaaaatacaaaaaaaattagccaggtgtagtggtaggtgcctgtaatcccagctactcgggatcctgaggcagaagaatcacttgaacccaagaggcagaggttgcagagagctaagatcatgccattgcactgcagcctgggcgacaagagcaaaactccgtctcaaaaaatagaaaaaataagtggctaagtcagtagtgaaactacgaagctaacttattacatttttcaccttttgaactttcaaacttgagtcatttatggacatctttgaagggaacagttattataaactctcactgttgacctaattaacattataatgtcaattatatatgtatagaaagaattctagatatacactcctgctaatatatttctaagattttttaatgttttatgatatacaaatttggatataagaaaaattataaaaccaacaaaattaaaactagtaaagtgaatgtaacgagataggctgtatagttcacaccacacaatgtcgtttagtcgacagtggaccgcacagataacagcagttccataagattatagaggagctgaacatttcctatgcctagtaacatcacagctgttgttaaggtcctatcacaacacattactcctatgtttgtgatgacactggtgtaaacaaacctactgcactgccaggcatatagaagtgtagcttatacaattatgtacagtaatacttgataatgataatatttgactatgttactggtttatgtatttgctatattatattatacattttatcattcaagtgtattccttctacttattttaaaaaatttgctgtgaaacaggcagggtacagtggctcatgcctgtaatcccagcactttgggaggccgaggcaggtggatcacctgaggtcaggaggttgagaccagcctggttaacatgcagaagcctcatctccatgaaaaatacaaaaattagccaggcatagtggttcaccctatgatcccagctactcggaaggctgaggcagaagaatcacttgagcccgggaggcagtttgcagtaagccaagatcgcgccactgcactccagcctgggtgacagaacaagactctatctcaaacaaaccgaaacattaagtgtgaaacaacctcagcaggtccttcaggagggattccagaagaaggcattgttaccataggagctggcagctctgtgtgtgtcactgcccctgaagacctcgcagtaggacaaggtgtggaggtggaagacagtgatattgatattcctgaccctgttaggcctaggctaatgtgtgtgtttgtgtcttagtttttacaacaaatatttaaagtacaaaaatgaaaaaattcaaagtagaagaaaaggctgatagaataggatataaagaaaaaatatttttgtatggctgtacaatgtgcttgtgttttaagctgtgttatcacaaaagagtaaaaaagttaaaagaaattaaaagtttagaaagtaaaaaaagttacagtaaactaatgtgtattaaagaaaagtatttttttacaaatttagtgaagcctaagtatacagtattttttaagtcaacattagtgtacagtaatgttctaggccttcacgttcactctccactcactcactgactcacccacagcaacttccagtcctgcaagctccattcatgataagtgccctatacaggtgtgccattctttttatcttttactctgtatttttactgtactttttctatgtttagatatatttagatacacaaataccattgtgttacaactgtctacagtatttagtacaataacatgctgtacagatttgtagcctgggagcaacgggccatagcatatagcctaggtatgtagtaggctatacagtggcagtttgtgaagtgcattctgtgatgtttgcatgacaacaaaattgcctagagacacactcctcagaatacatctccatcgttcaggctcagcaatgcatgactgtattagtaaactaaatttccactttcaatgagaattttttcagtgtagcttgttttgagttcattttgcctatacactataagtttgtgataattcaattttgctactacttttttctaatcaaactactatcaaatctccacccacagagcatacttttatgtaatttgctttcacttgggccaaatatcatttttgtattaagttggcctatgttcttttctcaataggtaaccaaaattaaagcagtagcatttggcagcaattacaaacagaaatgagagcatttatgtcctggcgggagttggttgttaagtggccatccggaagttatgcaatatgttttctttctcttttcttttctgtttttttttttaagattgctattgaaatgaaaacagaaactgcaccaactgatgttaaagataaatacaaagccatcgtaattaaaagagtatgtcacaaatgcaagaataggcagaaggatcactggaactgattagaatgtcagaatactgtttacataagaagtagtgcatactgaaactggcaatttaaatgaacggggatcctgcagtgtaaaactctgaaataaacaaacaaataaataaacagggatgaagacaaattttgctaagaaaattatgtgactatactttaaaaaatagtttctattttacgttagatgctaaaatgaattccaaagaattacagacttcaatgtgcaaagaggaagaatgcatagaaaagtgatactaaaagcaattcagtatttttctgttctctaaattttaaaaagcccttgtggctgggcacagtggctcacgcctgtaatcccagcagtttgggaggccgaggcgggtggatcacgaggtcaggagatggagaccatcctggctaacacggtgaaaccctgtctctactaaaaatacaaaaaattagccgggcgtggtggcaggtgcctgtagtcccagctgctcgggaggctgaggcaggagaatggggtgaacccaggaggcggagcttgcagtgagctgagatcgcaccactgcactccagcctgggcgacagacagagccagactccgtctccaaaaaaaaaaaaaaaagcccttgtaagcataaatacaaaggaaacttggtagatatggcaacataacaattaaaagttcatgtaagtacaaaaatcaacaaattaaaaactgagaaactggaaaaatatttgcaatacattgatataaaaatcataatatgtttttaaaaacttttaaaaactagcaacaaaaagtaaaagatgaacaaccaggtgatggaaaaaaaaaaaaaagatccagaattgttcagtaaaggtgtaaaaagtgtttccaatcaaagaaatacaaactgaaacaagaatataatattttattttggttttggttttgtttaataagcagaaaatggtgaggcatttttgacaagcaattttgcaagacagatcaataatctttaaaacgtatgtagttcttgagcaaggattttcacctctaaaattatatttcaaagaaataattgtagaccacatgcaagattttttttacagattatttgtcataaagttatatataattgtgaaaaatgcaaatcaatgatatctgtcacccagaaaggaaggaaatggttaaatacatttaagtttagccgtataacagtattccttaaaaataagtctcctaggccaggcacagtggctcacgcctataacccagcactttgagaggccaaggtgagcggattacttgaggtcgggagtttgagaccaggctggccaatatggtgaaacctcatatctagtaaaaatacaaaaattagctgggcatagtggcgcacgcctgtagtcccagctactcgggaggctgagccaggagaatcgcttgaaaccaggaggcagaaatttcagtgagcctaaatcacgccactgcactctaggctgggtgacagagctagactccgtctcaaaaaaacaagaaacatcacctaaaaaaaagtctttgaagactattaacatggaagcatgataatggtataattttaataagaaattatgatagaacactgatagaatattatcccagttttacaattccacatgtatttacatgtacctgggaaaattataatgaaaatgttaacacatttttttcttgtcagtaagtgcaggggaaccttacattttctttatggttttctgattattccaaatattgtaaaatacacattattcatatacttttaaaatgtggatcttaactgttttcctttaatctgctatcttacctttttaaatctaggaaatgtatgtatctcaaaatggtaaaactgaatatttaatattctagaaattaatgttttataaatcttaattttcttctcagtaatattgtataattttaaatattggcagattgtcagctatggctgtgcctatttaaagccaaaactcctgccaattttgtgaaaacttacgctcattatctagatttttgtttgtagtacgataaatattttcaccgtactttacctgctttggcaaaagatagatggcagaagaaggagctgattaaataaccaataaatacaagagaaaatctgggacattttttgcttttattattactttttataccattatgctggtaaattatttataatattatgattatgctaggattatagaacgaaaggtaataagttttatggattgtcagtaataataattactgtaaattgtcttttaaaataatgaaggctaaaatacttaggtattgagagtgttttcttcttgctactctgtgatgtatcgttgcagcaggctgagataatggaaaaggctgagagctacaagccaaaaagactgggtgttgagtctctaattccacttcttttttttttttttttttcaagacagagtctagctctgtcgcccaggctggagtgcagtggtgtggtctcagctcactgcaaactctgcctcccgggttcacgccattctcctgcctcagcctccagagtagctgggactacaggtacccgccaccacacccggctaattttttgtatttttagtagagacagggtttcaccgtgttagccaggatgttcttgatctcctgacctcgtgatccacccgcctcggcctcccatagtgctgggattacaggcgtgagccactgcgcccggctaattccacttcttattagctctgggattgtggacaatttctctaggcagagcttcctcgtctgtaaaatatgaatgagtctaatatgtatgcatctagtaatctgatttaatcacaaaatgggactagactatacagtccttaaagaatctatcactatgacttctctcagtggcctttttttttttttttttttttttttacagagctggataataaagagcttagaattttattcctgaaaggcaactagagtgctaggcattctgggtttctgatagaagacatgcacataagctttagcaaacactcagaactctatgctccctaactacaacttcgccagagtgcagaggccaactcttttcctttaaaaaactaactccaggatgtgttcacatggtcaataagatctatagttctttgctgatcatcccctgggaaacttttaaaatgaagtctgacacattacaaaccatgcacagaaacaaacaatatcagtaaaactctcaagtaatgcgtggttttgagccatgtagagtccaggtaagccttccaagcttggttaggtgcaaaacatactttctccagtatgtaaattaataggaatctttttttttttttttttctgagatggagtctcactctgtcagccaggctggagtgtagtaccacaatctctgctcactgcaacctcttcctccctggttcaagcgattctcctgcctcagcctcccaagtagctgggattacaagtggacaccaccacgcctggctaatttttttgtatttttagtagagacgggttttaccatgttggccaggttggtctcaaactcctgacctcaggtgatctgcctgcctcggcctcccaaagtgctgggattataggtgtgagccaccatgcccagcctataaataggcatctttgatggccttttaaaacaaccagactttgtaggctatctgcaaaagataatagtttgaaattttaatatttatttaaatagtcctcctgatggtaactgatcactaacttttgaagtgcgttgggttggactcagtaaaaatctcagcaatagcttataggaaattattcttctgttttctaaggcaggaggctatgcacccgtgtcatctaaaagagtggcccatggtgctatggagcaagccaaatcttcattgcagtccagttctgtcatttaccaaatctgtgacctccagagagctgttttattaatctacccctcagcttcttcatctgtaaaatgggacaatgatagcccttctcttccagattaggcacctaatgcagaacctagtgagatctaaatatatattagctacatctattattatgtttataaagacaaaggataaatggtagtcctgttttgtcccactcaaagctgttctctgagccacaaaaagactgtttcagctgcatgccaagttaacacattgcagttaagaaggaaaagcattgcagttaagaaggaaaagcattgcagtagagactagtccgtgaacatctttgtcctcaccattcctatcgccttcttttaaatgaaggaggcagtgggtttcttatattttggtccccatgattttgcaatttatagccttgataacctggccacagctaattaagccaaggttcggggctcattccttaggccgtgatgtgcaacttggcctgtaccctctaacatggcttctcatgagaactctacctaacagaaagttctgtgttgaatagcgatgaacggattcactccaaccttctctcagtgactttgaataaaagatatgcagactgtatagcagcctaaagagtgggctctgttccctcgcaaattttagcatactcattgagaagggagggagctttggggagacagtgagagaagagaatttaaacattgtgggcaatttcttctgcccttccatttgctgtggaattttccagccattttatgttctgtggatttttcatgcttgatatggttggtttctgggatgtgtttcagtcaacattgacccaaaaaccatgcagtcagttttctgtctaaaagccaaagctgtaacctcactgatattgcagaaatgtttctatcactttctgacccctaaaagtgcatgtctcttagatcatagctttgctggtatcaagattacatttttaacagtataaaccttttacatatgcagtagcaattagaatgctctccccaagaggaggacattctctgaaatcccaagtaggagtgaacccagagtagcatagcatatctgctaacttgattccatctgtctttgttgcaacatgctcactgagcatatgcccctaaatgaatatgagatgaagacaggatctgtggtccctcccgcaacattgatggggtaagtttttttgctaggctgagtgtggttcaaatatttttgtacaatatatatcctaaacacaaacaactacttcgtctgttgcccacccaaaaatatgctgatctgttttgtgctgaagtatgatcgttcgtgttggcgtccttgagaagtaatgggataaggtacttgaagggcgatttaagagctttccagagcagcccttggcttttcttaattttccagttttgcaacaacttttagagcccaatcctcatgtaagctttggatccactggaattaaaagctcagactttatagacaaacagacctgggtttgaatcctatttccatcacttgcctttaggaaagttgctcaacttttctgagtcttcattttctcatctgtgcccaccctcttattgcagtgaggcttgagtggtattcacagccctcggtgcagtcacttccatacataagagccactgttgttgttaacatagtttagaagttaagagagtcacaggcgtcgtaaaccctcagatagtaccagtcatgaggaagcagaattcactaagcggtgggtaggagggtgcacaagtagccaggtatacaagtagccgggagctgctgagtgtcccaggtctccatgaggatcaatcgctcaatagcttggatagtctgcgtgtggataacacatcagcaaggaatagagacaacgccttaaaacagactttcagcatttctggtgtcgaaaggtcctaacatgaggtctcactaaattcgagatttcatcagcctgagaagaactcagggtaaaataagagtagtaatacacaccccttttaacctgggttagaatgcgtttatgagtgtgaggtgatcttcaagtataaagccctatgtggatgtaacatgatagcagattataaatattaatagcattttaagtcaaagataactatttagaattgtgaataatagagaagaaagactgtgggcatcactgtacctcctaccctcagttaaaacttactgaaggaactgaaggttaaacattcttgataaccattgtatttctgcagtgtctcagaagtattactagaagacaagcatgggatttagagttaaactaaccttgggttcaaatcataatgctgccactccttgactgtgtgatggtggagaagttatttcacttctctaagcttcaaattctctatcagaaatgttttttctgtagctatctgcttaggaacaaagagaaaggcagcttcctgcatgactcagcttccagcttattattattattattattattattattattattattgttattatttgcttttgacaaagtgaactgaggtcccaagtttttatttccctttcacagagtcaagtttattggtataatcctgctaagaagtacttaaaacaaaaactagctattcacaaacaagtcaaatatataccctctagagtgtgttgataacgtgacttagtacatgaagagagagcatggtgttcaattgtgcaggtcaggtgaagctagtctttcatgcctcatcacaagtagcagatttccattaagaattggcaagctctcaaagctcagactctcccagagcagagcaaacaggcagatgcgaatacatgcctatcccagcagcatctgtttatgccagtggggagaaaccatcccctccacacacggttaaacaagtcagtgtgcagcctacctccagggcccttctcgttttgcctgggaatgtcctgggtggcttgtaggagatgaggatgcagcttggggcagccaaacctggggcatttcagaggcagagtataattcatgtggcaatacctggctctttatggcccgtagttttacacctaccatcctctgcacacagaaaactttaggcagaaatggagcatgcacaaccaggtctgcatatccgagagtggtcatttccttgcaaggcgtgtcgcttgactgaggggactagggggctgcagaggggctggcagatgtttggcttttggtgcagatatgagccaaataaattgaaaataggaagaaggagtacatgacctcacccaaattttaattcccatagaatagttttttgtttgtttgtttttagcgttgtatgcctaatagggtaaatgttattcaaaaaatagcccaggtgttagaaagacaaaatagttgttacctttagggaaatggttgtgaacaaaaggggcacacagggggtgtctgggccactaataatgttctgtttcttgatgtggattcgagttacatgggtgtgtcactttatgaaaattcatcaagggccatcaagggctcggtggctcatgcctgtaatcccagcattttgggaggccaaggtaggcggatcacttgaggtcaggaattcgagaccaacctggccaatgtgatgaaacccaatctctaccaaaaaaataaaaaataaaaattagctgggcgtggtggtacactgctgtagtcccagctgcttgggaggctgaggtgggagaatcacttgaacccaagacgtggaggttgcagtaagtggagatcatgccactgaactccagcatgggtgacagagtgagaccccatctcaaaaagaaaacaaaaacaaaaggtctggcacggtggctcacacctataatcccagcacttttggaggctgagcagactaggatcacctgaggtcaggagttcgagaccagcctgaccaacatggtgaaaccccttctctactaaaaatacaaaattatccgggtgtggtggtgcatgcctgtaatcccagctactctggctgaggcaggaaaatcgcttgaacccgggagagggaggttgcagtgagctgagacggtgccccattgcactccagcctgggcagcaagagcaaaactctgtctcaaaaaaaaaaaaaaaaagaaagaaagaaagaaaattcatcatgctgtatacttataatctgagtatttttcttcatgtaggttattaaaaaacagcagaaatattcttctctcaaaagaaatttctatattttaaaatatgcatatttatactatacatatatttatatttaaattatatatatatatttagtaaggaggggaatacatataacttgatacaaagtctgcactaagttagaatatatctaatgcaaattaatacttgagtgcatattaagatatatcaaaatttaaaaattggtcaaggtttttaagtgctttgacagttacagtaaggtaaggttctacataaaataacatgagtattgtcagcttccaccttacatttccaggaatagtcatttttcatgcattcattatattcttttcagcatcatttgcagagtttttgaacttctaagctgtaccacacagaaatgccataacactcattttgactatttcaacaaagtattataactaagccattaattgatccactagctttgctgttgggaaaatttacttattttgtaaatacagccacattgacttttaaagtcatctaaataagcttgttattaaataaaaatgttttgaaccttaaaactgctttaaatgattttaaataaatggtttatatttttttctcagtagtaataatttttctgaagtatttgcttattgtttttaagtgatttctttatacatatatatgtatatttacatactatgtgtatatattaggcaatattaaatgacctgaagcttttgatcaattctaatagaacagacaattgcaattctaaattagctctcataaaatggaacattttgcaagtagctaataaatatttgttgatcaatagttataccttgaatcctttatctattagaattttccagacaacaaactcatattgtttctcctttaggttcatttggatgtatcaacatagtaactcttgttacaaaaatattttaagtttaaaatcaattatttggttaaattctgtatgcatattttaatagttaatagacaaggtaaaatcagctcacttccatgtgttcaatatttattgcttgaaaattaaggcttataaattagagtatgctaactatgcctttttgttatagatcctcagcgctgttggttgtattatggaatagttaagtataggctctgctctccagacaccaaaggtttaactcagctctgtctttcaccaggcttgagcaccaaaggggaagtcagagaaaaagtaacagcaagtgaaataaaaatagaattctcaaaagcaatagttgaaagacaagaccacagaatggtatgatcaaagtgttgagagaaagagaaacagaaattgagagtttgagaccaaaaggtttttcattaaagcaatctctaaaggatttacttaatttttttaaataaaagaaacccagaagaaatgtctgaggtgtaagaagtattgatcaaagacattaatgaagatataggttaaaggtttttaaaactgtgtaataaaatattaacatcaaaattaatgtgttttaaaaaggagtaaatgaaacaattaaaaatgaagtctgttagaaagagaataatcaaaattacagttttttaagatccttgtattttaagaggatttaaaagagtgattaactttagactttcttaagtatgtaagatagaattccaaagtgcccactttttaaattttttattatttattttttgagacagactgtcattctgtcacccatgctgtagtgcagtggcatgatcttggctcagtgcaacctccacctcccaggttcaagtgagtctcctgcctcagtttcccaagtagctgggactacaggtgcacgccatcacgcctggctaattttttgtatttttagtagagacgaggtttcaccatgtcggccaggcctatctcaaagtcctgatctcaagtgatccacctgcctcgccctcccaaaatactgtgattacaggtgtgagccaccacacccagccttcaaagtgcccacttaatattaaataatatataacttcaaaaccagaatgggggaggaaatggattaagaaaacaaatataaatcatctattcagaaagactaaacaatataagacaataggaacaagtctgtctttcttgcttttacatgtgtgcatgtgtgtgtgtagtctagatacctagatagttagataaatagatatagatagatagataaacagatatagatagatagatagatagatagatagatagataaacagatatagatagatagatagatagatagataaacagatatagatagatagatagatagatagatagatagatagatagatagatagatagatgatagagagagagagagagagtgtgtgtgtgtgtgtgtgtgtgtgtgtgtgtgtgtgtgtgtgtgtgtttagtccatggcagtggactaaatatactagctaaaagatcttgtcaaattagtttaaaaagaagctaagtggtttttttaagacacatctgaaataagaggactcagaaagcctgaatggaaaataatgaaaagagacataatatgcaaataataattaaaggaaaaaccgggtaactataatagcaggtaacaaagacttcaaaaacctttttagaaggtagaaaggatactgaattatggcaagcgattcattttgccagaagaacttagcaattttaaacttgaattcgcaaaatactctcaaaatatataaagcaaaaattgacagaagtgcagggagaaattgataactcaaatatcatagaagaaaatgtggcatattaatttcagaactgatcatttaggcacacgacaataagtaaaaatagaggtttccaccaatataatttaaaaacttgattgacataaagtctaaacaaaataaagaacacacattcttctaagatataaatgaaatgtttaaaacatttatgactttctaggggaaggtatcttaaaaatacttagaactgaaggacaataaataatcctataaataaatattcatgagatgcaagacaaagatagttgtagttattttacactttaaatgcttaagtaaaaaatgagttaaggctagaaactcatagctaaattcaaataaagtaaaagtatgtgatgatgtaagagcagagcttaatgaaataaaacttgaagttatagtagggaggatcaacatagtcacaagttagtttcttgaaaacagaaaatcctccagcaaaattggttaagaaaaaaggagaacaccacaaataatcaatacaagaaatgaaaatggagataattataggtagcagacactttaaatgacaataagagaataccatgaacaaagctggccaaagcatttgaaaatttaggcaaaatggatgaattccatctatagtatatatgtatcagaatattatttttattgaaagatattgtcactgggtatcgagttctaggttgacagttcattatttttttctttcttattttaaaggtgtggtcctactgtcttctggattgcattatttcctgtgagaaatctgtcattgatatgtttgctcctttatgggcaattgtgtcctttttctctggctgcttttaagaatggccttatgatatacctcagtgtagtttcttccattcatgttttaatttaaagccattatctcttcaaatattttcatcactctcccaacccccacttttggaaattcccattatacatattgtaccacttgactttgccccacagctcattggtgctctttccttttttcttttttcttttctagtagcttttttttcctctgttttttattttggatagtttctatcactgtcttcaagttatctaatcttttcttctgtagtgtctaatctgctgttagccctttccagatattttttctttttttaatttttttttttatttcagtaggtttttggggaacaggtagtgtttagttacatggaaaacttctgtagtgggtgacaacccactctttgggttgtctgtttactctgctgattacttcttttgaggtacagaagctttttagtttaattaggtctcatctatttatctttgtttttgttgcatttgcttttgggttcttggtcatgaagtctttgcctaagccaatgtctagaagggtttttctgatgttatcctctagaatttttaggatttcaggtcttagatttcagtcttcgatccatcttgagttaatttttatataaggtgagagatgaggattcagtttcattcctttgcatgttgcttgccaatcatcccagcaccatttgttgaaaagggtgtccttttcccactttatgtttttgtttgctttgtcgaagatcagttggctgtaagtatttgactttttttctgggttctctattctgttccattggtctgtatacctatttttataccagtaccatgccatttggttgactgtagccttatagtatagcttgaagtcacgtaatgtaatgcctccagatttgttatttttgcttagtcttgctttggccatgtgggctcttttttagttctgtatgaatttaggattttttttctagttctgtgaataatgatggtggtattttgatgggaattgcattgaatttatagattgcttttggcagtatggtcattttgacaatatttattctacctatccacaaggatgagatgtgtttccatttgtttgtgctatctatgatttctttcagtcctagccagagcaatcagataagagaaagaaataaagggcatcaaaatcagtaaagaggaagtcaaactgttgccgttcactaaggatatgattgtatacctagaaaaccctaaagactcatccaaaaaacctcctaaatctgataaatgaattcagcaaagtttcaggatacaaaattaacatacacaaatcagtagttctgctatacaccaactgcaagcaagctaagaatcagatcaagaactcagcctcttttataatagctgttaaaaaaaaaaaaaaaaaaaactcaagaatatacctaaccaaagaagtgaaagatctctacaaggaaaactacaaaacactactatcttttgtatttttgtttcagtttcattgagttttactccgatctttgttatttcttttcttctgctgggtttgggtttgctttgtacttgtttctctagttccttgaggttttaccttacattgtctgtttgggctctttcagactttttgatgtaagcatttaatgctatgaactttcctcttagcaccaactttgctgtatcccagaggttttgataggttgtgtcattattatcattcggttcgaagaattttttaatttccatcttgatttcattgttgaccaaatggtcattcaggaacaggttatttaatttccatgtatttgcatggttttgaggattccttttcaagttgatttccaattttattccactgtagtctgagaaagtacttgatataatttcaattttcttaaacttactgagacttgttttgtggcctatcatatggtctatcttggagaacgttccatgtgctgatgagtagaatgtctattctgtggttgttgggtggaatgttctgtaaatatctgttaagtccatttgttctaggatatagtttaagtccattgcttctttgttgactttctgtcttgatatccagtgctgtcagtggaatattgaagccccccaatattgttgtgttgttgtctatctcatttcttaggtctagtagtaattattgtccaaatttgggatccccagtgttaggtgcatatatatttaatattgtgatattttcctgttggactagtccttttatcattacataatgtacctcttcgtcttttttaactgatgttgctttaacatctgttttgtctgatatatgaatagctactcctgctcacttttggtgtccatttgcatggaatatctttttccactcctttaccttacatttatgtgagtccttatgttaggtgagtctcttgaagactgcagatacttggttgaattcttatccattctgcaattctgtgtcttttaagtggagcatttaagtcatttacattcaacattagtattgagacatgaggtactcttctatttatcatgctagttgttgcctgaataccttgttttttgtcaccgtgttattgtattgtatgccctgtgagatttatgctttaaggaggttctattttggtgtatttcaaggttttgtttcaagatttagagctccttgtagcaattcttgtagtgctggctttgtagtggtgaattatctcagcatttgtttgtctgtaaaagaccatctttctttcatttgtgaagcttagtttcactggatacaaaattcttggcttttaattattttgtttaaggaggctaaagatagggccccaatcctatctggcttgtagggtttctgccgagaaatctgctgttaatctgataggttttcctttacaggttacctgatgtttttgcctcacagctcgtaagattctttcctttgtcttgactttagataacctaatgactatgtgctaggtgatgatctttttgtgatgaatttcccaggtgttctttgagcttcttgtatttggatgtctagatctctaacaaggccagggaagttttcctcaattattttctcaagtaagttttccaaacatttagatttctcttcttccttgggaacaccagttattcttaggtttggtcatttaacataagctcaaacttctttgaggctttgttcattttttaaattcttttttctttttttctttttttttagtttgagatggagtctcactctttcgcccaggccggagtgcagtggtgctatctcggctcactgcaagctccacctcctggattcacgccattctcctgcctcagcctcccgagtagctgggactacaggcgcccaccaccacacccagctaatttttttgtatttttagtagagatggggtttcaccgtgttagccaggatggtctcgatctcctgacctcatgatccgcctgcctcaacctcccaaagtgctaggattacaggcgtgagccaccgcgcccagccttaaattcttttttctttgtctttgttggattgggttaattcaaaagcctcgtctttgatctctgaagttctttcttctacttgttccattgtactgaaactttccagcgtatttttcatttctctaagtgtgtctttcatttccagaagttttgattgtcttttatttatgttatgtatttctctagagatttttttgtccatatcctgtattattttttaaatttctttaagttggttttcacctttctctggtgcctccttgagtatcttaataatcaacctaccgaattatttttctggcaatttgaagatttcttattggtttgaacccattgctggcgagctagtgtgatcttttggggtgttaaagaaacttgctttgtcatattaccagaattgtttttctggttccttctcatttgggtagaccatttcagaggaaagagctggggtttaagtcctgctgttcattctttggtgccatggggtgatgccttgatgtggtgctctccccctttccctagggatggggctcactgagagctggactgcagtgattgttattgcttttctaggtctagccacccagtggagctactggactctgacctggtactggggagtatctgcaaagagtcctgtgacatgatctgtcttcaggtctctcagccatggatcccagcacttgctctggtcgaggtagtagggaagtgaggtagactgtgtgagggtctttagttgtagttttgtttagtgcatgggttttcttgaatgttggttgtgctagcagttagttggcctccagccaagaggtggcacttttaagagagcatcagctgaaacaagcttgtcctaagtttgcctgaataggtatttgggcttctcaggtgatgggttggaccatagcgctcccaagagattgtattttctgtcttcagctgccagggcaggtagggaaagaccactgggtggagccaggattaggcgtgtctgagctcagcctccccttgggcagggcttgctgcagccactttgaggatggcggtgtggttctcaggccaatggagttatgttcccagggggattatggctgctctgcagtgtcatataggtttccagggaagtgggggaaagtcgtcagtgactggcctcactcacttcccacacagccagcaaggccagtctcactcccactgcaccccaccgatagcactgagtttatatccaggtgccggtgagcagagctgaggtcttgtcccagactacaagcctcccagctgagaaagcaagcaggactttcaggccccacctctccccacctgctgtagcttctttgctcatatctacactttctgttcaccccctaccccacccctgccccagattgtgcccagaaaaattcatatttggtcaaaattattacaaagttcagctagaagtttccttttccctgttgtctttccccagttccactggcagccctccccaagaacctctatgaggtaaagtcagaaacggcttccctgggcaccaggaatgcctacagggctctttctgctgcttcttctagttttatatttcactgggctctctaaattcatttcagctctaggtaaggttaaattcttctcctgtgatctgaatttacatgttccccagtgagggtatgtgttcagaagtggactttccctcctcacgctttgggcactcacagtgtgaatttcactttgttgagtgtagatatttttatatcctatattatgcttaagctttgttctgggatgaaattaacttattgaaaacagttgatcctttggagacttgcttttagacttcatgaggtgagaccagcacagcccttttctagggctgattttttcccaataatgttataatttccttttgagtactgtacctaataccctgagttacaaggttttgcactcagactggtgggaacatgaattattcttaatctgtgtgagtaggttgttccctcagctcctttcaggtgagttttctctgacccaggttgttttattacacacatgaatttattggtaccttgctgaagacttaagggacacttctgcagatcacttaagttttctctctgtacagctctctcctgtctggtattctgttctgaagaccctagactaccaactctgtctcctcaagtaaggagctcaccaggttcctaagtttcccttccctgcactgagacccagaaaattttatcaggcagtaggctgaagcaattgtggggttcacattgtttgtgtctgtctctcagacataactgccctgccctgcctgatctctatgactgttttatatattttgtccagtcttttagttgtttcagacaagagtaagtcaaatcctgctactccttctcggctggaagtagaagtttctagtcttatgatttttaactgttgtcagctaattaaaatgtaaagttttataaggacttcataagtgtatgcaaatgctcctaaggctttcctggatgtcagtttaggcccccaggcttcaggattaatctttaattaatactctgagtggagacagggaaaagaagggtgaatgaagtttctgtggtctaagaaatcccaatagacaacttctggagaaatgacaagagagggacataagcaatcaaaaagaagggcgaggccgggcacggtggctcacacctgtaattccagcactttgggaggccgaggcaggcggatcacgaggtcaggagattgagaccatcttggctaacacggtgaaaccccgtctctactaaaaacacaaaattagccgggcatggtggcgggcgcctgtagtcccagctactcgggaggctgagacaggagaatggcgtgaacctgggaggcagagcttgcagtgagccaagattgcgccactgcactccagcctgggtgacagacaaagactccgtctcaaaaaaaaaaaaaaaaagaaagaaagaaagaatggggaggggacatatgcatctccatctcaactctctaaaactaagactcagacagagattttggtgaaaaatgtgtgcctaataaaatacttgctctaaaaattagattctagatattatctgaatatgtgccagtcactattctaagcattttacatatgtggatgtatttaattctctgacaactgcataagtaagctattatcatctccagtttatggataaagaagcaggctaagcaaattccccaagatcccatagttaaaaaatggcatggctcagatttcaatccaggctctgtaactaatatattatctgctaagaatatcagtcttatcatgtttagttctctggcttaaagtccacaacataataaaagtgaattgtagatgctgagatgaagatattaaatgtaaatacaacaaatacaaggaaaaataaaaactgacaatttgtttaaaagggcaaggacatagaatcctctgaaatagacattgcactgagaagtctatcactagcatattaaggaatgaagactcagataatgaacttgctgttaaaaaagcaaacctctgttaataacttttaattaaacctttgattatatttttaaatgttttttatttcttaaaaaacagttttgggctgggcaccgtggctcatgcctgtaatcccagcactcgggaggccgaggcaggtggatcacctgaggtcaggagtttgagaccagcctggccaatatggcaaaaccctgtttctactaaaaatacaaaaattagccaggcatggtggtgcacacctggtagtcccagctacttgggaggctgaggcagaagaattgcttgaacccaggaggcaaaggttgcagtgagccgagatcacaccactgcactccagcctgggtgacagagcgagactccttctaaaataaataaattaattaattaaattaaataagaaacagttttgcatttgaataattctgacaccaaaataatttttatcctggaatacactattcaatagtggtaaactttgttatatggaaaacatttcttatttctgagcaatatcaggtaaatgaatcaggaattatttgaattagaaggtattgttactaaccccctcatacctccaatgtactaaaactaatacatcttaaaattccttttaatcatttaatttttcttttttccaaaattttccccacataaataaagtagaatttagcctcttctacttcaaaaataaagtattttctaacaatgtttatcattataagtttctcagggctcaaatgtagaacatctttttgatagcttttcactctttccccaaacatatcccagttttatgagaccaagtacaaatatcttcctgtcacacatcatcaggagaatcttgccaggtgcagtggctcacgcctgtaatcccagcactttcagaggccgagacgggcggattgcctgaggtcaggagttcgagaccagtctggccaacatggtgagaccccgtctctactaaaaatacaaaaaaaaattgctgggcatagcagcaggtgcatgtaatcccagctactctggaggctgaggcaggggaattgcttgaaccaggaggtggaggttgcagtgagccaagattgtgccactgcactccagcctgggtgacagagcgagactccatctcacacacacacacacatacacacacaaaatatggataaaatatctagtgtgagaggaacagcagaaggagaaagtaatgtcttgaggaaggtgcgaatcatctgtaaatactttttagagtaatggaattcctagacagacagcttcgcaggcagtattgccattcagtatcattggcaaccttcctaaaaggaaaagagtaatgttaatgccatttctgaaggtatgaattgaggattttgattctttttccataaatacttaccttgtgaaaactcctctgcaatctctactgtcagtaagttttataaatgctgtatacaagtcttcaattcaccattgcctgcttgaggcttatttattttttgagaaagaagctggagaagtcatttgaaaattcatgggtagttcactcttcaaggttgtggtgtgctcttcaaatagctataaaaatttccaagagacaggaccactgaccctgcgcttcgtagcaaatagctttacttactcattatctgactagcgtattagttaatcatgtaaacaattatctttcttttcaggtggcaataattcatggcatctcctcccccttccaccccacacatatacttatttattgtcacagcctgatttataattgttttttaggatttcttcatatcctccctcctacctttacccctgagttcagaaaataataaacactctaaatctccaagcaatggaactcttctaagagttaagctaaagtctatcctaccaccttgctatattaatgtcagctcatttgatgtgtctgtagagcaggatttgtttggcaagctttttctgtaaaggaccagatagtatttcaggctttttgagccatgtggtgtcggtcacaacttttcaactctgccatcatattgtgagagcagaagtagacaaggtatgtttaaaaaaaaatgggtatggttgtgctccaataaaatcttttttatagacactaaaaacttgaatttcatgcaaattttatgtgtaaggaaataattttttaaaaatctcttctttaaccttttaaaaagacaaaagccattcttagcctgtgggtcgcacaaaaacaggcagcaggccatgggccatagtttgccaacccattatctaaacggttaacagaatgcttactacaggttttctgaccctcagcactagtaatactttgggacagataattctttgttgtggactgtcttttgtttttgttttgagacagcatctcactctgtagcccagactggagtgcagtagtgcgatcttggctcgctgcaacctccacctcccaggttcaagcgattctcctgcctcagcctccccagtagctgggattacaggtacccaccaccatacctggctaatttttgtatttttagtagagatggggttttgccatattggccaggcttgtctcagactcctgacctcaggtgatctgcccgcctcggccccccaaagtactgggattacaggtgtgagccaccgtgcctggcctgtcttttgtattttaagatgtgtcatatcatctctggcctctgcctactaaatgccattaacaccctacatcccccaattgcaacaactagaaaatctacagacattgacaaatgacctttggggacaaaattgcccccagttgaaaatcactggtctaatacactgaaaacttagaatacaccgcataaaatatgagctggtaggctgcgtagtataagatagcgtcatgtgtcacctgagagatagccattggattctcatgcttctaatgtagaaaccataataccgtggtcttccccttacctacagtttcattttctgtggtttcagttaccagagatcaaccaaagtctaaaaatattaaatggaaaatttgaaaaataattcatcagttttaaattgtgtgctcttccaagtagtatgatgaaatcttacaccatcccaccagagacttgaaccagccatttgtccagcatatccacgcggtagctgctacctgttcctgagtcacttagtagacttctggattattggctcaacagtagaggtattgcagtgcttccattcaaaaattccttactttacttttattatggtatattattgtaattgttctatcttattagttactgctgttaatattctattgtgcctcatttataaattaaactttacatagatgtgtatgtattggaaaaaaatatggtacagctgacccttgaacaacacagatttgatctgtgtagtcttcttttatgtgttttttttttcaataaatacagcaggccctccatatcaatgggttctgaacctgcaaccaaggcaagacacaaatatagtattcacaagatttgaaacccatgtatatagagagctgactgacttttcatctgggagggttctggatggctcacttccatacttgaatgtgctcggattttggtatagaagggggtcctggaaccaatcccccatagatagcgagagatgacggtatacatagggtccagtattatctgaagtttcagacattcactggggctctgggaatgtataacctgcacataaaagagaatttccgtactacctccaagttaataaccactgaagaaatcctaggcttaagagagcccgttattggaacttagatggtggcgttagagtgcttatgctttggacttaggagtcagtatcccttccccccagctttgtctctttctatattcctttcccatttttcctctttccacctccttacactcaaaccatacagtgtgcacctgacagtggactacaaagattaatattcgatgaaaggactttgtccatttgaccagaccacttgaatgatgaggtgggagccacagaatacatagttgatattaaattaagaatctaggccagacccggtggctcacacctgtaatcccagcactttgggaggccgaggcgggttgatcacttgaggtcaggagttcaagaccagcctggccaacatggtgaaacccgtctctactaaaaatacaaaaattgctgggcgtggtggcaggtgcctgtaatcccagctacttgggagtctgatgcaggcgaatcgcttgaactcggaggtggaggttgcagtgagccgagattgcgccactgcactccagccggggcaaaagagcaagactgtctcaaaaaaaaaaaaaattgagaatctaaattaatttatagaaatcctttttccataaatttatcttttctccaagttttcttctgatatgcaaagtgtgagacacctactcttagcttttagatagtttacaggccaatgacacacagtagatgatgttctgccatgatgtctcaaaggcagagaaacattcttatttttatcaacactttctcatccccatctttaaattattggtataaacaaacttctgcttctcactttagattataattttatcattttttacaattcatcaaagaaagtttttctaaattgcacggaaagttctatagaatgctgagttatgtattctaaagaatatttctccttcccattttttcatagctaaactgtcaatatttttaccttaacttcctacaaagtcctatagctatttgattacttgatgtttcagtataaaaaaaaattaggtcaggtgtggtggctcatgcctgtcatcccagcactttgggaggccaaggcaggtggatcacctgacgttaggagttcaagatcagcctggccaacatggtgaaaccccgtctctactaaaattacaaaaattagccaagcctggtggcaggcactggtaatcccagctcctcagatggctgaggcaagagaatcgcttgaacccgggagacagagattgcagtgagctgagatcgtgccactgcactccagcctgggtgacacagcaaaacttaatctcaaaaaaaaaaaaaattaataatgctgcttctgcctgaaatacatgatttccagtgagtgaaggaccacttgctctactgaagtaaagctactttactcaagtctctgaaggagtaagagagtcctgcagggcacatttgaacagctcactttcagatacaagtgataaaaaatggagcctcagcaacaacaacaaaaattataacttttaaagagatagaacaacatggtttgaaaaggaatctggatttttgcctctggttgctgtcattgacagggaaagtcttatattttctgaacttgtttttaaatccccccaaatagagggattagactgtgtaattccacaaatccgttgattttatgacctggctatagcttgggaaagcaaccacatagtaccgttgttacactccagagctattcaaatattgttatcaaagtggtgccaaaaatttctaatcaaatatttggaagagtttggtgatgagtcgaaagtagcctgtatgtctctgaattctgtgatgtttctcatttttcctccccgtacagtcttcataggtatttagacaagtaaacacctgtaaaggaagaatgtgggcaataagaatgaatataaatgataaatcacataatctgatgtaatgaaagacttaagttattacagaaaacctagaattaaatgaaatatttaaaaagtgatgtcttcaggaagtctacagttcagattcaagggtggcaaatactgtccatggagaccagtagttctcaggagggtgactttttttctccaggagacatttggcaatgactggagatatttttacttgggcatgttgttgatatctagagagtagaggccacggatgctgctgaacacctccaatgtgtaggacaatgccccgcaacaaagaatgatctcgcccaaaatgtcaagaatgccaaaatggagacaccctggtgtagacctatgatagctctgacttctttttttttttttttttttttttttttttttgagacagagtctcactctttcacccaggctggagtgcagtggcccgatctcggctcactgcaggctcgatctcccaggttcatgccattctcctgcctcagcctcccgagcagctgggactacaggagcccgccaccatgcccggctaattttttgtatttttagtacagacggggtttcaccgtgttagccaggatggtctcgatctcctgacctcgtgatccacccatctctgcctcccaaagtgctggagtgctgggattacaggtgtgagccaccgtgcccggccgatagctctgacttctaagtcaactgtgttcatcagtttcatatctcccctcttactttccaccatcacaaaagcctctgcctcctaccaaatgttagtaaatgcagtgaatgttagcaatctatttgaaacaaggtttcttggcattcatctagctgtatggataaagttttaccagcacaaactctgtatgcatggggtagactggatcagacagagcaatctgaaccacaatgttggatttccttcaagcttgagaaatattaatactaccatatatacaggcggggcatggtgggtcacgtctgtaatcccagcactttgggaggccaaggcgggtggctcacctgaggtcgggagttcgatactagcctgaccaacatggagaaaccccttctctactaaaaatacaaaattagccaggtgtgggggtacatgcctgtaatcccagctactcaggaggctgaggcaggagaatcgcttgaacctgggaggtggattttgtggtgagccgagatcacgccattgcactccagcctgggcaacacagcaagacttcatctcaaaaaaaaaaaaaattaccacacatactaacaatatgaaagttctaattcatatttaaggaaacatctgcttctacatgtgtttctatctgtggttctgaaaagcaaatcctaatttttatgaatgataatttctgggcctctttttgtctttccccagatgttccctgctttgttgcttaagagctgcatggcacagaccataaaggttgtgagctcttcccatttcaagaaaccctggggagattcaaataaacaaattcaaaatgccccttagagtctttaacagaccagaattagtacgttgtttgtttgaaaatctttctttttttcggatataaaactatacactcaagactaaatggaggcagtacaattacacattttgactgaattgtctcatcagtaaaagtatcacctggctaattgtaactctttagaattggcctaaactagaaaataaacaaggaccttattcaagtatttcctattatgttacatacatacaagttaccaattagaagttgatatacactattttgtttaaaaataaaattcagcaagcttctgatgatttattctgttcttgtttttcttaccagttttactgccaaaataaactccttctcatacaaagtctgggattataccacagagttactataattggattcaactttaatagaatattacaatattaattttaatagagtatggtttcagatattaaaaagattaatgtacccaaaaacataatcattgttttgttttttttttagacagaatcttgctctgtcacccaggctggagtgcagtggtgtgatctcagctcactgcaacctccacctcctgggttcaagcgattctcatgcctcagcctctcaagtagctgggattacaggtgcatgccagcatgccaggctcatttttgtatttttagtagagatggcattttgccatgttggccaggcttgtctcaaacttctggcatcaagtgatctgcctgccttgaccttccaaagttctgcgattacaggcgttgagcaaggcattgagccaccccacctggccacttcttttaaattgcataattttcctgttctctatttcatccaatctaaaataataatgagttttaaatacttatttttaacattttttttacacctatgatttgagaatatatatatattaggccgagtttcatttttgttgcccaggctggagtgcaatggtgccatctcggctcactgcaacttccacctcccaggttcaaacgattctcctgcctcagcctcctgagtagttgggattacaggtgcccaccaccatgcccagctaatctttgtatttttagtagagacagggtttcaccatgttgtccaggctggtctctaacccctgacctcagatgatccaccagcctcggcctcctgaagtgctgggattataggcataagccatcatgcccagcctgagaatagatttttgacatttttaacttgattttccgagaagaaaaaattacatatttttaaaaataataaatacattgaaatctagattttaaaacatgtttactttctctcaaatttgttagaaatgtcacaacaaatagctttttcaacctatgaacagtatttgtagaagggaaaaatgaggaagaaatgggcacatttttctagtgattgaatggtggtgtctacatcttgaataattctcactgcatatcgttgcttgaattgtagatctgtatggcatgtgacttgcctgggtctatgatgttgtcaacagaaagagtcaaattctgtaaaatatttgaagagatttcttctgagccaaatatgagtgaccaatggtcccgggaaatcctgaaaacatgtgcccaaggtggtcgggctacagcttggttttatacattttagggggacataagacatcactcgatacatgtaagatatactttggttttgtctggaaaagcaggacaactggaagccaagggtagaagggggccttccaggtcataggcagattctcatgatgttgcccagatgtcctattgtaatttcaattggttgagtttatctaaagatctggaatccatagaagggagtgtctggattaagataagtggttgtagagaccaaggctcttattatacaaagcctacaggtagccggctttggagagaatagattgtaaatgtttcttatcagacttaaaaaggtgccagactcagtgaattctctcctggattagggaaaagacctggaaatggaaagggattctctacagaagttagatttttccccacaagagacagctttgcagggccatttcaaaaattgccaaagaaatatattttaagacaaaatacttggatttctttcaggacctgctatctgtcatgtaatgctatactagagtcaggctggatttgggtgtcttattgctacagaaagtcttaagatctctattaatgttaatgctggtcagctgtgcctggattccaaagggaggagggtataatgaggcatgtgcaacccccactccccatcatgacctgaactagtttttcaggttaactttggaatgcccttggctgagaggagaggccaattcagatggctgtggggcttaaaatgttatttttggcttatgatgtggaggcagaagtaacctgtatcactgttgtgccaaagtctctaagagctaatgtgcagttcaccaagttgtctccctatgagagtcagccatcactgcaaacagcaacactccaggttgattgtggttctgtcagcttcatcctgcaccccagagtaaagatgacatagtggggagcctgtcttacaatgagcatatagcagatgcaagaaataaacatttgccttgttaagccactaagatgtcagggttgtttgtcctgcagcaaagcccagctcatcctgactgataaacttatccattcaagtgatcagcttttggtgtaaatgcccctaagaaaactgataaagcggccgggcacggtggctcaagcctgtaatcccagcactttgggaggctgaggcaggcggatcacgaggtcaggagatcgagaccgtcctggctaacacggtgaagccccatctctactaaaaatacaacaaaattagcctggcgtggtggcggcgcctgtagtcccagctactcaggagactgaggcaggagaatggcataaacctgggagacagagcttgcagcgagccgagattgcaccactgcactccagcctgggcaacagagcaagactccatctcaaaaaaaaaaaaaaaaaaagaaaagaaaagaaaactgataaagcctgatgcactacctacctatgccttgccaaagaatggtaataatccaaaaactgtttaatttagaccttcactatgcaatgcatattttatctaggaacacttttactggtatcagtgatcaaaattatagagcagggggggaaatgtgaggaaacaaatctcaaatgtcaacatacgtggggatcttgtttgcagatgaggaagtgcattctcaaagctgtgtgaattgtcctcatcatacagctattttcattgtattctttcacaaaaatatgtatgtggatggattcttaggtgttagagacggggaggaaagaataaaggagactcaaggcataggtggaaaccgtgcatacagatggtatatctttatgtgttgagcatttatatcatgcatctgctaagtactgcaatggaaacaaggataagacgcacagacttccctaaagaaatgtaaaatctcaatgacaaagaaacatgtgaagaagttagtatcttaagcaaaatgatgcaattcatagtaggccactgtgtactggaaaagtaagggctattctattccaaagtgtgatttttttattgggtgagggggacctgagaaagcttcatggagggtgtgatagttaatactgagtgtcaacgtgattggattgaaggatgcaaagtattgatcttgggtgtgtatgtgagagtgttgccaaaggagattaacatttgagtccgtgggctgcaaaaggccgacccacccttaatctgggtgggcaccatctaatcggctgccagcacggctagaatataaagcaggcagaaaaaccttgaaaagactagactggcctagcctcccagcctacctctttctcccatgcttgatgcttcctgccctcaaacattggacccctggttcttcagttttgggattggactggctctctttgctcttcagcttgcggatggcctattgtaatcatgtgagttaatatttaataaatttccatatatatatctattttattagttctgtccctctagagaaccctgactaacagagaggagaggatatctgaactaagcctcagaggaggatgaatggcaaggagaagaaacatgtctccaggaaactgaggcctgagggggtagtaatttttcccgagcatatgataaatgacagtgatttgggaagacttcatggcatgaatgtatgtgagaaagtgggcttgcgagagcaagattggaggagttggttatggaaaggcgagtaaccagatataggctgatagatggagtaagcatagagaagggcattgttttgtttgcttgttttttttaattttttaaatgttttatagatatgggagtcttactacattgctcaggccggtcttgaacttctgggctcaagggattctcctgccttggcctcccaaagcactgggattacaggtgggagtcatcaggccggcttttaaagaagggcattgcagtaggaatagaatgaaaggaagagatgaatgaatggaagagatatatgagccatttcaaaataagaatcacaacagtggaactgagtggctgtggataaaagctaaaagggttaagtcagggttgggaccaacagaactagaacaatacttgtattttggcccagatgacaagggctgaagggcatccagtgaacacccagaaactgaggacgctagactgaagcccaggggaaaatccaagctagtgaggtttttctcttatgagttatgggaggagcaacttggagggaacacttattgattgcatctcttgtaatatccacagcaaaggcatatgaggcgaggctagggaaggagatagaggaggagtgtggtcagagacgcaaaaggcatcaaataaagctgatgtggaagagaaccaggacgctcattgtggtatgaaagtcaagagagagagcttcagggaggtgggggattcgcaggtttaaggagaaagcaaagagaatgaggaccaaggaaaggccattggatttgaagtttgagattttctttctttttttttgttttgtgacagagtctcactctgtcaccagcgtggagtgcaatggcaccatctcagcttattgcaacctccacctcctgcgttcaagcaattctcctgcctcagcctcccaaatagctgggactacaggtgtgtgccaccacgcccagctaatttttgtatttttagtagagatgaggtttcaccatgttggccaggctggtgtcgatctcttgacctcgtgatccacctgcctctgcctcccaaagtgctgagattacaggcgtgacccactgcacccggcctgaactttgggattctcttggtggttgtagagaatgcacttcattagctttagattctgggacagtcacattataaaagacaaggggaaataaagagggtatacaggacactggtgtatactgtccactccagatcagtggatgaagaggatctgcaccctaaggggacagcagatttatcccattgctttgttgtgttgctttgtcgagatgggagatacctgaaagcagaaggaaagcaacataggaagacgctcaaaaataatgattttcttaaatgcacatgataatttatggctgacactgacattttctcagttacctttcataataacattagagaaatgacataaggttgcagagtggggggcagtgggtttcttctgactccacttcggttcccttcatagcatgaacacatttgtaagggagaaaacgaggcaggaatgatgcacattccgagggtgggagtgaagaattaggagtcacaggtaggttagcatgtggaagagaaggtgactgaaaccagaggcagagaggagaaagtggactgagatttacatgttttactccctgaagagactagcagtccctatttccaccaagggcagaaacattcaaacattctgcatacctttccttttatgcatgaaataaaatactggcatttgaaggaagaggttgataatgtttatttcttagaacattcaagcttggcagttatgtgacttatctctagagcctctcagaagtctctggggacgcaggagtctttggagactcacactttctgcaaaagtgcagaaagaaatacaattacttaatgaatacctactgtgtactcagcaaatcctttatctgtcacttgtgttaatttctagaaattacataactaagagtctccatgaattgcacttgttttcttaagagggaaagagaaaaaaataccttctttccttaccatttaagccagtgctttttaaaccaggatctgacactccgtaggtgaccatagatgtagtatcacagatccgtctgtttccaaaatgttacattctgattttaagatcccctgaaagttgaaatttctcttttgctgcaacaactcacacttgagaaaaattttcacaggagactttattttcttaaagcagagtttgttaatatgaattctcacaggactgtggcaattcatttttcttttaatgcgttcattactctagaccaagacatcaatttttgtgcaaaccttgtttcctgctgccacctggtggaagccacataagagttttacagaggctttggtggtgctaggagaggggccagggctcttcctcagtcacagaatcccacacagtgatcaaagagcagatctttctattaaactccctggcagcaaaacagtagaggcttggctctctgccccgggactgtgcagaatgtcacaggtcggaagcccagagcatttttctcttcttttatctttagactcttgtggctctcagaccttgaatataattctttgctgaaaattctttaaaatcattatcttttctttcttccttttttctttctttcttttttctttcctcttttttgctatgctagacaggaagaaagaagggaatggcattttaatgtaaagaagattgcactgaaattatattacttgcttaattgtattaattcactgcaataacaatttaataatatgacaggtcatttacatgctaatcatttgggtctcttgtccagagaaatcatgaggaagggctgggaagtgctcttattatgatcaaaataatccacactctcctagaggagtgcataggtatagaactgacattgtttgtttaataaagtttcattcaaggcaatttggctggttcttttatcaagtgtaatgggaaaacaagccagtcctgatgttaaacactccaatgatccctcaagctttttattctgtaataagttttacagcattatgtgttacccacgacagtcatttagtcggtcaatttcaggctagtgataaaagtttgagtaatgggaaagctgtgttgatgttccatattctttgtgagatgtctatgaattaatgctcccaggtacacactcaatttatatttaacagccattactaaatgtaatatctaagtaaaacccagttatgacctatatatatggaaaactaattaaagctgttggaaacaacctatttccctttggattatttatgtaaatacatcgaggtctaaaaattcagtacaagtcagatgtgttcctgcctagggctattatataaagctcagaaaattttatgagaaaaatgatgattcttaaggattgagcttcaaatgtgaatttttctattttataaggatatagcttgggttgttaagcatcaacatagcttttcaaaatagttttttattctcacaagtttaaaggccttgtaaaatctcttctattaaatatacatatatacatacatattacatatacaccaattgactaacccctctaagtgctgtatctgaactaattttaaaagaatacccgtgtttttcagctcccaaattgaaaagattattagttagtaccgtgatttctgaacttttaatcaaattttcattcattttataattttgaaattttgacaatctgagaatcttctatgattaaatatattctttcttcctttcttttttctctttcccttccttccttccttccttccttccttccctccttccttcctgtcagtctgtcttgctctgttgcccaggctggagtgcagtggcatgaacatggcacacttcagcctcgaactcctgggtgatcctcccaccttggcctcccaagtgttgggatagcaggtgtgagccaccaagcctggccttataaccaattaaatgaaggaaatgatactatgacacagacaaccatttttcaatcaagttattctgccatattaaattttcagtcacctttctattgcatttattgaatttctactttttaccagttctaagcctagatctgtctctcttaaattattaaatgtcttattttcttatgaaacaaccttcagatgtaatacacagaagaaaaaggagtctcaggaagtttagtttgcccaactagaaattgagcacaattacttggtgtgttgagggggatttgaaactatgtccttatgataattgatagttatgataattgatgacaaaggggttttagaaagacctcttttgcttttagaaacacttctctttgcactttctttaatgcccattttttagttttatgaattaaataatatacatttatttaaacaaaagtatcaacatttctcaagtatctataggttacttatctactcaatgcaactaacaatcaaaaactagtgctccaacaaattaaattttccaaacactgaaatattgatcacaatgtctctaagcatttcattgaaataaaaattttgatgtatctaattttcctaaatattttaaatgcatttcaatatgcaaaactctcacaaaattgttgtaaatacaaaggtaatcagtatttttagattaaaatcagttataaatgtgctaatatagtgaatgtgacccttgtccggactcacatttttcttcttagtcttttcctgggttatattcttaacatatcagctatttttctatttttatagcttcttagggttcaaaaatattaccatatccaaatgaaaactaactacctgagagcagccaactgcaggatctgtgtcaggatccagctgattcttggtgaggacacagatccaggtgtctaaggagattcagacactagccagtcatcatcagattaagctgcacttaaatccacatatatcaaattgtttttttttatttttacaatggtgcgttactaccatgatgtcttcacaactgatttgagcagtgttgcaaatcccatttcattatcccatcgttgtgatatatagacttggcctgttggaataccttcttggaaatttaaaaaaatagtttattaagattattagggccattgaagaatttcctcctaggagataatgcattgagtctacctttcagtcctcctcctcagaacacgtgcccgaactatcatttttgagatcaccattgatttctttctacagcgtggtcactggtaccaataaaatgctagtcttcattcctatccagttattatgtggggccccatgttgttagtctttctgatttcattatgatactaagttttaagggaaacttgacttcctatttttgtgtctattgtactacccactatagcgactatatagtaaggaatataaatttgttttcataggaaataaaatacccacatatattaaatccccattaaacataccctatttcatttacccttctttaaattataactatctttttatatggcttatattaacttttctctctcaagcatcattttaagctaatgacctttcagactagacccaacttctttcagtcaaccataattcatgctcactttctccctctctctcatcaaatcatcgaaatttgatcagcaggaatctctttaacttgactccattgattttttagtgttttagtacagtctccaacattcttaaaaacatatttgttttctagcaataacaagatgtcccagactcattccaatttgttttgttttactgccccaaaacatggaatcagcttccctaccataagtagtaaagagtagtagagaatactattaaagtccaaaatctgggaactagggataaacaggagagttgatggtaagtaaaaccagtgctgctgcttaactatatttactaatgtcagagatggaaaatacaagttattttaatgtcataagctcacagtaattttttccaaataagattatatattgctatgctctacttttctcaaattatgtgattttattgaaaatgaaaacttttattttggaattgaaatatttgaccctcttctttctgcttaggggaattatttggaaagatttcttatgcctagttctgtagggttccaaaccatgtatactttcacaaaatgcatgtgtgcaatagcacacatgctatttccagcagcaagttgaatccttgtatctagcactgatggtcaatatgttttgcattttgctttcccacctccaatgaattagtataaactatgaccttcattgatatttctttagtttttatatttgtatgaatcagctacttcaaacccttaataaaatctacaacctctccaataaacccaaagttactagatggaaggaaacaaagattagagcagcaatcaatgaaatagaaacttaaaaacagaaaagatcaacaaaactacaagttggttttctggaaaaaaataaacaaaatcaataaaattttggctagactaagaaaaaaaaagagaagactcaaataaatgaaaccagaaatgaaagaggagacatcataacctataccacagaaatccaaaggatcacaagaaactgttatgaacaattacacagcacacattgaataagctaaaaaaagaataaattcttagtctcatagaacccaccaaaactgaatcatgatgaaacagaaaatctaaacaaaccattaatgagtgaggaaattaaatcaataaaaagcctcctatcaaagaaaatcccaagacctgatagctttactgctgaattctaccaaacatttaaaggataaaataccaattttttgcaaacttttaccaaaaaatgaagatgaagaaacattctcaaactcattttaccaggccagcattaccctgataacaaagccagaaaaagcaccacaagaaaaaaaattacatgcccatattcctaatgaatatagatgcaaaaaccctcaacaaaatactagcaaactgaattcaacagcatactaaaagaatcattcatcatggtcaggtgggatttatcccagagatgcaaggatggttcaatatacaataattaatatgatgcaccacattagcagaatgaaggacaaaacccatatgatcatctcaatagatgcagaaaagtcatttgacaaaatttaactttctttcatgaaacaaacactcagcaaattaggtacagaataaatgtatctcaacacaataaagagcacatacaacaagcccatagctgacatcatattcaattgagaaaagttgaaagctcttcctctaagattaggaagaagacaaggatgcccactcttgccatgtttattcaacatagtactagaagtactagccagaacagttaggcaagagaaagaaataaaggcatccaaattggaaaggaaaaagttaaattgtctctgtttgcagatgacatgatcttatatgtagtaaatcataaagactccatgaaaaaactgttagaactaaaaatgaattcactaaagttgtaggatacaaaatcaacatacaaaaatcaacagcatttctatatattaacatgaattatccaaaaaggaaataaagaaaacaatttcatttacaatactaaaaaagaaatacttaagaaaaatttaaccaaggaggtaaaagtttataatgaaatttataaaacattgaggaaagaaattgaagaacacaagtaagtggaaagatatcccattttcatgaatttgaagaatattgttaagaattcagtactacccaaagtgatctacagatttaacataatgcctataaaaattccaataacattttttacagcaataggaaaagtaatcctaaaattcgtatggaaccacaaaagaccctaaatagctaaagcaattttaagcaacagagagatatcacatgacctgattttaaaacctaccacaaagctatagtaataaaaacagcatagactagcataaatacagacacatataccaatggaacagaataaagaccccagaaataaattaatgcatttatggtaaataggtttttgacaaaggtgccaaaattatggggaaaggacagtctcttcaagaatgtatatccatacatagaagtgtgaaactaggctctcattttacaccatatacaaaaatcaattccaaatgaattaaagacttaaatgtgacacctgaaactgtaaagctactagaacaaaacatagggaaaatgctctatgatactggtctgggaaaagattttttggctatgaccccaaaagcacaagcagcaaaagccaaaatagacaaatggaatgacatcaaactaaaaagcttctgcacaacaaaggaaacaatccaacagactgaagagacaacctatggaatgagaggatgtattcacaaaccatacctctgataagggattagtgtccaaaaggtataaggaattcaaataattcagtagtaagaaaacaaataacttgatttaaaaatggacaaaggacctgagtagatgtttctcaaaagaaggcatacatgtgccaacaaatatatttaaaaggtttaatatcactaatcagggaaatgcaaattaaaaccataagataccacctcaaacctcttagaatggccattatcaaaatgataaaagacaacaagtgttggtgagaatgtgaagagggaaccattacacattgttggtagaaatgtaaattagtacaaccattagggtaaacagtatggaggttcctcaaaaaattaaaaatagagctaccatatgatccagcaatcccactattggctacatatccaaaggaaatgaaattagtatgtagaagagataagtgcactcctatgtttaccgcagcattattcacaatcgctaagatctggactcaagtgcccatcaacagatgaacaggtaaagaaaatatggtatatatacatgatggaagcttcaaaaagaaggaaatccagccatatggatgtacctggagaccattatgttacataaaataaactaggcacaaatcaagtatcctatgatcccacttacatgtggagggtaaaaaagttgaagtaattggaacaaagagtaaaatagtggttaccacagagactgggaggtggtgggattaggtagatcttagccaaaggacacaacatttcaattagacaaaaggagtaatttcaagagatctattgtacatcatagtgactacagctaatgacaacatattgtgtatatgaaaattgctatgagagtggattttatgtttccattacaaaaaaagataaatttttcagataacgcatgtgttaaatacctttatttagccattctacaatgtgtactgtgtatgtacatgtgtatatgtatataatctcaaaacatcatgttgtacaccatacatatatacaatttttacttgtcaatcaaatagtttttaatttttaaaaatttacaccttccttttggaataaatatcccagctctcaaagctgataagtaatgaagtaaggatgaagctacctgatttggctgatgtatggtccagagaaggcgatgcatatgggacaaaatcatgaattaaaaaggcaatttttctttagattaaaaaatgtcaacaaatagcaatgtttgttattctaaggaaaaattatttatgatacatgaaaacataaagaacatccaaagctgagaagtattctttcttcattctttttatagtcttcatcttaagtgacttcaatacataccatttatcagcatgtctgttacatcttatattgaactgtttccatggaacatctccatgggtcagactgtagcctcaaagatactacaagcaaaagagaatccagcagtgtagtgggagaaggaggaaaaccttccctgactgcttggaaattgatgtatttatgacatgaagaagttaaaagactaggccaagaggcacaggatccagataaaacaacttccctcgggttccagagacatgaaaataaagaatttatagttatcaggaaggaggtaatttgctgaaattcccatcacagatccaaaaacgaggaaggaggcagacatgtgttaatagctccgaagtggcctggaagtcttattttgccagtgatttaactgaagatcaaatacactcatgtaaggaaagcagagaaagcttgcataagtctctggcctggacctggaaacccagtctgctttatttccttgggggagcaggtttcctaattcttccacgacatttgttggttaaatgttgaccaacaaaagcagaatgttacattgtgtttgatgggaggggaaagtccttgttttctatctagtctggggaatcatacatcaatccacacaggaatatgcatcaagtgtttccatcttaatgagtggcatgattccagaagggcaacaggccaggagagctctaaagcttccctgaaaaaatggagaggctggttgtgttttgttcttgccttggatggatgaagaaatggaagcaggtgccccattgggaccatggatcaaatgcacttaggaacttaaaggaaagtctaggggctctgagtgaaccagcacctcctgccctgctgggggttagaggcttcactggctagtccgaagcctagtggttttgagtaagaaaagaacttcaaaacattttactgtgatttaaaaatcctccatggtgagcatgcccagcttttgttctctcgatgtacctccaatctctcaagaagacataatttagtaacgctggggttgctgctactataaatgctttgattaacattagaggaagaggacgacagaaagcagcttctgtcccagccaattaaagagcttgtttaaagtatgaaaatgatttattagacatgcaaagagggttgcaaagaagaaagacacacagtctcaatttaaaaaaaaaaaaaaaaaaaacaaccacaaagctttggtccaggtgcctgccttctgacaacacagataaacagtttagttgataatcccccacatcttcttcttcagcacagcaatttgttccagttatcatactttctaaatagaataaaagaaaatgatgctcctttataatatatatagggtttagataaaaataaatagcacagtccacatgctttaaaccaaagattgagtctgtgtgaacagaaataccagatagctgtttgatacagcatttcccaaatagatatatctgagagctctgctaaaaaaaaaaaaaattaaatttttttaaaaaggaaagctagaaaaaataataataaatagagccttgtgatcatatatgtgcatcaacaccggctatatactcctttcggaaaatcacaatgtacgtgactcttgcagtaaagaaatgtgtttaacatttttacatttttaatacagcatttctcatacatatttgactgtagaaaccttctctgatatgacgactattgtcattccctagaattagtattctgttcaacatacttggaaaatacttaactagccaatctatttacaatgggaagagctataaagtccctcagtcattaacagctaatacacttgaaagattgttagcagaaaaaggaaaacatgacgtcaggaagctggggccatggattttgtcccttacacataccttcgttttacagacatcacaatgacaaattcaccctgacccaactgaggtcacatcagcaactgaatgtaggtggattgtctgaaacccattaccgttgtccacccaccatcatagaaaattattttaaatgtatgtattatagtaagagtactcttgatagtattattttttctttctttcttttgagagagagtctcactctgtcacccaggctggggtgcagtggtacaatcacagctcactgcagcctcaacctcgcaggctcaacctcccaagatgctgtaactacaggccagtgccaccgtacctggctgattttttgtattttttgtagagacaggatttcgcaatgttgcccaggctggtctcaaactcctgagctcaagcgatctgcctgccttggcctcccaaagtgctgggattgcaggtgtaagccaccacacccagtggctaatattacttaaaccatataaaactaggcagtggagaaagggagtaagagtacaggctccagattcagacggactttctctgaagtccctcctactgcccatggggacttgaacaagttacttaatttctctataagcctcaatggcttcatctgcaaaggagaataatgacagcatctattttttaatgttttgtgaaacatatggaataatgcatagtaagtgcatagcacagtaaatgacacatattaaacatagacaaatattagctgtaatattttatcatcattttctttacaaataatagtgtttttggtaactaagactaagaagaaaagaaggaagacagaagttgaatgtccttgcagatggggggcaaatctgctggcaagatttgtgatgtgtgttgctaattatctgtgattaactggttaatagattagttaaatcatcctgttggctctgcggaggatgatctggaaggggtggtactagagtcagggagacaaaagcagtgggaaaagataacagaggatgactggagagactttggagctggaattgacagaatttggcacctgattttgcatgggcatgagatttctggcttagaagagaccctgaagtttcataatatggacggtgatattactaagatgaagaccacaagagaagccactcttggctgagcgcaatgagtttggttttagacttgctcttgcaagcttctggtaggaaatcttaatagttaagcacgttctgatagaattttggcacttggctctaggaaggaccctgattagacatagatggagctatcaatgggaagatagttgagatcacatagataaatgatacacagagagaagagcacagtggcatagtggagctcagaggaatgtaaatatttaagagataataagaggcagtggaaccaatgaaatgatgaaccgagagtaaagtagaaagatgatgagagagaataacgtcctgaaagttaaatgagcttgagtcaacaagcacagaaatcagggctacaggctacatgccaagcctctgaacttcctccgtcctggaccatggaccaagctcagtcctgttttccccagagacccacagaaacgccagtttgcctcctagtgtaaccctgcaaagaaagcaatgtcgttctgcatcaatgctgatgagcctgcgctgttcagtatctgtggggcttgccaagctactcctgctcatggaaacctcagtcaggagcgaggattccttggcagatcgtccctgtgttctctgcatgaggtctctgatctggctgcaccaataacaagaactaatgtcatgtttacccttcacaaagttcaaaataacggtacttcgaaattagccaggcttctaataagcagtctgagaagtacacagactccaaaacagtgtttgcagagcttctgtagaaaagatcatctgcatcagaggcagctgagatcctaatgaaaaagaactgcaagactgagtgattggaaatagctagggttatggctcagcaagctgccttttcagcaagccttgcagatgattctgatgctcaccaaagtttgtgagccactgatgactacagaaatagaatatcaggctgaaacacacaaaaagagcaccatcggggaaaaataatatgaagaaaatactacatttttagtcctggtccctaatccttcaaagagttgttatgctttgtggaaactaatcaggtctagtctcccacctttcaaattatttctgttaaaatgttctcccctcctgcccagaattttctaatacacagtggaatgctttattgctctctttaagcatgtcaactagagcaggagaaaagtttcccatgtattttcttcaaagaaaaagatgtttaaagtttaatattaaaagaaagagtcatgaagtagtttaacatttttttcacagggcgcagagagttgcttctgcatggttatttttactaagtactttccaatttatactttatttttctcaagtataaaaatggatcttcctacttaaaaacaccaatgtccaacttcatggtcaaatgtaaactttggaaattattacttgatttctgttagtggaggaattagaagagtttttgttccactatgttattccaacctcatctcctcgtttgtcaagattcttaagctgaacgtttttctgcgtgcatgcatgcatgtgtgtgtgtgtgtgtgtgtgtgtgtgtgtgtgtggtcacagtgaaacatagattaaggctgagaagtaacaaccagctaattattataagtatagatataggccatggatattaaagtacccccattttgtgttgatacatgaaatcatagaaatttcatgtatcatagagattaatcacatagagattaatttagaccataaaaacatttcaattttcaggaatcccttattaaaataatttttgaaaaaacaggggtgaatattcatgaagccaccacgtcataaaggtttggttgatgaatagtgagagtaggggtgaatagaggtaaagcaggagacacattggcaaggtcagggctgcaagagacaggagagcatcgaaaccaaaccccaccttcccacactcctaaagactgtccagtgagtaattttcccatttatacaagagcctggtctatgaaggcaaataaaatggaaggatttaccctcactgggcattgaagcacaaaccttgcccaaggccctgtcccgagcaaaagagcttccctactgggaaagatcaagatcttaatatcccttaatataactcaaataatcattagccaacctgagagaagaggacaggctctgagtctgaggagaagggttggaagggtctggttagtgcctgaccttcctataatataaagctacttggagatattagagctagtgaatgccttctcccagccaaatccatgctccaggaatgggcacagagttgcaaactaaagatcaattgttcatcgtggtacatgtctttgtgaggtattatgggacaaacttcagttcatatgggaaaaccgaacccttcccacgtggtccgtgaaaacccagttgcacattttcagacaacttctttatgagtacagggcattaggaagttgaaccagcccggccaatttagaacaactggtctctttaacatgagcattccccgtcagtgctaccaaactcctttccatgtgtcccatgcaaccagaaaatgtgttgtttaaattcagctcgtgtcatttgtaaaaaaaaaaaaaaaaaaaaaaccataaaaaataaaaataaaaataaaaaaattaaatagtttgacaagataaatcagggactttggaataaagagttagtaatatgttgagtagtttgtcacatgatatcatttttaagctactcttttttgggggggcggggcacggagtcttgctctgtcgcccaggctggagtgcagtggcgcgatcttggctcactgcaagctctgcctcccgggttcacaccaatctcctgcctcagcctcctgagtagctggaagctactctttctaaataacttcaacaaatattactgatgtgataacaaggcttgatttcatcaagcagtaactctgtctccatgtggatagcggtcttttgaagccctcctcggctgttagagtgcataacccacagctctcaaactggtggagacaaggtggtatgtttgactaattcagtgacgttcggtaagcacctactatgtgcccagcaaggtgtcaaaaacagagcaaagaacaaaataggcaaagtgattgtatatatcactttttatcctaggtcaggataagcaagcagtacataaatttttaaaacaggtattttaggtagtgatacatgctataaaaattacatggatagagaatgaccaaagatgactagattgaatttaccacttctttgagtaggtggcagtggttcaagttggtgactgagttctaaacgatgggaaaaagacagccctgcagtggtatgtgggaagtgttctgggcagaaaacatgttctgaagctggaacaagcttggtactttaaagaaaagaggctgggcgcagtggctcacgcctgtagtcccagcactttgggaggctgaggagggcagatcatgaggtcaggagatcgagaccatcctggcaaacatggtgaaaccccacctctactaaaaatacaaaaattagctgagtgtggtggcacacgcctgtagtcccagctactcgggaggctgaggcaggagaatcgcttgaatccaggaggcagaggttgctttgagccaagatcacgccactgcactccagcttggtgacagagcgagactctgtctcagaaaaaaaaaaaaaaaaaaaaaaaaagcatgcttgtgtgactggagcctaataagcaagtgagagaatagaattggatgatttcagaggcagagacaaaatataaggaggtcctagctgggcacagtggtgtgcatcatagttccagcaactcaggaggctgagcaaggaggatcacttgagcccaggagtttgagtccagcctaggtaagatagaccccatctctttaaaaaaattttttaaattttcattaaaataaatataaggtctttacgtgctatgtattccatgaagtccagagctatgaatgccatagagtaggttctcagtaaacatatgagacaaaatatggctgagggtgaccttagatcaggctttctgaatcttacagaaaaatcttcttttgaatctcttttagctgaactttgaagagaaggataaagtagcatctgtttcaggtgccagggaagcccagaataaaaggctcaggatgacacagccgcatcaacatccagtgtttattggccatctgtcccctaggaatgtcttaagagctcatgctctatttacgagaacagccggggacagtgagaggaaggaagaaattgctttataaaaaagagtagctgcattcttttgtgtgtggaaagagcactattgtggaagcgacgaaacccaggtgtgtaaaaatagaaccgagtgttcacattaaactttccgtgcctcagtttccccacatgaaaagtggacataataacagcacttgagtgagaattaattgagataaaacctgtgttgaaatactgcttagaacatgggaagggtctgagctactatttattaataatgccattatcatagattttagctacatttattaataactccatgaatttagaatgttaatggaataaggattggagaagaaaaatttgctatggccagtgagaattccttgcaagaaaaaagcattgcaattgtgtgtgtgtgtgtgtgtgtgtgtgtgtgtgtgtgtgttggatatgggcagttgtagtgtggaacacctcagcagcacccaggcctcacttgtggatggtacaacctcaggaaacttactcttcctcagtataaatgagaaggtccccttttcccccaatggctgcagtgttggtctaggatgaggtcttctctaccctcatctgcgtagttccaggatggactttctcctcaaaatcacagtccaataaacaaaagtaatgaaaagggtctaacttccgtttgtatctcatgaggagcatcaaaaaccagttagttcctagcatagcacacagcactcttgaattctttcagccattcccagggccctcgcttctctaccctgcccctcccatccctgtcaggtcctgagctcctccttgctcctccctccttttttttttttggttttttttttttttttttttttgagacggagtctcactctgtcacccagacttgagtgcaatgtcacagtcttgggtcactgcaacctctgcctcctgggtttaagcaattctctgcctcagccttctgaatagctgggattacagacatatgccaccatgcctggctaatttttgtatttttagtagagacggggtttcaccatcttggccaggctggtcttgaactccttccctcatgatccactcgcctcagcctcccaaagtgctgggattacaggtgtgagacaccgcgcccggccacgctcctccctcttttgaagacttgttggactcttgtctttccttctccttcctctttccttttccttttgttctgtctaaactcctacagaacaaataaatcaatgaacgaaacacctaggtccttcccagtgtgaatcctttccattaccatccacaaaggtgaccaccattaaagctgtgtgtgaaggcttctagacattagtcctttattctgagtttaagcaaatacacacacatacagatgcatgtatgcatatgcgtgtatgtgcatattatatatgtggggtatatacacatatctttgtatcaggcacataaacaatgcacacatacttaataggtttgtgcaaaaaaactgcaattacttttgcaccaacctaatattactataataaaatggagctgtgatatacattttattctgaaaatagcttgtcccttaacaacatacaatggacaatttacatagatcgattttatggtttatgccacattatgtcacattttttgtccaaatgaatgcatgtttcttcaaatacatacagtaataaatgtatacattgtggttacttccattttttgctatttgaaactctttataaacatttatatacccaaaggattataaatcatgctgctataaagacacatgcacacgtatgtttatagcggcactattcacaacagcaaagacttggaaccaacctaaatgtccaacaatgatagactggattaagaaaatgtggcacatatacaccatggaatactatgcagtcataaaaaatgaagagttcatgtcctttgtagggacatggatgaaactggaaaccatcattctcagcaaactattgcaaggactaaaaaccaaacaccaccgcatgttctcactcataggtgggaattgaacaatgagaacacatggacacaggaaagggaacatcacacaccggggactgttgtggggtggggggaggggggagggatagcattaggagtaatacctaatgctaaatgacgagttcatgggtgcagcacaccagcatggcacatgtatacatatgtaactaacctgaacattgtacacatgtactctaaaacttgaagtattataataataaaattaaaaaacaaacaaacaaatcactcacaccatggaagcacaaaactaaaaagttcagtgtgtgtgtgtgtgtgtgtgtgtgtgtgtgtgtgtgtgtgtggtgttctacttgaggtagaaggtaaaagattaaggagaaaaccaagtggattgaaatctgcaataaagcgaccattctccagtactaaatgcacttgaaatttattcccctgcatctgtaggtaaatgtccttctgttcttgaaacaataaatccccataaacttcccataaagttctgcagaagtgaaatgtgagattggttcccttggaatccattcagtgctttgtttgtgcatcttccaatcttaattttagagcccttgttcttcgtccagagcccctagactgggaaaaggtcagaatgcaacatgtttcaaagctgctgtgctctgggtggctgtcagactgttggagagaattgctttcaaaacccagagtatgccaccatctactcagtttcagattagcgtaacccacagcaccatgctatggcaggggaagctataatctttgctttttgttatcatttaaattcacttttaaaaatattaagattctcaaacagccagattctgaacatgcagtcttccccattgctatcaattatgtctaaggcaaaaaaagaggaccaaaacttctattttttctaacttttattttaggttcaggggtacaggtgcaggtttgttatatagttaaactcgtgtgacggggggttgttgtacagattattttgtcacccaggtactaagcctaatacccaatagttattttttctgctcctctcccttcttccagcctccaccctcaagtaggcccctgggtctgttgtttccttctttgtgtccctgtgttctcatcatttaactcccacttataagtgagaacatgtggtatttgattttctgtgtcagtttgctggggatgatggccttcagccccatgcatgttccctcaaaagacatgatctcattcttttttatggctgcatagtattccatggtgtatatgtaccacattttctttatccagtctgctactgatggacatttaggttgattccatgtcattgctgttgtgaatagtcctgtgatgcacatttgtgtgcaggtgtctttataatacaaagatttctacgcctttggatatatacccagtaatgggattgctgggttgaatgcaaaacctcaattttacaacttgaaatattgaagcgggaaatgtaagtgaaatcccaaattggcatgccatactaaatgttattgtaataacttatttaatatttgattatccaagcacgtacttttgtaccacattctgctcaataaatgtagaaggaagtgccgccattttggattgcagcagtacctcttcgtgcagtgaaaatcttttatgttgtggcccagccagaccctcagtgcagtttgcatatagctttggggcctgtagtgctgtggtaaccattgttgaaccccaaatatccaagacaggtctcagtcaatttaggaagtttattttgccaaagttaaggttgcgggcccatgacacagcctcaggaggtcctgatgacatgtgcccaaggtggtcagggcatagcttggttttatacattttagggagacatgagacatcaatcaacatatgtaagatatacattggttctgtccagaaaggcaggacaactcgaaatggggagggggcttccaggtcataggtaggtaagagacaaatgcttgcattcttttgagtttctgattagcctttccaaaggaggcaaacaggtatgcgtttatctcagtgagcagaggagtgattttgagttgtgtctgtcctttgtccacaaggatattccttgtgagggaggtatgtagctttttttttttttttatcttagtagctatcgtttttaggaatacagtggaggcaggtttgccctaagcagtacccagcttgacttttccctttggcttagtaattttgggggtctcctttcacatcatccacgcagcagcaacttctggtgaacacactgttcattattccaggcaccacttatgcagtctgtctttccctgatacaaattctcagatttctttgaaattaaaactgttctaaatctgcatactggatattacttcattcacattatatttattttaattatgtaacacaaagttgtaaaacttctgttagtcttaatatagactcatatatgtcctgtgtcatcaatgtgaattccattttcaatcctcacctcaggatgattacgagcaaagcacagtgtgtctaagctccaatgcttcacactaaaaacagcaacaaaggccaccagttgcaaaacagaatcgttctcgctctcagatgtgttctttttatccttaaaatcagagcattcatttccgtttggatgcactatttatttttatatcagaaattattttcacttagcagttgaatggaatttgtttgcaggctttctttcaatagtatttccttcttcttgaggatatatgaattctaaggaaactgcagcacattttgtaaaaatccaaaccaattatctcacccctgcctacaaagaagtctttgttatttttctattattattaaaatatatcagcaagattttttggcctttatagttctttggtatttcaaaatgcttctgtatgatgttattgctttaaatcatcacaaaccctgtgaagaaagaattatttttctaatttacaaataaagaaactgaggtcttagaagactgaattcatttcctcgtctctctttctttgcactatgggttatcttgatgctttactgatcctgctctcccctgagacatgtggactctgttactgttttcagcaggaaaatcatggttctattaataggacatgtgaatctttttatttcctgtaatgaaaagagcacaaaaaggaaactttgatttgtgtaacgtaatcgtatggatcatatcaacccattaccctgggtatagagcagtttcccagtttcacatccgtcattctgctgaaatgggtggcttttttccacattttactcacctgatggatttgatataaaacctgtttttctatggatgtgaggctctggaggttttgtagtctatcaacacataaaggctgcctggcattacagcactcctgctctgcacagtggtggagtgtagctaaatgcagctcagtctttttacagctcagctatgaccatccttcattacaacagggcagatgataaaatggaaacttaatgctattagatcatgaattccaattatatgaagagagatggaggtaagagaaattagatgccaaaaggagatacaataaagacagaagtgacgttcacagggctggcagttctcagaaccattgtcacccatcattgtcagtaccacctgaggacccggtgaagatgactagcatatcagatatctgagaagggaaatgctgagtgtgtccaaacatccaaacaaataatgccaaacctagaaaagcttctgtccatatgggttaaatagctcttcaattctgaaactgtcaaaagtaggctttgcagatggtcatgtcaagcaatgataataactggtagtggaattcccatggttcaaatttattaaaaaaaacacactattttcatttattcaagaaacacatattgaatacctgtgtgtcaagctagatattacagttagaaatatatagaaagcacaatctctgctctctgaaatttgcagcctagcagaggagaggaacacatgaaagtaattataataacaagttagatgcaatgatagatacaagatatcctaggaggacagggaaatagtaccatgcccagtccggggatacgtcagaaagactgtctggaggaggtggcatctgaactgagtcttaaagaatgagtagaaatcaagtccaatgtggtatatgaactgagagagagaaggggaggatgttgtagaaaaagacaatccaaaaagaggaaacagtgcaaataaagctggaatccacacacaccattgtcatggtgggaacaatggtagctgcatgttgctgaaatatacattctgaggctaggagtagaaagagataaggctggcaaagcaggcctatgcttactatgccatgtcaccgagcttgcaatactatatattctgcaagctatttggaaccgttgggatttgatgcatgagagtgaaatggtcggttttgcattttattttattttttattttttttttttatttttttgtgatggagtcttgctctgttgcccaggctggagcgcaatggcacactcttggctcaccacaacctccacctcccaggttcaagtgattctcctgcctcatctcccaagtagctgggactacaggcacctgccaccacactcagctaatttttgtatttttagtagagacagggtttcaccatgttggccaggctcgtcttgaactcctgacctcaggtgatccacccacctcggcctcccaaagtgctgggattacaggcatgtgccaccatgcccggccttgttttgcattttagatggatttctctgttggctttatcaaggatgaatttgagatgagcagcagcaggaacagaaccaagttaggaggctgctgccacatccaggcaagagacaatgcagagccaaggcagcagaaggaatggagaggaggagacacagcacagactatttagaaggtgtggctatcaggccttggggattgactggatgctaaggaagggctcccaggttcctgccttgaatggcagagtgggaaaagctctaccttctgagatggagaatactgtggatatagttaatttggaagaaaaatgcttgctttcagatatttagagttagatctctactatgagtttaaggctaaaataggcatttcttactggacagctttaccttgatgatttatactgaagatctaacttatgcacaaatttgggaatcgttaacatatgattagtacttgaaatcatgaaatgggtgaaaattactcaggaaaagaaaaaaagcataaatattcatccctgggacacaggaacattttgaagttgtcattccccagagtcacccccacccccatggcacttcagtgtactgcacactttgagatatatatatatatatatatatatatacatatttttttttcctaataaatagagacgaggtctcactatgtcgcccaggctggtctcaaactcctgggctcaagcaatccaccggcttcagcctcccaaagtgctgggattatagacctgagccactatggccagcctgatagtctactccttaacctacaggaagcagacatcaatttgttttacaacctctacatgcaaaaaatactacatagtcttatttttactaaatcaaaactttgtttcttgctaaatcttcttcccctctttgccagggtgtaaaagattcagtcttgttattccccgctttctggaatcaatcacatagcaacctttagggcttacccaggacagaaattggagtgaggacaggaaggccacaagttcccatgacacacctagctattcacgtctccgcttctagttattaactttgagccccggtagacctaggattactcaggcataaataatagccccccaaatgaaaagtgggaaattgtagagccctaatgtggagagcctgaagagcttcataaaaaaatcttagacttgttcccaccctccaaacatgtgaaacacacaactgtttcaaacattttaaatgtaccgaaattacctcataagtaccctttatatttaaatgcactaataatgggattgacatgtaagaatttccatgactaggaacaagcccgttttaccacaagccccagaacctggctataggtcagctcacagcagtgcaggaagcacctcaactgctttcaccagcatattctttttctctgtgggaccccatccccattctagcccaaaggacccgaatcacagagacacacagggtgaaatatttatgttgttgactcctcccgcaaacttgtcctctgatcattttgtgttgcagccgtgaaacaggcttgctggacgggaagaaatgctgcagagagagtggctgactcaaacccatggacagcattttattaataacttgcagcccttcattctaagtgaagcttgcccaataaaatgaggcctagagctgaacaaagctcctcttacctaacctgaatgtacaaaaaaggtttaattaaggaagtaatttttttctcccgtaaggaaatcttgacaaatagactcaaatttgcatgcaaatgaagccatctggttgattgttgtccacagtccccagctcacaggaaacaatagaaggccctttgcataactcagagaatctgcaaatctctaacatttgggtcactaataattttcagagtaattagtctcttcagagctgctatttacattggaaggtgtttgccatttacagcagaagctatagatattcttctaggtgcagccccagtgtgagccatttggtgacctgaggaaatcactcaatctgggaggggaatgacaagaccattggccactggagccagcctggcagcgacactcctcaccaaactgcagcccagagtgccttcacgcagtcttctccatgcgagccaaacgcagactcttctagccaccatctcttcccccttcctaattccccatctcccctctggggagggaggagacagggcaggggcaggcacaccaggcagggcctctacttctcatcacctgtctctgctactctgcagttatctcccgtaaacatttgttcaaatgcaatcatgtccattgcttgggtaactctaccttcttagtcgtcaggtccctcctcctttcatcagatttttacttaatggctactctacaaagcgtaacacagggctggtgctcaaggatgatagctctgattcatgtgtcctgaatggaattaccaaaaaattaaaaaaaaaaaaatcagtggagatgaagagatagggagtacagagttttggaagctagtgagggagcagaggaaggaaagagatgacgaggacaaaagggcagacatgggtgaggttgagaggagtaaaccagctgaggaagtgaccgctgcaggcttagctgtcaatcctggggtttgctgctccccgtggttggaactggaggacataatgctctgtgaaataagccaggcaccgaaaacaaatactgcaagctctcatgcatgagtggaatctaaaacaacagactcagagaagcagagaggaagatggtgggtacagaggctggaaggtgcagggaatggggagatggtcaaagagtgcagttaggaggaacatgcttggttggttaagttgtattgcacagcttggtgaatgtagttagtaatagaatatgtatatttcacaattgctaaggatgaatttcaaatgttcttatcccccaaaatgttaagtatttgaggtgatggatatgttaagtaccttgatttaattatttcacttcatattcataaatcataacatcactttgtaccccatgaatttatacaattatacattgtcaatttatgatttctaaaaaagcattagtacctgtggtaaatcaggctcaggggaaaagcctcagggtttgtcgtcttactgttcacacattgaaggaaaagaggctcctcttccatctttccccattccttggccaagcccttgcacaggctgactgtaagtgaaattaaagaatatcagtgtagtagtaagtaatcacatttgttgatcttttgttttgtgcctagcactctgctaaatgtatttcatgggttatctcctgagattcttaccataccctataaaagaggttccactgttattctgttcctggaccaaatagggtcgagctgcttattctcaccacccaataagagatgcagatgaactgggaaagaagagaggtgttttgttttgttttgttttgttttgttttgttttgttttgttttgtttgagatggagtttcgctcttgttgcccaggctggagtacaatggtgcgatctcggctcaccgcaacctccgcttcccaggttcaagtgattctcctgcctcagcctcccaagtagctgggattacaggcatgcaccatcatgcctggctaactttgtatttttagtagagacagggtttctccatgttggtcaggctggtttcaaactcccgacctcaggtgatctgcccgccttggcctcccaaagtgctgggattacaggcgttgagattctatttctgtaactgggtacagggagaacacctggaaattatcgccagatcaactcaaacttacaaagttttccagagcttacataccttgtaagctatatgtctatgagtaagtgtgcatttatctaaagacataagtgactcacttcttttaatttataactaagatctgagtcctgaagaccttcctctggagcctcagtaaatttacttaatctaaatgggttcagatgctggactaatgacccttgtctcctgctaaatcatggaggtttggggagttccttcagacccccattaaacttgtttgtggaggcctggggagtttcttcagacccccaatgaaacttgtttaatcctaaacaggtcctgttaagaattccttcattatcttgccatgtttcaaggtccagaaaaggcctaggcaaactctcggtgggcttttgttacatcctaacctttgtataagggcactgcttctttcagcttttaatatttaacttaaccattcagtcagtgctgaaacagttgttatggaggcctgcattagtaagacctggtctgccacaattccactgtacacatgaggatttaggaaggccaaatgatctgcctcacgttgcccagtaggtggagatggtagagccagaatgggaacctggaggtcggcttcctcagcctgcacacggaaacagtgcagggaagcttcaccaggtgacagcccagagcagcccagggactcacttcctgtcatcactcccaccccccaccacctcatcctggtagtaccacccgcgccaatgcttctagggctcttgctggacccacaggtggactgtgacttcagtctgttacctccttctcttcattctccacgaaagaacttcagcacatcacaagttcagttacttcactactggcagtaaaggaaaatctgtaagtccaggctgttgacaggcaggtgggaagcaagctgtggagctccaagaggcccaggaaccggaggcaggcaagggccgggctcagagccggaggaatggcggaacgtctatgtgagggtcagtcacaccccagctccccgctatgaccctgccagtgactgtcctactctacccatgcaggaagtgggggttcacactccagacaccaggcaccaaaaaatgggggtaaagctccttaataaaaacagaggaaattgacttaataaggttgacccctctccttagccttcttcctgtcagcttcccaagcactgagcaacagacatatattcctcatgaggaaagtagcggattcttctctcaagatattgaacattcagtgaccaaaacaagtcacagatactgacattcggagtcccttcaatgggacaggggactctccatgtgatcatgaagcccaaacatcaaatccaccaccatcccagacacacacactccagattgcagtcagctgtctagtacttgactgttcggtataaacagacaggtgagagtcaccaactatgtaggataatgtcagagatgtcataaaagaagggacccccaaactcacaatccagggtaggggtgggtggcaggaggtctgggaagaaacagaggcgacagagaaagcagaagaaaacttttgataattaaattaatattctcagagagacaagagaagatattgagatattgcctccaaaaaaattagaatggggtgctatgaaaaaggggactatcagagaacgagaaataatacttggaaatttaaaatatgatagctgaaattaaaacacaatgacagtattgaaaataaagctgaggaaatttccaaagaagtagaacacaaaggaaaaagatcaaaatgtggaacaaaattagaaaaaaaaaaatctaaaataaataggtgtttgagaaaagggatcagagaaattattaaagtctcagacctcatatgggagaaaaatctatatcaaggcaatcatgaagttccaattaaaagagttaaagaaaagatcctgaaagtttccagaaaggaaaaaaatgtaggttgcatataaggcttcgtaaacagaaagcagttgctttcccggtagcagccctgacagcctgacaattttctttctggagtttctcaattaagtgcgaaagtagaataatgactcatcagaggaacatgggtttagaaagttaacctcgagtatctcttttctcaaggagctacctgagaatgtgtttcaggaaaatgagagtgtagacctaggaagtggatgtcatgagatcctgaaacttggggatgtaataccaaagtgtggcaaaaggaagtccctgcactaatggcagagggaggtcccaggacaagggctgtgcaggaaccctgagaagaccccgtccaggtgggaacagaggaaagagagccatagaagatgcctccaggggacaaaaacgtgactgcagatggcctgatgtgtgcaatgttggaaaatgtttgagaagagttttactgctgtgttagagaatctggagagaattcgtggcagatacatagaaaaataagcaaatgaaaaaaataattatggattttaaagaaactaaatacaagaaaatacaattgcaacaaacaaaaatataagaaaatacaattacatacaacaaaatgcaagaaaatacaatttaaagaaaatacaagtagattttattggttggcttttaaataatattacatagtcctaaaatatgaatactgtgctaaattttagtattattattattattattattattattatagtgtcttactgttgcccaggttgaaatgcagtgacatgatcacaattcactgcaacctcgaactcctgagcacaagggatcctcctgcttcagccacccaagtagctagaactacacagctattttttttcagagacaggatctcactgtgttgcccaggctggtcttgaactcctggcctcaagcaatcctcccacttcagcctccccagtcactgcaattacaggtgtgaggcaccatgccaagcttgaatttcaatataaccaaaaatctgtgatttagctatttggggagaatatagagaaaggggctggggaagcaggcttataaaagtgctaaattctcatcttatattcaggaaaatcagtagagaatatctaaaaggtataaatcaataagtagctccagaggtttttttttttaaaaaaaaatacagctgtttaattgaaagagttaaaagtgtgagaaggtgtctctaaggaattgggaaggggcgggaagcagggaactgctttttgctttagtcctagcaccactagacttttataactatgtacatgtaatactttgttagaaacaaaaattaggttgaaaatgaaatgctgtccatcagaaaatgtgctcagaaagcttgaagttggaatcctatactatcttagtctgttcttgcactgctgtaaaaaaatacctgagactgggtaatttataaagaaaagaggtttaattggttcacagttcccgcaggctgtacaggaagcatgatgctggcatctgctccgcttcttgggaggcctcaggaaacttacaatcatggcagaaggcaaaggggatgtacacataccccgtggatggagcaggagcaagagagagaagggaaggtgctgcacactttaaacaaccacatctcataagcactcaatcactatcacaaagacagcaccaagggcaatggtgctaaactattcatgagaaaccgcccccaggatccaatcacctcccaccaggccccacaacattgggggttacaattagacatgagatttgggtgggaacacagatttaaaccatatccaataccaaataatcactggtcggattcaagtaagtggctgctatgaaatttgtgtgaagatatgatagtgcattttctattgatgcttaattggggtttaaaatgatgtgatgatggagaccagcaagcctgctttgcaggctcagccccgctctcctgcactagctagaggtgcctccctggttcctcttgccacacgtgatgagccctggccttgcctaacatgcagtcacaaagcttctcatgtgattgactcacttccaagctgcagagccttcagtgtcatctcgatcattctgtaaagcttttgactccagccccgggctgggtctccagtccctctctacctgcctcattattctgttactgttgactgacccttccagtctcagacactaatttctgttctgtctcacatctttcatatcttccctctcagtttccagccttgcctcctccacttatccgtgctggcctggtccctgccacctcctttggcactctctttgccatatagtgaatctcttattcccagcttggcattctcacccattgtcactttacctccatagcactgaccttggtagcaagtacaaattgcagtgatttcaataaccttaaggttatgataccatcagtcttgcaaatgcatggtattgttcaatgaagtctatagggagttatagaaataaagccatggataaggagaattatggtgtgctagtggaagcagtatccagttatcagtaggtgctaaagcagcattagtttttatttatatttatttagcatctttaacacccaggttaccaaaaagaacattctgtctcatgaggactttgtaaaaggagtgaaaatggatataaatgagaggggcaatgagttacttatgtattgattgaataattatttatgaatggtgactatattctgaggctgaagattactgagaggaaatgttttcatgccggctttcatggagtctatgatcagttgggagcagtatcaacaaacaataataactctttgcatccagaagcgctatcagcactggaaaaggcacgcatataatcttgttataataaaaaaatcccagagattgggcaacagattcctcagaacaggactcagagatggtgaccatgggctggagcagaagcatccatgatttattatttgtaccacactcactgaaagcctgtaagtccacatcccattaagcatgtttacttacaaatcccatccatgtgccactgcatttatatagtgtacattataaagtataactaaaatcgatattaaaggataacatttttaaaataagtaaaagcagaagttctaacatcatctgcctgagccccagtgatcacccttggcacctcctgagccgcactcctactttgataccatcagtctaatccagagtggagtcctccctgttgcttctgaagaatctggatttaataagctcatccagagatttgagataactcacaattgacaactccaagggcatcatgtgataatccagatgtttccaggatagtgggaaaaaccatttgtacaaggcatgacttccccgtgaatgagtctattcaagagatcaaattagattgaagttgcttagtgagcatagaattagaataaatggaattgtggtctatagagatatttcatcacacttgaataactgatggaactacttttctcctctctgcggatatttctgtctgaataaccagtgctgggcctcaaataaatactgacatgttttacttttagctttcctttttctagaatcattttagacaactgcccttctgttaatacatcaccacctcagaaaataagaaggtacttgattggattgaaattttaaaatgttaattgcattcgtatcctggggatacagcctaaagagacagaattgctttgcttaaggctgaagtctggctggggactttgatctctgcaggctctcgggtccttaaagggctctcacccaattaggatgagctgaatccttctggccctgggcctcatctttattccctcccagcttcaggactctctgatgagcgagagcgtagatttaggttttctcacagaggtgcacctgaacgcctcttgctgtgtagtaaggcagatgttgaggggggaggaaggcttacccttgataactagcaacttgagctttgcaaagcgcctttctgttcctgttaccagtagcctacactacatcatacaatattctcctccccaagaagaaagcaacctatttgcctattttctcctactgaaatctatgattttatactttgtttaaaaaaaaaatagcagccgagcatggtggctcatgcctgtaatcgcagcactttgggaggctgaggcaggtggatcacttgaggtcaggagttcgagaccagcctgaccaatatggtgaaaccccgtctctactaaaaatacaaaaattagcctggcatggtggtgtgtgcctgtaatcccagctactcaggaggctgagacaggagaatcgcttgcacctgggagggggaggttgcagtgagcctagatcgtgccactgcactccatcctgggccacagagcgagactctgtctaaaaaaaaaaaaaaagaagaagcttaagactgcactaagattaggaacacattaagaacagtttttaccctaatgaagatatttacaaacatattttgcactagttccctgtttatgtattacctgcgacagtaattaataggaatgccattggctgagacagcttcagagccctagatacctagggaagcaagccaaatcctcttcaatgtaaatactgaaacgaaactaagcttatcagcaatcagaaaccaccacctaacctctaactaaagactttccacattaaccaatcaaacggtttctttgtcttgcatccacaaacacatttctctctctccaaccccgcaccccagtagacaacttgaattctggtgctgcccaattcacgaatcactgaatgtccaaataaacatgttaagattttaatatgcctaagtttatcttttaacatgcctggggacttatctagatgttgctatattctagacatttctaaaaacaaaaacaaacagcattaattaaataagaccatattttaatatttcataatttaaaattatgacttaagcatggcagaaccaacacaaagtaacttttatttgaaaatagtagctcaatttaatattgcatatgtgtataatttgcataaaaggaaggaaaaatatcatttgtgtatgaatagaaactaatggagtgcacttagttgattcattgtgccttttggagaaaagatatagcaaataccgtgttttttaaaaagcatacatttggagtttagtatcagagctcaaggctttagtaactgctttaaatcacacccatatattttagtctttagctgtgacagtaagtgtactcagaaatgtgcacattaaaaaggaatttctcccctgaagatgaagttgagagccaactcttgatcccatattaaattcttagtccatctgtcctaatggagtctgagtaacgcagtttggtgtttttattgcatcctgcgagctgcttttctcctggaaacactggctgctctgtcaggcaatgagtggggagaggcagctggtacaatcacatcttctccaagagctcaaggacagaggctggctgagagccatttggtgggctcactgcctcatccccatactatacaacaatcccacaggccagagcctcacctgcagtccccaggaggaagtaggaagggaagagaaggcaactcacctctgagagtttggcgcaggagaggtgaggaaactgccctagcctagtctggtcacttctgcctcgttcccggctcctcacctcctccaggctccgtcagttgtattcctgaagcacctgcaccaggtgtctgggtggccgttgacacaggagtgagcactggctcttccaaggcagaggtggatgaaaagcaagagcaaactaccaaaaactttgttcttactttgtcatcctgaggtttatctcagatgctgcttgcaccagaccaaagctaccagtacatatgcaggagttcaaaacagcccccacccacccacagagtaaccccaggggcttctcccaattgttgtgtctattggcatttacttcttagagtcccataggactccttggtaggaaccccaactatatcaatctttattgttatataattataaaatattgtttatcataaatattataaaatattttattgtacaatttatagaaattctatattaatatttaattttatatagattgtatatattaatactttaaatatctttatatgtaaatgaatattatatagacacacatataacttttggaaagtcaaaaatatatttgtgaggatttggtccaatgttgttcaacagaatgagagaaaataatgactattgctaatggtacttattaaactcaagcaatgggtatctgttacatgactaggctgatcagggtgtgagttaacctgatttttttgttttcttcccacagggaattattggaatgccgcctctttcccaaacccatcctcctacctgcacttctctactttccaaggggaaactagcgctgacatttctttctacttcaaaacattaaccccctggggagtgtttcttgaaaatatgggaaaggaagatttcatcaagctggagctgaagtgtgagtataagttgcttgtcaactcatggggagccactttcgtcacctcagggtggtccgggtcctgattgtggaaggccttttgattcaaacgtggaaggtttcctttgttccaggagcaggactagaggtggacacacaagcctgagtttgggctccaacctcagtccctgtccttgggatgctctcagggaagcaggcacatccagattctcaagcaattagtcaagaagatgagagagaacacaccgccctgagaatgtgggagaggaatgtttatcttcagcttcatgtcttgtgtggctgttttccaaagagacagggtcaaaaataggtgaggggtgtgtgcattgacccgaggagcagggagtgaggaaaatcatgtcaaggtcaaggaagacaggaatgataactagtgacatccgtgtgagttcaggaggccacggagaccacaggactgggcaattccatgacacagagtctgcaggattcctacagaggacccacacctgcccaccctctgcaagtgagttctggatgtcatgtacttagccaaagatacagagacaataagaggcagagcaagagaggatgctgcttagctcagctcagctggccttggagcaaacatcctaagggggcgttcaggcttggggagctccgtcagtggaaggtgggggttagctgcacaagacttgagaagcgcaatgcttgccctacctggaccctttaaacatcagggccccaattcagctttaggaagttacaatcccctgacttccaggccagttgattatttgcaaatgttgaactccgttggctgtgagagtcagggagactccactggctgtgagagtcggggagatcaaccacaaggacgaggccaggctatgtcccctgtccctttacaaaacctcagccttacactcagcatatcaaaaagtctcccttccggccaggcacggtggctcacgcctgtaatcccaccactttgggaggctgatttgggtggatcacgaggtcaggagttcgagaccatcctggctaacacagtgaaaccccatctctactaaaaatacaaaaaaaaaaaaattagccaggtgtggtggcgggggcgcctgtagtcccagctacttgggaggctgaggcaggagaatggcgtaagtaaacccgggaggcggagcttgcagtgagcctagattgcgccactgcactcaagcctgggtgacagagcgagactccgtctcagaaaaaaaagtctccctttgccaagtctgtcccctttaaatgagtgcttatgttcctgggtctggtctgagaatgatcccaaatccatttcccatttctgctgaaatgctattggattcacagtagcattcttaggttcaattccacaccgtcaggtaaattgctcaatctctttgaatcctaattttctgatttataaaaaggaaatgttaatttgtgggattgtgatgagaatagaatttaaatactcataaggcatttattttggtatctagtagttattgtaattatcatcttctgaggatgcccatggcagatctgatctgagccaggtctgattgaaagggaggctaaggctatcctggtcctagaattaaaattaactaattaattaaaatcccccctttactgaattctggataagaataattgaaaggggattcttgcttccctcagttaaaattaactaactgaatcaaactattttctgacttctacataagttggatcaaattttagaaagattttatggccacaaaagaaaattgccagttctatatttgagtggttctgtaagtttctataaaagtgcttggattcccccatctttattttatgtcctcaagttttgtaaagccacgcctgggtaagaaggaacacatactagatagagggagagcaggtgtttctactcagccctcggggtcaaagaatttctctactttcttctacttttttctttttttttgagacagggtgtcactctgtcacccaggctggagtgcaatggtgcaatcatggttcactgcagcctcgaattcccaggctcaggtgatcctcccacctcagcctcccaagtagctgggactacaggtgcgtggcactgcacctggctaattgttgtggtttttgtcactgcgggatctcgccatgtcggccaggctggtctcaaacccctgggctcaggcagtgtgcctgccttgacctcccaaagtgctgggattacaggcatgagccactgcacccagccactaatttctaattatgaaaaatctttagagctgtcttcagagttttccaggtctttccacagtatgaaaaccatgtggcccatggttcacagtatgaattacagcctccttttgtcaaatacctttactttcactgtatcctttactctgggcaaaaacatgtgaaacgttcaagacccagattcgagcctctaatcttccctcagagccccctgtatctactaataaccagagagggtggaaagacattttcacgatccccaaaatgtcacatattagatgcccatcattatatgtcatctccatcagggttcaaaggagcctcatggagagggaggcagacttctgtatttaagaaaaactacaaagcaaaccaaaagtggtgctttcatgaagaacatggagaaaaaaatggccatgatggaggcttgttgctgtcgctgtctcatcaatcacactttttctttaatttttttttatttttttttatggtgtctcgctctgtcgcccaggctggagtgcagtggtgcaatctcagctcactgcaacctctgcctcccaggttcaagtgattctcctgcctcagcctcccgagtagctgggattacaggggcccgccaccgcgcctggctaatttttgtatttttagtagagacgggctttcaccatcttggccaggctggtctcgaactcctgacctcgtgatccacccgcgtcggcctcccaaagccctaggattacaggcgtgagccaccacgcctggccgctgatcatactttttcagtcagacacttcgccatcaggattcctgagacattgggtagagaattctctcaggcccacttccttgtgtgaggaatcactctgcaaacctaattgttttcacaacagtggcgggctaccagaggggcctcaggaaacgttgattctgaagttaaactctttagaactgtctctatgtttttcccatttagcttgttaggccttctgatctctttctgataggaattcacattttttttctctaagcgtgtctcagaggaatttggtcacagttcatgactacatattgctttccagaatgacagttctgttaattaattacattgtgcccttctgtcaagagtggaagattctcgactcagaaaacaatgagtcagtgtacactaagttaatgagataccatcagcatcttatgcacaagtagaaaaacacagagataaaattagggcaatctcactcattagcatgctttaatggtaacattttaaccctatacttcatgtatttactattcatatttattcattcatttaatgagtatttactgagtatctactatgtcccaggtacagtgctagtgctgaggtaatttagtcaaatcaagtgtgatttctttccctcaaagatctttctgtttgttttagaaagcaggcaagtaactcaggagttatgataataacaaaaatagctcagcttcattcagactttcaggcctcgttccaggcgttttacgtgaatcatctcacactcctaaccaccctgtgaagtgcatactagcattcacatctccattttacaaacgaggaaactgaggcacagggtgagcaagttgcctggccaaggtcatacagccaggaagtggcagagctggtgtttgaccccaaacattatgtgtctgtcccaaagtcattgctgctaaccttaaagcacactgcctcacagaacagatagcaagaaagaggccgggagcactgaggggaatttttaaacctgactggcttgacaaggagcgcctcccagggatggaatgctttaattaaattttgatggataagtagaagccagtaaggtgaagaagtgggggaagaacaggagccagggaaaaaaggaagtttcaggataacaccaaatgaacgaaggtgtcggagactgaaccgaaggacccaggaggggacaggtgcagtggggaggggcaggggccagcaatagcaaggtgggcacagatgagcacccaatgcactctgccagggggagcatctgactcaacatgaccctgaaggctatggagagccagggcgtaacttgatcaggtttgcattcaccagagaaaagactggaagccagacaaccagccatgggagcctctgttaagacagaggcagaatgcatagaaagagaggaagacagtgatgaagcattgtagatatgaaagatccttcaatgagccgagatcacaccactgcactccagcctgggtgacagagcacagagcaagaatacatctcaaaaaaaaaagaaaaaaaaagaaagatccttaacagatagattccacagacattcaacaaatactcgtgagggttaagtggacgggaagatcctagaatgaaaccagtgtttctagttttgatgttgtgtgagtggggcacctttcatgaaggagtctgacattcaagagcaaaatacaaactgcattctggatattttgagactgagtctctgtgggctataggaggatctaatcaagtggacacatctagaggatgctgaatggacaagtccagaacccaacagagaggtctcagaaactcagtttgggagtcatcatcacttagaggatcaggaaataagcattcagtaccctcagcatggatgagattgcccaaaacaaatgtgtagagagaggaagcaagatgtacaagaaagacaaccagctcacacctgtcatcccagtactttgggagtagcagtaggtcacacctgtcatcccagcactttaggaggctgaagggggagtatcacttgagcccaaaagtttaagaccagcctgggcaacatggtgaaaccctatctctacaaaactaaaaataaaacattagccaggcatggttggctgcacctgtagtcccttagcctcctgcccagaggctgaggcaggagaatccctcgagcccaagaatttgaggcagcagtgagctatgatcacacagctgtaccccctagcctgagtgacagagcgagacctcgaggaagggagagaaggaagggagacaaggaagggagagcaggaaggaaggaaggaaggaaggaaggaaggaaggaaggaaggaaggaaggaaaaagaaagagaaagagagaaacagagaaagaaagaaaagaaaaaggaagaaagaaagaaaagaaaaccacattcaaggaatagaaggaagaaaactagtttgcagaaaactaacagagaagtaggaagacagtggtacccagaaaccaaatgaaaaagacatttcaaaaaggaaaaaaagagggttagatattgctgagaggtccctaaaacaaggacataaagtgaccatcagatttaacatgtagaggtcacggtcaaaaagtcaggtatcactagggtgagtggaagtggatttggagatcaagagagggtggttttgttcattctagtttgaggatggtagagactttagcattcatatagttgaaggagaaaactatggtagagaagggggattggtaatacaggagataaagggactggctgaaggagcaaggtccccatggctgtgggcatgaggtagacccagcatcgcagcacctcacaggggtgagaggaagaggcggaagtaaagagaacagcgtaaaccgcccactaggaagtgcctttccaaatcagaatttgttgttgttgttgtgtgtggacgtttgtttgttagtatttttgagatggcaaagaaatattgttcaaaaaaaatttatggagcagatatcagaaaacccagactctaaacttttcttcatcactaacaaccatggatctgtccatgtattttttcagttacccctaagggattagcttgactgctctagatcctttttctgactgagagggccatcataaccagggtcccaacctcgggccaccacctcctgagcacctgccctactgctggtgctgggaggcgctggggaagctgaggtggaaacaggagaacccagcatccacctcctagtgaaggagacaaacacattagtgacagtgtggatacataatttcattgagagctttgcaagtgccaggccctgttctaaagcttttgtaggttattaacttttgtagtttacacagcaagttttatacacattttacagctaaggaaatgagagcatagagttgacactgccgaatccagatatggtgcatttaatcgttaaaataagtaaattacaatgataggcacaaagtattatgaacaatcggtggagaggtatgtgacctatcctgggaatgaaggggaagatgagggaatgcttcagttgggtcataaaaatcaggcaaaaaagttaaaggaatggggaaaagaattctaggaggaagaggcaatgcgaacaaaaacacaggaatggggagtgtgatgggcgtttgggaaactacaagcattttgtattgttagagtgtgaagtatgacacaggcagtgaagatttggggtcaagtctcagatctcattctaaatatatggtcatctaaatatttatctagtatttattgagtacctgctatgtgtgtacctaaaatgaacgtaagaagaagacatggccccatcccagaggcacacaccatctagtgggaaagactagtaatcttaatctctctctgtctctttctctctttctctctctctccctctctctctgtctctcttttaggttcaggggtacatgtgcaggtttgttatattggtaaattgcatgtcacggggatttgatgtacagattattttgtcacccaagtaataagcatagtacctgataggtagtttttccatcctctccctcctcccgccctccacgcttagtacacgtatccatgcgtactcaatgtttagcttccagttataggtgagaatatgcaatatttggttttctgttcctgtgttagtttgcttaggataatggtccccagcttcatctatgttgctgcaaaggacattatctcattcttatttatggctgtgtagtattccatgatgtatatgtaccacattttctttatttgagactagtaatctctgttattataaaactgtgtgtgtgtgtgtgtgtgtgtgtgtgtgtgtgtatatatatatagttttttttttttttggacagattctcactcactctgccagctgggctagagtgcagtggcacaatcttggctcactgcaacctctgcctcccgggttcaagtgattctcctgcctcagcctcccaagtagctgggatcacagacatgtgccactatgcctggctaattttttatatttttagtagagacagggtttcatcatgttggccaggctggtctcgaactcctgacctcaagtgatctgcctgcctccacctcccaaagaactgggattataggtataagctaccacctacagccagcctataaaataatattttggataggataatattagaggtacgaacaatatgctgtggttacttagatgaggcaatatttacttctgactggagaaggagaaaagtttccttgaagatgctaacattttaaaagagccacaaagtaaatggaaaaggaagtttcaggtttagaatgccaaaggaaaaaagcacagcatcatagatggcatgaacacatcaaaaaggtgtggctccgtcatacacccatgctgcgagggttacggaacattagttaccattatatctccagggtcaccacaatgcctggcatgtggtaggaactaaataagcatttgttgaatgaatgaaatgaatgaatgaggtgctagtctgaatggagagccccagaaaatctaggtggagaagcagatcaccacgactgaggtgctggcgatccaaatatagacaaggaataatatgtggaaaggtggaaggacaggtcacggttagtgaaattttggaactcacgatttcacaggaaagcagtttgggcggtaagaagaatgaaaattgaaatggaattttgtaggttgtatcaaaaggctgcggagaaagtcagggcactgggaggccagagtagtgttggttggtcacctatgtcactgttgaggtcatcaatggtgaagacaagaggtgaaatggacagggaatccatgacccaaactttactgtcctggggttcaaacagtgaccacaatatgaacggggagaggacgagtcacaggtggacgcgaagccgtttgaagactctggagccatagagtggaagaagtacggagaagggaagaataggccaactgttcgcctggccccaagatatgggccactcagaaaaggggttacaattctaagggttgtaagttagggtccccttagggtggactgcaatcagaggaaggaagtgtttgaaagtgtttaatgatacaacaaatagtgaccatagagtctatttttgtttaacaatttaaaagagattttagtctgggcacggtggctcatgcctataatcccagcactttgggaggccgaggtgggcagattgcttgaactcaggagttcgagaccagcatagccaacatggcgaaaccccatttctactaaaaatacaaaaattagctgggcgtggtggcacacccctgtgatcccagctactcgggaggctgaggaacaaggatcacttgaatccaggaggctgagattgtaccactgcactccagcccaggtgacagagcaagaccctatctcaaaataaataaataaataagattttagaggacatttgtgaaggggatttttggagggaaattttgaaggaaaagctcactgagtaggtaacattcaggaaaagcaaccagaaactgttgtaatactttaacataagcttccatgttgcccaagtttgagatttttaaggtatcaggataacttggagggaatatttgcatttagcagacatatctccacaaaaatgtgcaggcagcggcctaatgtcctactaatcttaggaaataatatgaggaaaaactttcatgttcaagatgcagccttatgcaatatacatgctcaagaaagtcagaagaaaatattctgcaatatacagaaactgatgagtcagaagaagtaaactaatggcaatttatcttccagtatttcaaaattggaacaactttttatttttaaatagtttcactcttgtagatgtgaagaatgtctaattccacttaactgggctgttgttctgttggggtgttatttaggatgttttaaaaaatattgtgttttttattagtacaaatcaggtgttagcacctggatttttcacacatatattatatttatttatttagaggcagggcctctctgtcgcccagcctggagtgcagtggtgcaatcttggctcaccataacctccaccttctagacttaagtgatcctctcacctcagcctcccgagtagctggtaccacaggtgcacgccaccacactcggttaatttttgtattttttgtggagacggggtttcgccatattgcccaggctgatcttgaaacctggactcaagcgatccacccgcctcagcctcccaaaatgctgggattacaatcgtcagccaccatgccgggcctctggatttttctttttaattatccaagccaacttgggttatcaacatggatttaggaagaattttagtgtttctactactttgcaagtctaattatggtttcaatttatattcaacatttggaatctgaaaagtgattctgacttggtcattactatacataagaaaaaaaactattctctccccaaaaataaaatttgaagacctgaatatttaataacaacacttgtgattaaaaagaaattctctaacttctcgatttaaacctttgatttgaattacagaccaaaaagaagtttggaagtgtaaactaaaatgaaatttgtgctatattaaagcttttcatataatagctttttgttcttaataaatattaaaagatatataaatagttggtaaatcaatttagattaaatttatccagatttctttgccaattacactgaagggacagttatttgaatgtacagtagaggtatcctagagttatgaagatggattttagaatagaatgtcttctggatataaaaatatttcaagttactttagagtttactggtccactcatgtcctgatctggaaatttccagagaagattgggaattcctcctaagctggccagacagagtgacatctctctacagattctagagttctgcctctctcccactacacttcagaggtggctttgaaagaccacccaggcctcctgaccagccctctcacgtggcagctcctatgggtgccacataaccgcagtctctccacatcgcctttcctccccatcgtggagggtaccttcctggtaccaggaaggatcttccatttgaagatacaactgccttcttggtaataattcctttgccttgggcccacatcctggattccaagtaaccaagggcaggctacttccagtcacacccaaagagatggcttgtccctcggctggggctcaacttctgctttggaaaccagctgaagtccaggacacaggctccccaagacctcactagagatctggtgtccttagactctccctattaaactccagcttatttacatagtcacgggcattttaggacaataaaaagaaagtaaacatcagaggcaggatttcctcaaagacattacattgtacatacatgacggtatgtcctgatttctttcatgcgatgctcgaaaataacctaagtaatccacatcgattactgcagagaagccagaagagtaactattcctggggatagctgatgtcaactaggagggggtgcaaaggaactttctgggtggtagaaatagtctttatcttaatgcaaggaatgattgcatatgtaaaaatgtatccagctgtgcattaagatatgcacattttaccgtgtataaattacagctgaatggaaaagtagaaaaagagaaaaactctgctctgagaaaatcttgaatgacaaaaaagttaataaatcactcaatttttcaactacacttagagagaccaggattctaagctgactgaccagagaccagtccttgaacctctccagactttatcatatccacttgtaaaacaagaaggttgaacaagatggtatttaaggtctcgtctaccatgaacaattcggcaaacctgccggagaccatcagccatccagtgtggcttaccacctcccaacctaagtgaactcacagccaagcagcaccttaacttttcatgccagggttctcagttctcctaaggatgatggggggagggatgtgccacaataaaacacatctgcttccagtaattccagtcagcatatatgctttcaccaaacgtagtcaggagatctcctaacattattgccacctaattgtaaatgctaactaaggagccatcagaatggcccacgatacctcaagctcaacatatcgaaactgaaatccatcattttcactcaaaagcccccttctgtgctcccacttagttaatgtcatggccatcttcttcattattcaaattagaaaactcaatgtcctatttaaagttttactaacctccccataggggatagactgttttatcttgatagaacactgcatttttaatataaagaaatgctattcttcctgtaagccatcataccagaacaatgccacagaaagcatcaattcctactagtcataaaaggcagctggaacatagatgtgaacataatgaaatcataccaaatgtctctacctcccaggatggctttgctagttgaaatccctggattctggattcagacaggctcataatttgactccctcactccagtccctctatcctgataaccaccctccctagtgaggccaaatttctacagatctggtccagttactcctttccttacagaccaccatgattccccctgtgccttataagacaaagtacaatcccaagcttggtaagtgatttacggcctaacttaattttcaagtttttttcccctactccatacaagctttgcccctcacccaccagcaccatgtgccacagcctcagctatgtccagctactgatattccctggacaccactacagtttcctaagactgactatgtgtctgcctgttccggaattgcttccccttcattgaaatcctgcccacacaaaattttttttatcattttgcatcttgatttataatataaaaaataagacagaagacttcatttccccaaaaataccaaaatttttacaagacaattcattaggtgcattgcctggaaagtagcaggaatcctcattagtcagcatcttcacatagcatttgtctgaatggagtagtttatcattactccaaagacatactgaagtttcattaaaattttttgatgtaatttttcttctatctcactctcttggattctaacgttttcttttctcttttcttcttcttttttttttttttttttttttttttgagacagagtctctctctgttgcccaggccagagtgcagtggtgcaatctcagcagctcaccacaacctccgcctcccgggttcaagcaattctcctgccttggcctcccgagtagctgggaccacaggctcacgccaccacgcctcgctaatttttgtatttttagtagagacaggttttcactgtgttggccaggatggtctcaaactcctgaccttgtgatctgcctgccttgacctaccaaagtgctgggattacaggcataagccaccacgccctgccaacactttccatattatttactctatgtggtagttcatgaaacctttcccttctaaaagatggcctgttaaagtgtcaaaaagaccaacaactagaattggcctgcctatgaccatctgtaagacaacagaccctctaagagaagaaatcaaagaagtttgaattcacacattctgagacagacggaagaaagatatgctattattgctggataatgaacacatggatttatgagaaaagcagaaatatatatgaaaaatttaaattataataaggttagagactttccatctgccattctaggagctaacagtatctccataggcttgatatttttataaaaacaagtgcttcaagaaaagagttaacagtcagtcagtgtgtgttgctaatgctggagaattgattcaactagggatgacacttgggaccaattaattcaaagctggctttaaaaaaaaaaagtagatacaataaatcagggagtagagcttcatttaaatatagtgagggactgggatagattacttgaaaaagctcagaaccaaagattgtctcaaaaggccaaagacaactataagtaaaacaagtgctaggtttctataagctatcaaacactgaaatcaaaaccatgaaagaaaatactggccaactggatgtcaactggaaaatttatacaaagtttgttaatttgtacttgtatcccctcaatctataaaaattttaaaacatgttttaaagcaacaagaaataaaaacagtttgttataaatgaaaattttcaggaagttatcgttctcaagatgcattttactgaaattacaagacaatttttaatagcaatcaagtaggaaccttgaggagaaatggggaaacgtaaagacttacatgaaatcttatacgggagtgtggtcacagtaaaaatatatcttctttaaaaagatgtttctatttcttttgtattgctgttttacctttaattttttaattttttttttttttttagtttaggtacttctcaatttttaaggggattgtgctctagaagtttctgatctagttgttcagaacctgaaatgtattttaatgtagacaccgcattgtatatagcactcacattccatagctaaccgtaaagagctctgctgttgctgtagttgagtgttgattcaaggtacacaggacaggctgagatctgggtcctggcttctggaggccatgagatgtagaatagaaatgttgaagaacaaaaagaattgtttcttgtatttctgaaggtcaagcttgagcatgacaaacttctccacagggaaagtttttatttgcctttttgatagtcaaatcacggtcctgcctctccttttgttgggagcctcattttggtgggttagtaaagggaacatctccaacattcataggagcatttgtttaaagggctcccacgtggcttccagccacttctctccactctgaaacttctatgaattagagaatccccctaattcattcaaatatattacggcctatatttttttaatattacaatgatctgacacagttgggtattgaaaatagagtaaaaccattacaccacaattatcccttcatccctgatgaacatcctcttgtccatttttttaatcatacgaataaatgaaaaaaatgtgataaggtcataagagagttaggaacattatgtaatcttctttaaaaataagataagctgctctacccagtaaaaccctaggtttctgcagccatatgacagtctgatatgcatgctatggtcggtcacggtggctcacgcctgtagtccagtactttggaaggccgaggcaggcagatagcctgaggccacgagatctagaccagcctggccaacacggtgaaaccctgcctctactaaaaatacaaaaattagctgggcatggtggcgtgcgcctgtaaccccaactactcaggaggctgaggcaggagaatcgcttgaacctgggaggtggaggttgcagtaagctgagatcgcgccactgcactccagcctgggtgacagaatgagaatctgtctcaaataaagtaataataataataatatgcatgctatgctctggtccatgaagaccttccacacagtgatttagaggttcagactccttttctctgtggctccaccatcgtctagagcccgggaagtctagctggcaaagagagaaagggaggatagagaagcattctctcttcttgaccacactgaaccagcgtgaacacattccttgccctcctccctttggtaagagctagtcacatgtctccacctggatgcacagggaccaggaaggcagttactggctgggtagcagctttgcgggagtgatgatgaaaaggggaaagaaaccttctgtgaatggttagtggtctcttttacaggtactatgacaccaaaaaggagtaaactttaaagacaccaaggtaagtttccaggagatgcagcatttgatttgcattgaaggatgacaggcaaaaatgagataagggcatttttctggagagaaaacagcataggcaaatgcaggtgggggaggaagaccgtgcaacatagaagcaattgaaaggaataaagccgaagcccaaggaccacttcaaagatacctctctctagagaaatgacccaccgcctatctgttaagagtttgacaaatgaaatctggctgaacctcaggccttgtcggaaattagtcattttgcttgcctttgcggatggtgttaaaatgatcaaatttggttttctgcatctctgagtttgattcctctgatgagaactgatgcgaatgccaactgactttttatgaagagtggttgatatttagtattctacagagtctttctgggtaagtgtaaccagagccagtgaataatagaagcagtgtatatctgtcaagtgtaattataacactgaattatgctcatcctgcattccggttcctgtatacattagtttaaacatcagaacatgctggcatttcagacctgtgaggattttactttgaaaaatagcatgcccttgtttttagccatttttaacaggaaaaaagaacttatatcttgttcaaaattattttatggtaaagtttgaccactctgttttttaaaaaaatcttctcaagtttctaaaaatagggaagaaatgaggaatatttcagtctagttttaaatgccctctaattttctgtatttaaataaaatcgtatacaataaaataatatcttattttgataaactgaactttctgattaaatagttgttaaagttacagaatagagttgcttataaagtcaccaatctttgccagagaaagtggaaattatcagattgtaactttaaaattatgcaagtattgtttatcgttgaatgatttaaaaattcagagcagcaaaaaggacaaaacaaaaattcagctataatcccatattccaatatatttaaattatcattttggtgtctatatttctaaacatttttctatgcatttatatatactttttttttacaaaaatgagatcatagggtacatactgttttgtaacctacttttttatgtaataatattttaagaacacattttcatgtcatttttcttaagactccataacaatatttttttttcaactgagaacaaggaccataccagaatctccaagagggcatgtgtagtttgaaaacttataattttatatttagaaagaaaacccaaaaatagctattgttttggtaatataacctacagaatataaagcatagaaatttccaattggctggtcggatgtttatctgggatcttctgaggtttgttatattaccattagcctcctacatggggcatgattagattactatgtcaacaaatgggagcacagattttgaaagattgtgaaatacagtgcctcaactgccaagcattccatttaacccacagtcccttgctgttgggcttaacttttgaaagataaatttccacacattctgatccactggcttctggttgctcattcccaatcataacatatgatagcatactatctattttaagtatgtgatatgcgattgctttttatcacatactcacatatcacagcctcaagctgcagggcagctcaaatgatgaaagtggaagacaggccgggtgcggtggctcatgcctgtaatcccagcactttgagaggccgaggcaggtggatcacctgaggtcaggagctccagaaaaacctggtcaacatggcaaaaccctgtctccactaaaaattgaaaaaatagctgggtgtggtggcaggtgcgtgtaatcccagctactcgggaggctgaggcaggagaatagtttgaacctgggagggggaggttgcagtgagccaagatagtgccactgcactccagcctgggtggctgagtgagaagaagagaagagagcagaggggaggggagggggggaagggagggatggggaaggaaggagggagggagggaggaaacaaggaaaccacactggaaggaggaaggaaggaaacaaaccacattgggaagagagggaggaaggaaggaaggaaggaaggaaggaaggaaggaaggaaggaagggagggagggagggagggagggagggaggggaagggaagggaggggaagggagagggagggggaggtggaaggaatggagggaacggagggaggaagggagggaagggagggagggaggaaggaaagaaggaaggaaagaaataaacaaacaaggaaaccacattgggaaatccaagcaaagatgggctcagcaggtcacatggtttggatatttgtccctccaaatttcatgttgaagtgtgactcccgatgttggaggtgggaacctagtggacagtatttgggtcatgggggcggatccttcatgaatggcttggtgctcttcccatggtaatgagttcatatgagatctggttgttttaaagagcttggcacctcctcctcctctctctcgcttcctctcttgccatgtgatgtgctgctgttccttcaccttccgtcatgagcataagcttctgaggccctctctagaagtcgatgccagcactatgctcatatagcctgcagagccaagagtcaaataaacctcttttctttataaattacccagccctaagtatttctttatagcaaggcaaaatggactagaacagctggatagtactgctaaccgatgaccctatccccaaagctgtttccattcattctctttgttgagagtatgtcaaaccatcccaggatggaggctggagatgagtttaaccccacctgcaactgttctctcgatggagctactctacagaaaaatcatgttccattagttcactaaatcgtaacaaaagtaaatgtacttgtttgaacattgtacaaactagtcctaaaagggttctcacgtattttatatgcgcagtctttagggaggcaaaaatgttttatgcaatctatacaagaaagttatattttcagctgttatccaaaacaaaggaagcgtactctgtgaaaaattggtattattgtttaacaatatccatttccagaggaatgcttttcttaagtagaagttggctgacacaaccataagggatgctgtgaagtgatttctgtcatttttcatacatggaaacatatgaactcaagggtctactaactcttctacaactttaaaggagcacttatcctgggatactttcaaacctgagattctgagattctatatttttaatgttcaacccttagtttcctcatttctaatattcattactaagtagacgataaagatcaagttaagcatagcttcagaaaaactaataaaataatttaaattggttatgcatctcttgtgacgattctaaggcaaaaggcacttttatagaagtctttcacactttaagaaagcttgctatatagaaaatgattcagttgggcacagtggctcacgcctgtaatcccagcactttgggaggctgaggcgggtggatcacctgagttcaggagttcgagaccagcctggccaacatggcaaaaccccatctctactaaaaatacaaaagaattagccagatgtggtggcgcgtgcctgcggtcccagccactcgggaggttgaggcaggagaataatttaaacctgggaggtggaggttgcagtgagctgagatcacaccattgcactccagcctgggcaacagagcaaaagtctatctcagaaaaaaaaggaaggaaggaaggaaggaaggaaggaaggaaggaaggaaggaaggaaggaaggaaggaaggaaggttctcctttcctctctaatgtctctccattcccatttaaagtctctgttgatctgcagcataattttacttttttctccactatttgtccaatactgcaaatgcactgtagttgaagagaatctgttgttgtaatggaaaacagaatcaatctctttttatactctgagcctatagcatgtagtatatatgtcctcatttggcactttttaattttcattacagagatcttctctgaagtcatatcaaggtgacactgaaaggatttgatagaaaggaaacaatttgtggcaaaacagagagagaaaaatactacctgtgatacaacctatcggcagagtcacaagtcagtccacagaaaccagaaaacagacgtccccttggctgctttccttctgatagacttatctaaagctctcactagcaagcatgctccttccaaagccatagcctttcatcctcagagttcatctttggcttttcctcattatcagtgtccctatcaagatagccatgcatagcacagttatttagaaggcacaattaattgacttgtatgctgtctccttgtaagcttcagcttggtctgtgttgaaacttgtcagcttttcccccaattcatgttgtttcaacctgcagttttattacctcctttggatgccaaattctcctttctccttgcactctccaaagccatgtattttgatgaactggctctctctgacatcacctcaaaccaacttaataaatcacccctagtcttctaccaaagcacatttccttaaatgagttttctcattttgccgcacaacctgaatatggtcggaagaaacacttctttgaagtccatcccctcctcaatctgctctcctcttcatctctaggggatccttaggtatgagtttcagagtttctctaaagcagcttctgggtttccctttattacaacactctatccccagagtaaccatctgggacctttatctattcttccaaaatgggtactgtctgcccaatgaacagctgtgctctttccaaacaagagggtatttaaaacccaactgcaagtcctacatggggtacaggggattgttgccagccacatatcattttggaactatttttgccttctttctttttaaatcatataggcctattaatattcaaggagttattctcaaaaggtggttaaatgcatagaaaaactaaaattagaagagctttgcattttaaagacagctttctgtttttgtatggccaatggtatctcccttttgcttccttttctctgtggatgtctttgtttgtgaagttattttttaaccataataaaaagcttaaaggccaaaatacataaagagaaatacttcttatactcaagaggttatcgagataccagagattttaaaatgagttcgtaacattgattcctaagctccaggcatttccttgaagaatttccagaagacttcaaataaatttttcttgccaatgttcattttcagatgtgtttaacaccaagttttctggtgtgaatatgcatatatgactctaaaaatctctacattcagaaactaaaactatactaaaagaaaaataggtcattttttatttccttcataatatgacaggcaatacagtagttaggaaaactaaagctctatatctagtcattactggattttagtgtctctcagcctcagtttcctgactaatcagtgagggtgggctcaggggtcgaagtctattcactgaagcttttaggtcttaacattattggattcaatcacatacttcttttttttgagacagagtctcacactgttgcctggtctggagtgcagtggcgtgatctcggctcactgcaacctctggctcactgcaacctccgcctcctgggtcaagtgattctcctgcctcagcctcccgagtagctgggattacaggcaccctctatcatgcccagctaattttttgtatttctagtagagatggggtttcactatgttggccaggctggtctcaaactcctgacctcataagccacccgcctcggcctcccaaagtgctgggattacaggcatgagccatcgtgctcagcctcaatcacatacttctaagctgatgtgattgtttctgtttttgtggagttacaaccagttgcaaatttagagagaccacattccccataagactgcatatgcttctgacaccaattgcaagttcagaagttccccaaaccacccccaggtttgatagttctgtagaaggactcacagaattcactgaattctgctgccgaaggctgctatactcatgctgcattatgggtgaagaatgcacgtgaaaatcagacaggggtagaagcacagatggcagagtccaggaacagtaccagatgctgagtttacagtcaacctctctatatagattcaggagcacatttctttcctggaacgggtgtgtaacaatttgcatggggtattgccaatgagggaagcttcctgagcctccatgttcagagtctttactgagactccgttatataggaatgattgattgcccacatggctgacctcagtttccagcccctcagaaggctggagaatataagccaaagccccacacccttcatcacattgttggtcaatctggcatggtaaggccccatcttttttctttttctttttttttttttttttgagacagagtttcgctcttgttgcccaggctggagtgtgcaatggcaccatctcggctcaccacaacctccacctcccaggttcatgtgattctcttgcctcagcctcccaagtagccagattacaggcatctgccaccacgcccagctaattttgtatttttaatagggatggcatttctccatgttggtcaggctggtctcgaactcctgacctcaggtgatccacccgcctcagcatcccaaagtgctgggattacaggcatgagccaccacacccagcccaggccccatcttaaatgccatctggtgtggccctacccctaaaacacaatgttagactatctggaataacccaaggctcccaggcaaatgaagacatgcttaccaggcaggacatcccaagggcttagatattaccttcccaaagccaaaggcaagggccagacctcttgagggcaaggctaaattctctattacacagttctgaaaatctctctgttgaggacaagaaagcaaagattcctaggacttactactagaaggaaacctgaaactcctaatgtttcttaaagtaagattccaggaccacttgcgtcagaatcacctggcattaacaaaatgcagactccaaagccccaccccaaacctactgaatcagattctctgtaacagaagcattggaatatgcattttaagcattttcctttagcagttttttatgtaggccaaaacttgagaattgtaattaagatccaaggtccctgttcctacaagtagagtgaaactagcatgcaataaagcaaagggagaaaattctgcttcttattccactggtgagtttatcttgggcaagccattagtcctcaaacatcatatgtttgaaaataacgtttagctacatttgttttaaacagacataactaatgtagcatgctcttagactgagaaaatattcattgagttactttgtgctcttgggaaagatgcttgtggaatacaagatggaactccatctagttcggctggccttgggaaaatgagtggatttctcttttcagagtatccatgtgatcactgttgccttcctaggcaggagtagtttctattcatcctttcattcattcacaaattggtatctactgtgtggcaggcaatgttctcagtgctgaggagagaacaatgaacaaaacagaaaatgcctctgccttcctgaggccaggaccacatatatattattccagatagtgatacatgctatgcagactttttaaaaatcaggattaaaggggaaaggacagctgagagcgaagtttgttatttaacatagaatgtttagggatggagtttctaatatgatgacttgtgagcagagaagtaaacgctcagccacagagttatttgggtaaagtgaacagcaagttctaaggccctggggcaggagcagtttcaaatgttgtgaaggagaaagtcctatgtggtggaattagaggaagactaagaggagtggaaatagatatggggagtacagacatctctttcaaggaatttggaaacaaaagggtgcatagaaatgaaatggtaacttttgggatagataaggtcaaaagaaaggttttatagtgccagtggttgttaagagtagagatatgtctctgtgtgtgtgtgtgtgtgtgtgtgtgtgtgtgtgtgtgtgtttgtataacaacccagttgtagagggaggggagaattgtcagagtggtgtccttgagctggtaggaaggatggcatcccgtgtataggtgcagcagttggccttgaattaggaacatagatgaactctttacttctttctccttatctctctgattcccatggcgaccttattttcagccttcctgcctcttctcatgaccctttcgtgttaaataaatccttttatcttctgatgtacagttagtacttcattcagaaaaaaaatacaggaaacaaaaaaagatattgataacactgttcaccatagagtgaggctgaaatatctgttctaccaattaccagttttgttgtatgactcaaatgagatttattgtacagaagatcccccaggaagctgccacccctcgaaccttattttagaatggaaaaaacgtatcattaccaaaactaaacagtgttagctggtctgcccatcatgctcatgctatataactttccttctcttttctcttatcctgttctgtactgaatggccaaattttttctgctacttcaactgaaactgtggtctaatatctaaatgctccctcacctgctgagaaaacttagagccaaaaacacctggtattggtcagttgttaaatttatcgctcaatatactaagcttggagtgatttgttgagttagaatgagagcaaatagtgccacctgctggaattacacttggaaggggaagcgtgaacatgccaagagctctccatggttttgtcccaatcattactttaagcctttcagatgaagtcatgagcctgctttattagaaagtaatttcttccacctatattcttttctgatggcaatatgccaccttatgtatttctcttttagtatttctcttttctccctgtaatgattcagtatctaaaattaccattaagaccagctgtatttcattttatttctcttagaatctcttgaaaaattatagaatgttgccatttgaaagaaccttagaggttctccgtagtttcaaacacattttggacacaggaacttttgggaaactatggatataatcctcactttggacctcaaactgaggcctgaagcgtgaaaagtgaaaagaccaaacagctgaggctctatatcagttaagatgctttcagttacaataaaaatggcttgagcaataacataacagcatatctcacataagaaatcctaaggtagatggctctgggattaatttaaaagttgagtagaccaggtgtggtggctcatgcctgtaatcctagcacactgggagtctgagatgggtggatagcttgagcccacgatttcgagatgagcctgggcaacatggcaaaaccccatctctacaaaaaatacaaaaattatctaggtgtggtggtgtactcctgtagtctcagctacttgagaggctgaggtgggagaatcatctgagcccaggaggtcaaggctgcagtcagctatgatcacactgccacactgcagcctgggtgacagaacaagaccctgtctcaaaaaatacaaataaagaatttttaaaagttgaacaatgtcagccatgacccaggctcatcctctgtcctctctgtcctctgtatctctgacatttgtgaggcagctccagcaacattaagaaccacagcttcccacccaatattaaggggcagaaaagggactgtcttttccttataactcaccaaaagactccactcatgtttcattggctagaagggaattatgtgtctcatccaaagtgggtagctggcaaggagcctggaattgccatctttgccttcattaaatccagatccatcctgtgggccttgggtagggctgtccttatgcaaagtgcaagactctggaaacacagagattccagggcaaaatccggttagctcacaaagaaaaaagggaaagtgactaattattgggagaaaaatctccatgggtctcttccacttttgcctgccttctgagcaagaagcattgacagctttgtttataccttttttaaggatgtgtgtatagctaacagccttggaagatacagatagtgtcttcctctgggacagagggtagatttatttcatggccagagtaagaaatataatgtcactctccggggcagaaattgagcaagtttgctagtagctactgtaaaaagattggggtttcctaagtccagggtccctcagctgtgaagcaaacttattgcatgtgcagcatccacctgggatgccctgcattcccctgcaagggaaagcaatgtgaacgggaagctcaggctgcctgctgtgttgtgagtaaagaagtcctttgtctctgacccaggagtttcatgtcttctgccagcatcatcagactgtggccatgttaaactatggttctgccagcatcatcaaaccatggctaacttgttagcctgcaagtggggtaaagtctcagacccttcccagttcttgatactcatggaaaggcaaccattcatgtttggcacagtgttctttccaatgagccaggctatatgcatccaattctcaaatacttatttctggaaatgagaatttgttcggtatataagaaattcctttttcacaggcagaaacagggcaacacttcagtctccaactggagacacacattaagcgaggacagtgtcattggctcaagtgtcttttatgctgtctcccttttattcgctcactctctctataattatctcttttaaaatgtcagttgctctcacccagaagaccaagagcaatcagccacaaactgaacttagaagcttttaaaacacactggctgtctgactgggggatgggatttctcaaaggcttcccgcagcaatgtcagggaagctgacattgagtggctgagaaaaaagagccctttccttggctctcacagtgggtctttcagatccttcctgaggaagcaacggaaggggtgtggaatgtgctgacttcataaatatttctccagcagagcctgaatggaggctgtttgggaagaaagttgctcgtggggtcctttggccttgagtccctcttactgtatcccattagggtgagaggctctgagctacggcatcgtcctggcaactttcttcccttctccagaataaaatattgatgttaaggtgacggtgaagaaataggggatctattgggacaagcaaaaagtatagatattttctagcgacttctggcactcagagtttttccaagtagtgacagtttgaagacctggacacgaattcatcatagcagtaggagaatcacagaggaaattagaacagcatttatccctacgagtcaaaccttagggttaaactcaatttatccctaaattctatttccttgatggcagttgatgcctttaaaatgaaacaatctttcctacttagcccaggaaccctcgttctcttgctgttctgacaacttacatttaaaaaatgctcctgctaaaatacagtgttatgagaacagaacagatttaatctgaaaccaaggctactttttcctcatctgctgtatcagaactacagagaaagatcacacagcctgtgggtcatattatcatcttcctgcattctgatcatacttccatggaaaccttgatggaggtcactggcctgcaagttcaatccagtcccaatgacccctggaggcaggggcttctaatttagatgagatatttttctgaagtgtgtgtccaatgaccacaggtgttgaaatgaaagttctctcgctaacgacatgaaggatcaaaattccttggtacaattaggttgattaaattgagctctgtgtctaatatccctgtagctcaataaagttaatgcagctttccaaggggcccaacacagaggcagggaacagtctaggtcctgagagaatctggcccaccatggtttctaaattagaagtttgattgcttgtgacatcgtcttaaaatggtaccagccaaaagaagctgaattttccattagcccaggaaaaaaaaatgacagatatttaattaaactgcttagagattaggtggaaagcttattgatggacagaggggctgaatatctttataagcaaagttaggcactggtgtgccacatctttaatgttgagaagaattcacccagcctaagggagctgaagacgtgtgtgctgcttcagcctgaggctgcctctcctgtcaatcacaagaaaaaatatacatttaaaaagcttgtttataaagcactaggtggtcactgaggaacttaacataaaatataaaatgtgaaattagaaagctacttatagctaaagttaataaagcaaccacccaatccatttgccaattgttgagaggtgactaattgcagaggaaggttgatttggaggtgatctctaaaaaaaagaatttgtggtcagtgctagagggtaggttatgagaaggagcctacaacccagatggggaataaccaaggtttgcaacagacgatgtacgacagggattattctccagaaatgttgtgctacctttcaggtaggcacaggtggtcataaaatgtaggtcaccctcattacaccaacaataggtcaccctcattacaccaacaataggttaccctcattacaccaacaataggtcaccgtcattacaccaacaataggttaccctcattacaccaacaattcaagggtccccaactttcaaaagagtataaagatcaatgaaatcaagtttcataaattcccccaaagcagtagctctcaactctagctatgtgttaacatttcctggggagtttttttaaaataccagtgccaactcttgaccaactgagtccaaatctctggacacaggtgtttcaagagatctccaggtgactatgaatcacttcccaaggagctacttactgaaaaggtaaattgtatgtggaattagaagatatcaggctctgaaatctgacaaaccttggttcagttcgtgactccactaacttactgaatctaagacactcaacatgcgctaacttctccagacttcagtctccttatctggagagggtcaatgatggtcacatcttggaaggcttctaaaattaaataaggaaataaatatatacctgacacatagaccccccaaaacacccttggttattaatggttaatgattgacattttatccttcttccattgattttgccatcgacctttgtaggacgtgacaggcttagatgatttttcctctccctgctttgtttgtcgtctagaatttactgctatttggtatctgggagaaaaatactcatgtttttcatgctttctgctcctccagctgccacagaagtgtccttttcatttgatgtgggaaatgggccagtagagattgtagtgaggtcaccaacccctctcaacgatgaccagtggcaccgggtcactgcagagaggaatgtcaagcaggccagcctacaggtggaccggctaccgcagcagatccgcaaggccccaacagaaggccacacccgcctggagctctacagccagttatttgtgggtaagtaatggaaaggtaaccatggcttccctctgttgatttttaagagcctgcacaatacaaaaaaaaaaaaaaatcagcctatgcaaggtttgatatagagatccttccaaaagtaaaggtgttggcctcttgtagtctccttcaagacagaatggaataaggaagaagtttcaggagacctagatctcgttccacttccactcttgggagctcactgtcctcagctataaaatcagagtgcaggctgagacatctctcaggtctctctaatatctgcaattttaggtttatggttttagaagtgtataaagttatttgatcatttggggcacttgtaactgtgtggaaggaaaggaaggaaggaaggaaggaagggagagagggagggagggagggaggaaatgggctaagttcagatttttttgaaatgataaatataaagccattcctttcttgcctattctcaaggttctaggcagagaaagatttagacttttcctgacataggaaaaaagatcagtacaaaaaagaaatttaaacagatcaaaaagttaaactacctatgcaagaagtggatccagacacccagtctaatctttttcacctgtctttctgctactgacatatttcagatgaacctaaaattacttcaaattcatacctgcttcccatggctagttgaattttaaattttgtttttgagaatattcatatgttaggaaattagcaacttttcctctgttgaatgaaataaagaagtgagtttgaaggactttgtggatgcatcatcttagacccctctctagggggtcaattgatcagtgcagtcaactgtggaagtctcagacaaagcaagataagaatgtgacttggttgctgttcatattcataacacctgccacttgggctccaccctacgttacagcctcactgagagccagttaattttaacaaggggcagagtccccacagtgtctttcatagttgtgttgggaagcttgaagagcggtagaatgtcattaaaggaaaggtaaaattagatctccattcattttgtgtgatgtcggccaactacaaaacaaaggtgtgggtcaatgagctttgaaagtgagactgacttttaacaaccacatcagctggggctataaaagagttatagatttagaaataaagtatttcctaattacaactggaaatcagccctttccaaatccttccctcaagttatagatcacaaaattacacattattttttaattagctaaatatcaggtccattgatccctgctgagcacagtgaagaaatttcacttcatcaacatgtgtggcccagattagctaggacaagtttcttcctaaatactgttaattctgaacatgctgggtagattctatctggttttcatcataacaggtgaccctacttgactcaacttctcgtttttttgaccctgcccctggatatagaagtccaactttagttttgttcctttctgttggctaactgtggctgtgtgtaagaattttgaagacctagtaaggttgtaaaatgaagagatggaagagtatttattatggtcttggaaggaacatcaattcacttaaagaaggtgacccaataataacttaagaaaagagcaagggcctgagatcagaattctacagaaccatggaatataagggataaacagaaaaagaatatctcaggaagaatgaagaggaatagaaataaggaaaattaggagagagtaatgtcacaagaggaggaggatttgattaaaaaggtaatggcaaataatatcaagcaccatgagtaaaataaggctagaaatgtgcgtgtgtgtgtgttttgagatggagtctcatcctgtggccaggctggagtgcaatggtgtgttctcaactcacgactcactgcaacctccacctcctgggttcaggtgattctcctgcctcagcctcctgagcagctgggactacaggtgcatgccagtatgcccagcaaatttttgtatttttagtagagaaggggtttcaccatgttggccaggctggtctcaaactcctgacctcaggtgatccacccacctcagcctcccaaaatgctgggattacaggcatgagccaccactcctggcctgtgttgttttaatttagcaattgtaaaaccattgatgaccgcagaaacagaaatttcagaacaggaggctgacgtgatgagtcagcaatttcttttgactagaaaatagtctctagtcccagtttctaattcctgtcaccttaaagggaggcacaaggcacatctctcagatatgagctactttagccaatttgtgaaatattgttcggcaatagaagtctacctcaggtgaagtgagaggggttgttacaaaaaaaaaaaaaaaaaaaaaaaaaaaaggacggccacggtggctcacgcctataatcccagcaatttgggaggccgaggcaggcggatcatgagttcaggagttcaagaccatcctggccaacatagtgaaaccctgtctctatttaaaaatacaaaaattagggctgggcgcagtggctcacgcccgtaatcccagcactttgggaggctgaggcaggcggatcacgaggtcaggagatcctgaccatcctggctaacacggtgaaaccccatctctactaaaaatacaaaaaattagccaggcatggtggtgggtgcctgtagtcccagctactcaggaggctgaggcaggagaatggtgtgaacccgggaggcagagcttgcagtgagccgagatcgcgccactgtactccagcgtgggagatagagtgagactctgtctcagaaaaaaaaaacaagactctaaaactaacacctagttcaacagctatgaatttctggagccacttatctccaaactattcagttagaatttagggacttaggtgttagtctcagttcacctctaatataaaagcattttcttgaccaactattaccatcttccctctctgagtatcttctatttctatgttttgtttgtttgtttgtttgttttacatggagtcttgttctgttgcccaggctggagtacagtggcatgatcgtggcttactgcagcctcaacctcccaggctcaagggatcctcccacctcagtccccaagtcgctgggactataggctcatgccaccatgcctggcatgaggtctccctatgttgcccaggctgatctcaaactcctgggatcaagtgatccttccacctcagcctcccaaagggccggaattacaggcatgagccaccatgcctggcctcttccaatattagacattttttattacatgcttggtaatgattgaacaataccagggttgccaagtggtcagtcttctcacaatggtgtgtggttaacaatatggtctttgactaccacctctgcctcttgccaattgagaaaccactgacaaattgcttaatatttctgtgttaattaggaatacagctcctacaccacagtattaaatgagatattccatgctaagcactcaggagagtgcctcgcctagggcccataattattatcattattattaataatagtagtagtagtagtatttgagacagggtctttctctgtcatccaggctggagtaaagtggcgtgatctcagctcactgcaacctctgcctcccaggttcaagtgattctcctctctcggcctcctgtgtagctgggattacaggcatgtgccaccgtgactggctaattttgtacagaaagggtttcaccatgttggccaggctggtctcagacccctgacctcaagtgatctgcccgcctcagcctctcaaagtgctgggattacaggcatgagccactatgcccagcaggtccattctcattaaatgtgagtttctttttcctttactatcctttaccttttattccctttattttcttcttcctccatgtaatagttacccttctcttaaagaagcctctttcaatgggctcattacttctttcttgaaatattgacttgaaatgtgatcacttccactcaccaaccctacaggaaagctcacatgcagagatgtccctcaatattcagaattattctgctagtcctcagcttacctgcagaggccacagagcagcaaactaaggcccaaggattttttcacagtcagccaagaaatcagaagttcatctgaaaacatcacaccagcatccctgcaacagctaagatatgtgacagaatggcccaagagctccacctaggttccggaaggaagggctttcatacaaattaaagctgaaacagactgcaaatagttcttggctttgcacacagagctctacagaaggccaccttccacccactaacctgtgttaatgtaattgcctgaagggtttttcttgcccgctacacaggtaaaccaaattcactgagacaatgttattgcagtaaataaagcgtttaattaacacaaggacagccaagcagaaggactggagttattactcaaatcagcctctctgaggactcagaggctagggtttttaaggacaatttggtgggcagggggctagggaatgggtgttgctgattggttggagatggaatcataggggtgtggaaaattgtcctcatgtgctgagtctgcctcagggtgacagccacagaactggttgagttctgcgtcccaagtctggatggaggcaggtggtttccagaatgcaaaaatctgaaaaaaaaatctcaaaagaccaatcttaagttctacaatagtgatgttatctataaaagcaactgaggaagccacaaatcttgtgacctccggccacatgactcctgagcattaagggattctagaaactacacctacattttaacagagttcaggcctctcccataattctaatctcatggcctttcattggttttacaaaggcagtttcaatcttccagccaggagggaaccagttttaaggagggacaattatcatccttgctttaaagctaaactctagctgggcacggcggctcacgcctgtaatcccagcactttgggaggccgagatggggggatcacgaagtcaggagatcgagaccatcctggctagcacggtgaaaccccgtctctactaaaaatacaaaaaaattagccaggtgtagtggcaggcgcctgtagtcccagctactcgggaggctgaggcagaagaatggcatgaacccgggaggcggagcttgcagtgagccgagatcgcgccactgcactccagcctgggtgactgagcaagactccgtctcaaaaaaaaaaaaaaaaaaaaaaaaaaagctaaactctaaaccaaatacctcccatggttagtttagcctgacctatgcccaggaaggagcagggacagccaggctgtgaggctagaagcaggacggagtcagccatgctagacttttcttgctgtgtgatctttgcaaaggtggtgtcattagcgaggccaggctcacatgtccttttgcaaagtaaccgaaaaaaaaaaaaacagagaagacacagttcacctcactgcacatctaaaatataattagaagctgtcatcccaaaagggttaacacaggtcttttggaagttgtaagaatccagagattattctggtttaatcaaaaagtaacaaatacatttaaaaactaagagacacagaaagaaaaaaagcacttgctggtatttgtctgaaaagtgcaggaaacttttcccattttttgatccaaaatgagtgtccagcatatgacgagctccctggatggcccagcagaagcacttaagccacatgttgatctgaagcctcagccagcccaggtgttcggacctgggctgtccgtgggccagatttttcttaggcggtggagaaagcaaacaagctcatggtcattgtctaagcatgaacaatgccaggctggattgagcaaagccagctttggcagagacatacaaggagtttggagccctgacagctgatagcagcggcaggagtgggagaaggcaagatatctgctgggcccccagcctgggaggctggctgccagcccagggcatggccaggagctggcaagcaaacaccactgcggggagccaagcaggctgttcaggtcagggagctaggacagggttagcatgcagcaagctagacactagccagagcatgcaactgctcttggcagtcattaagggaggagatcagagttacaagatctggaggccatttcagacagcttcaggaagaagtcaagctcctaagtggctccttgacagaggctaggtcatcttaactcatgacaaatgtccgtgctcaatttacttggctctggcctcttctgatatctctctagaggttaaagggaaccatctcttttgtgcagtccaaaaaggagttgaaaaatcaccctcagtgcttcaagctcttttgcgttgggcagaaagcctgactgagactcagtggaaggcacgctgtcttcaggaggactcagagactacctgagagtggggaagcccgcagcctcttcttcctctgacagtttgtctatcaggagacttttttctcctgggtggcaacctgagtttatggaagagttgaggtttattaaatggacgtataagcaactacagactgaaatgttataaccattctctgagtccaacctccccaaattctaaaatacagcttgtttggtcagctgcttctcatactctctgtattccaaaattgcaaatggatcattccagtgccatctgaaatgcagtatcattgagagaccaaagagaaaatcgcatttgtgtgtgaaggagaaaaatagaattctaataatgaaattcacccaaatctatgtatgaataaaatggctgtttctcatatctaagaaattgataataaaagatgtacaactcaggccgggcatggtggctcacgcctgtaatttcagcactttggaatgctaaggcgggcagatcatctgaggtcaggagttcgagaccagtctgaccaacatggtgaatttctgtctttactaaagatacaaaaattactcaggcatgctggtgggtgcctgtaatcccagctacttgggaagctgaggcaggagaatagcttgaacccagtgggcagaggtcacagtgagccaagattgtgccactacactccagcctgggtgacagagtgagaccacatctcaaaaaaaaaaaaaatgtacatctcaaattgcaggaattataacctagagaatgtgtgcctgcccctgtttcctgcaaacctgcctcaaaagcaaccacgtgaatgctgactgagacaccccggtgaaccccagggccaagtgcttcccatgcttcccctcaatgagtccacacgagtctataacatagataacattgctaattcttgttttattctcacattaaagattagttgacttaccgaaggtcgtgcatttaggaagagacagagatgggatttggttccagacagtctgactccaaagactcagcgctttaatcattcctcttgtcaaagcaaaaattgcactgggcaaagttgaacaggcaaggaagatcttcattcagggctgttgcgacagggtagagaagccagaatgcagtcgagctcgcctccacttcagctaagggcaggagaattttgtttctttattttgattttttggttttttttatttcactaaaatacaatgggaaagtttttacaagctgggataggagggatcatagggtgtctgtgtttgctgattggctctacccaaaggaaaagtaaactttcacaacttggagttaggctcccaccctcccgtggaggggagacagggtgctattttccttgacaattaccatttcaaagagatgactcccaagtttttgaaaaagccattcctgggttgtaaaactggcaaacagctttttaaaaaatttatatctcaaaagggcagagaaagaattaacaataacaaattttctaaagtaagtgctcttaaaaagtgaggtcaggggtctagggtggaatggaggggtcctatgtaaagtttagtcaagctgaaggcaaagttcaggccctcttggtcagtctataccagcgtcccctgactgagatgaccctgtggcccagagggtatgtggaaaggtgcggtgacactgggtgctcccacagcttcccacaacgtgcaggagaatccatcccaaggaagatttgcaggccccacgtgcaataccggccccttgtggagcactctcccagttatggagtctatgggagagactgaagttgacaggcagtggtgaggctggacatcaggcagccctggctggtattatgcagattataaagtcgccatggcaaagatctaggcctgcagagggccactgtcaaacgcaaagggtttggtttaacgagaagttaatgcaaaagcactcttctcagggaatgagacttcttacttgacagtctctatgacatggaaataatgttttgtttttgttttgttttgttttgagttcctttggtaaagcttttataaagtcgtcaaagtcagcatggatctctaagtctcagacacattcttcggggctttgcagactctctcagcagcatgtctcctgcgctctttcctgaaatactttcttcccacagattccacagccgtgtgctgtcctgcttatttttcctaccaagctggccatcacttagtctctcctgcattccctccttcctccgcttgaccactaagcattgcagtgtcacagagccttcctgtcttctcatccgaatattgtcttggatgatctcattcagcccaccatccaatggcttctgataataatttgtgccaatgtctctcaaatttaaatctccaggcctctcttctctcaggaactctagatccacttatcctactttctactttgtgtttcaacttagatattaaatgggcatcttagaataaacatgatgggaaacaactcttgatgcctcctggaaatttgttcctccaaaagccctccccatctcagtaggtggcatcaccatctaatccacccatccaccctaaatttggagttacccttgatttccttcttccctttctttcttctctttccctcatcacttcctatccaatagtaagccctgtgagtctacctccagactgtccctcaaatgcagctgaggcaggagaatagggtctggaggcagggaagataggcagattcatgctgacttcttggaactaaatcaaatgggaacgcttcagcaatgacaggaaggtgaacggctgtgtagcttcacttcatcctctccatttacttatgccacacactgagtaacatccttgccatttacatagggtgcatactgagtaaatgactttgtcacttgacttcgtcttcttcatttacatagggcatataccaagtaaccaatgggaaacctctagagggtgttgaaaccccagaaaattattattattcagaaataaatgaatacgtttatttatgtgtcctccccctagaacgtaagctacatacagcatagacggaggatagggtccaataacaactggtcaatggttacccaataaatatttgctgagcaaacatctggatgaataaataagtgattgtgatttttctgggttaatatccatattcaaaattagatcatctcctttccaaagcaagaagggtttttccttataaactttctccagaattcttttctcaaaatgtgatgatatttaccatcttgggaaatatctttttactgggaaccacagactgaaatcaagcatgacagaagcagaagcagcaaaaaaaaaaaaaaagtcacagagaaagtcagcatattatggaagacagcatttcaaatcagtctagagcctgagcatagttttcagtcttcctgatatcaaattggggtcttgcctgtttggcggtagctgtgatgctggctgcaatcctaatgcagagtttctaccccaacctttgtaactagttcttggttctctctgggatagaaatagggagtgatgtcgtaattagaaaccattgccatacattaaagagtaaattaatttgctggacaaaatctagcaaaaaaaattactacattgaaatcaatcgaccatatgcaaagcaaaaatgcaaataaaatatagaagctcctccaagaaatgccttctccttcacagttgttcactacaagggttaccagccctctattcttttctgaacctgctgggccaccacgctcagtcggctgctatcttctcaatagaaccatctccacctacgacccccacaaagggcaaaggatagccccttcccacttacagttgccatgtatgttttctgccctttgccctttagggatcaaaactaattgacttttgcaattccagctacctttcagtcagagcattaccataggaagtgagtgatgataggtacaatgtttgcgctttttttttttttttttttgagacagagtctccctctgttaccaggctgaagtgcagtggcacaatctcggctcactgcaacctccgcctcccgggttcaagcaattctcctgccttggcctcccaggtagctgggactacaggcacacgtcaccacacccagctaatttttgtatttttagtagagataggatttcaccatgttggccaggatggcctcgatctctcgagctcatgatccgctggcctcagcttcccaaggtgctaggattagaggcatgagccaccaagcctggacaatttttgctttttttaaaatgtgctcccaaataatcaaatcaacagtgtacttttaatgtcttttgagctcccaactaactaaaagataatctgttaactatattatatgggtagaaactttacggtgaacattctgaacctaagaaactaaaggttcaccttctcatgtgtcacaagaccaaatgcttcaggaactctggtctttcttccaacatcctcatggcaattggaatggtctgatgcagagaagacattttaatgtaacggtaccacttttgcaatcaatatggaaaaatgtttttcaacaaataaataatttcttatacagattttttatctttccgataaggactgaactaaacttcatgataataaatggcaactgtcccacagaaaaagattgtaataaaataaattagtatcaatgacacaaatattgaagaagggatagatcctcgcagccccatagttcctcccacagtacactatgagcgtgagaaaaaagaggcccacttttagtattccgcattcagataaacagggtcgtttcccatcagacgcttccctctcatgtttttatctcacagtttggtttctgctccttcgtgttttcaaggccccctgatgtgcaggatattgcgtgggtctctcttcctttcatggtcctattgtcacatcctgacaatgttcctctttcattttaatttcattttattacgttttttcttcaccattgccagcttcaccctctcgccatcgccgacacccactgaaacgtattttatggatggtcttctagtcccaccctctatatatttgttcaaagtatacatatcattgtggaaattcgtgttgtctcttgtgtgccatgctttatatgggtggcattgtactacagatcccattctgtttcttactctcttccctctgccttacattgttaagatctatttgagtagttctctgaatactatgtgcatagtgctccattatgtgtatttaccacgcatcatttattctatcccctaatgatgaatacctaggttttctgcaactctgccaccacgaataaccctccagggaatatatttatgtgcattctctgccacctgtgtgaggacgtcttgtgtgtgtgtgtgcctctgtgtgtccccagaattactgagtcatagagtatgtgtgtacctaatttcactaagcactgcttgacctatcagtttctgagtataaattttaaactttatttactgaatttctatcaatagttctatcagtggtagcttcgggtaattgaagtctattttgctagttagatgtgttcatgatcttcttgatttattgttccttgtaccagtatataatttccatctttgttccttatgacatttttttttaaatctcacagttttgtctctgctcttaaaactaccacactgctgggcgcggtggctcacgcctgtaatcccagcactttggaaggctgaggtaggcaaatctcttgtgcccaggagttcaggaccagcccgggcaacatggtgaaaccccatctctaccaaaaaatacaaaaattggctggatgtggtggcacacacctgtaatatcagctacttgggaagctgaggtgagaggatcgcctgagcccaggaggtctaggctgcagtgagccgtaattgtgtcactgcattccagcctgggtaacagagtaagaccctgtctcaaaagaaagagaaaatgactacactagccaggcataatgatgtgcgcctatagtctcagctaccctggagctgaggcagaaggatggcttgaacccaggaggtcatagctgcagtgagccgtgatcacactactgtactacagcctggggacagagcgagaccctaactctaaaaaaaaaaaaaagaaaaaagataataaatgaacaaactactatgctagccttcttgttgttgctaatattcctgttataacctggtattttttgtacaggtgtttgtatccttttgtttaaatgttcctcttagatttcatattgctgaaccttttaaaaatccatttggaccaattactcctataattttgacttggcagtgaaaataaagatgcaatattttttccatctatgttctcaagacttgtgactcctgtacatggatcggaaggatccctggggctgggggtctctggttcagatccacagctattgatgaaggtgttgttttttggttttggtggtggttgttgttgtttttcttacctaccctgtttaaacacttcatgagtgccttccatttgaactctaatattgtttgttctggaaataccagatatttcttcagatagtttcttgcctgtgtttattcttttcttatgaagctactattgtgcagatgttgacacttctaccctccgtaattcttgacttttgttttattcttctaatctctttattcattcctattgtcttcatggaaggtttcttgacccaatatcccaacccacgaaaatgttcatcagctttatccgttctgccattcagcccctccaaggatatctttattttgacagttatagatttttcacttcaatatctccaactaattcttattcttatagtttgtcattgtcctgtgtctccaatatcaggaaggtgggattctgctaattttgctgccgcttcatgtcggcaccataacgcaggtgtcttttatgcaaatcctacagttttctgctgtcattggttctgtgtcttcagcgctgcttcttgcccttatttcgcagtgcttgctgtcctcagaggtcctgtcatttcgccttctgagttcaagcatattcccttgagatttccaaatgccacctttgttattgtcttcctacaatgaaaaacaaaagttcagggcctgcattgagctcctcctggaaagttgagggggcaaagaaaaactcctgcctcaggacaaacctctggcattgtcatccctctcaaccctttcttgtttccagtccatgtccctcacccacctcccatacacacacacaacttcagagtacctcactcccacctagacaggggacagccatcttccactgtcattgattcttaaaccagtggtgtatctataccactaaatctagcctctcactacccgttcctccactaataagcatcttattgctatattgaagtgtctgtctcaaaaataaccaaatccaatagcctgttactgttgtctgattttccttgacttcttgctcttatttaacaattgtcactgtgccctccttgaaatcttgacatcaaaacactccagtcttctgttttctcagcctctctgccaactcgcctcccttttcccttttcctcaatccccaagcttctcttctttttcctccacccctttgcttggatggctgacatacccatgaggcttggtcatcagagctacactaatccctcacggatccatcccaggcttgacctgggactagcatccgcaaaggcttgtatgtgaagtctgagagtgaagagaacagggtgccagcttggataataacaccagggattcttgactccggatttaaaaaaagactagatacaaatgtttaaatagagactttaaaagacagatggaagcaggagagggggagggggagatacatgaagatcagcagaaagaggatgcttattttacttcaaagatgacaaaactcaccagcaggacacttaatatgaacaataacctaaagatatttgcaaaaatgtatttagacaagagttctaggctgatatatttgacatctgggtttattaaagtttactaaaatagctgttaataattttgaaatttggatccaactagaaaatatccccactttcagatgcaacttggaactgtaggtcccacagtaaagcaatggcttctgaaatcagtgctgtcagactgagcttagggaaagtatccatcatccaccattttagcagtggccaaagcccataactgccttggtttcaaaactgtagtactgagcttttgcactaagaaataaatatgatcttaatgacagcatcaaaaaagtgtcttctctttgttggcttagagattaatttggacattgacattcctggctctgtgagtattgcatttcccctttcagcttcagccatccttgtagctttagagacaatggtctgcccaggtgcaggggctcacacctgtgatcctaacacttttggaggccaaggcaggaggagcccttccatccagtagttcaagatcagcctgagcaacatagcaagaccttgtctctacaaaaaaaaatttttttaattaaccaggcatggtgacatgtgcctgtaaccccagctactcaggaggctgagacaggaggattgcttgagctcaggaggtcaaggctgcagtgaaccatgattgcgtcactgcactcggcctgagccaaagagcaaaactgtgccaaaaaaaataaataaatataagacaatgttctggcaggtggtaaatgtcttgcctcaggtattaatcactctatcagcattttgtatacctaagtacaacaatgtctagaagcatatcagacgtaggagaagaaagtgccttatatgatgtaagcccaaaaatcaaacggtggccagagcatagtaagagtgcaggcttaaaagctatccagcctgggtgtgagttctggctacttactggctatatgacagcaaatgaattaactctcttattctcagttcactcgtctgtaaaatggagataataatatctagctctgagagtaaagttctggaatagtgcctgatacttctagtatttaattaatattagcttttgaaataaccaatagtttaccatgcttatcctgccaccatagcctctacaatgaatcagaccacttagctccacccccattgcataacatttcacatttggacacataggagtgctttatactatggaaacccagtgtcccttcagtctctattttgaagctttcttctagtttaatagtttggattcacatgttctgcatgtcctttactctgaggacacaagaaaatccatgcaataataatgaactgaaaaaaatccatcctattgatggagttatgaatgagcactcatgagtgtcatctgaaaaagcaattttccaaaccccagttctctcagtatgtgaaagcttttttcatacttgccctccaatatctagctgacagagaaactactgatcaatacttgtcaatcatgcagctctgcactaaagaatatggagcaatttcctttaactctctacaccactgaagactcttggccattctgctgttctcagttcaaccagataactgggtttatattttacacacctgcactgacaccacaggtattttgttttgttttgttttgtttttttgagacacagtcttgttctgttgcccaggctggagtgccgtggcacaatctcggctcactgtagcctctgcctcccaggttcaagtgattctcctgccacagcctcccaacaagctgggattacaggtgggcaccaccacacctggctaatttttgtatttttagtagaaatggggtttcaccatgttggccaggctggtctcgaactcctgacctcagtgatctgtctgcctgcctcggcctcccaaagtgctgggattgtaggcataagccaccacacccagcccaccacaggtttttttttaacgggttcaagttgatgcttcagacctaagaaacaatggtagcatatagaacaggagaaatagcaggtacagaattgcaacttgggaaggcccagcctgcccaaacacatagctgcttttgccccctgacctagccagggcagctgtggctgccatgccagagagccaaggtcagggtgggtcacctagacacagaggagtcctagctctttttcccaccagtcactcacaccattccagtggcgggctcaagacctctatgctaattcacagctctccagtccagacacagccctccacgaatgataagatagcaacgacacccatcctaactctgtgctttcttttctctctctttttttttttttttttttttttttttgagacggagtttcactctgtcacccaggctggagtgcaggggcacagtcttggctcattgcaagctccacctcctgggttcaagtcattctcctgcctcagcctcctgagtagctgggactacaggcagatgccaccacatctggctaatttttgtatttttttattttttattttttattttttttttagtacagacagggtttcaccatgttggccaggctggtctcaaactcctgacctcaggtgatccacctgcctcggtctcccaaactggtgggattacaggcatgagccaccatacctggctctaactctgtactttccatggaaacagtgcagtgagaagagggaccccaaggtcactttctcagggaggtctagatcagcccgagcctgataacccttcctcattgtcttggtctgcttgggctgccctaacagaataccatagtctggtggcttaaacaataaacattctcacagttctaaaagctggaagtccaagatcagtgtgtccgtagggttgctttcttctgaggcttctcttcttggttttcagactgctgtcttcttgccgtgtcttcacttgatcttttctctgtgcaagagcatccccagtgtctgtccctcttcttacaagaacaccagttctattggattaggtctcacctttatggcctcatttaatgttaagtacttctttaaaggtcccatcttcaaatgcagtcacattggaggttagggattcaacagacaaattttgaggggacacagttcagtccatagcactcctgatacctctagtatcagatttatatacacatcatctcagccatatttaatttattccaactatgtgcttctatagaatgtgcctatactcaataatagcaataatcgtaacagctaccagtaactagaattagtgcaaagaagtgcattatctgttattaacacactcctacgcggtgcatattgttatgccaatgccacacataaggagactgaggcccaaataggacctgggaagctcacatgccatgagcggcgaagccaacacatagaagtagatctttgtgaccacagttcatgctttcttcatccctgcttgctgcctcccatacatcaaattgtgcctggcatcatcgtgcagctatttgtgatcaccttgggattaacctgcaggcaagaagcacgtcctcatcatcattttacaaatggctttcctgacgcctttcactcatgaactgatcatgcaacagctttgctcttctgagcatcctgcaaccgctctcatctcatgcctccttcccttccaacaggcctcccctacttgcaggatggtacccccttacctttttcctgaagccctctctccatggacgagctcatgatcccctttctgtcacttcctcagtggggcctatcctaaccaccctacttgaaattgcagcctcccccaccccactccaactctggatcccagctaaccctgcttgacttttttctccatagtggctaccaccttctaacacacagtatattttattttcttattgagtttgttgttaaatttctctttctgcctgcaagaatataagctctacaagaacagagacttttgtgtgttttgcttcaatactatgaagcagacaaacaaaacatctaaaacaaggcctggctcatagtaggcgtgaaataaatattttttgaatgaataaattagattttatgtgtgtgggctttagtgtgattccttctatggtgaattagtggccagtctctttgggcaaaagtactcaggaacccaacttagctctttattaagttctgaatttgaggacagtgtttttttttttataattcctcttgatcattgtttttgccctttttgtttaatttaatagccgattattttgtcccagtcttctgtgcattttacagttgtattattcattatgggtagttccagcattttcataattaatctttaattgcaatacttgcaaagcatttcacaagaaaaaatgatttacaaattaaacccacatctcaccttggataattatcacaggtctgactaatgtgcgtgaagcccttgcatggcagggggctctctacaatgacaatgtgttgattttctaattaacaaaggttaagtagcgtttttgcttgaagacctataatttaaacttatgacgtttgtcaccaagaaagatttctacagagcgcagaagtggaactcaaataattttcactgattctagtgcattaatgtcttttacataatatataatgaccgttttcaggacagaagatttttcttcatattgactagatcaggaaaagtaccttctagctcactgtcccatttaaataaatcagggactacctaagcaagaaaagagcctaatttatttagttttcctttatagagcgagaaatggcatttcactcacctgctttataaattatgaagagggaggacaaaactttttatttatttatttatttagagacagagtttctttcttttttgcccaggctggagtgcaatggcatgatctcggctcactgcaacctctgcctcccaggttcatgccattcttctgcctcagcctcccaagcagctgggattacaggtgcatgccaccacgcctggctaattttgtattttcagtagagaagggatttcaccatgctggccaggctggtctcaaactcctgacctcagatgatctgcccgccttggcctcccaaagtgctgggattacaggagtgagcaaaactttacttaatgaacacaacaaatacaaactagactacagtcatatgttacacccagttaaaagagggagaaaaaaaaaagtcagacatcggtgcaaagaaagaaaaagcaagcaaggaagagatttaatagaatttgagagtgtttactgaaattcagaaaaaaagacacaggcccagagggagagcctgtgaaccgtgagccagagtaattcagagctggaaggagtcacagacaccatctagttcagcctcctttatctgtggatggggaaaccgacgctgagagagactatgtaatttgatgaaagccacacaactgagtagaaatagttgatgatcctgagaaggaaagatccacaaacacaagtgcaggaagagagatggatccatgtagaacctaagaagtccaaagacccaagaatcaagacagaagcagagggagaaaactccgccccactaaatcctttctgaaatgaaccctgtatatataaataattaagtatccatgaatagatctaaatatctgccttaatgatataataaaaatatgatttactctagatttatttgctctgccaattgaccctttgaaaaatatctccattctcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgcagcactattcacaatagcaaagacttggaaccaagccaaatgtccaacaatgatagactggattaagaaaatgtggcacatatacaccatggaatactacgcagccataaaaaatgatgatttcctgtcctttctagggacatggatgaagctggaaaccatcattctcagcaaactgttgcaaggacgaaaaaccaaacaccgcatgttctcactcataggtgggaattgaacaatgagaacacatggacacaggaaggggaacatcacacaccggggcctgttgtggggtggggggaggggggagggatagcattaggagatatacctaatgttaaatgacaagttaatgggtgcagcacaccaacaaggcacatgtatacatatgtaactaacctgcacgttgtgcacatgtaccctaaaacttaaagtataatttaaaaaaagaaaaatatctccattcttcatcatgttaacattcagagtcttttcaaactctcaatcattgctgaagatccatgaaataccaattgtttccaaattaaaatacatcccagatagacaaaaggttaacatgtggagagaagcaaaatcacaaacatgttagaagaaaatatggttgaataatcatattattttgtattgtagaaggtctttataagcctctgaccaaaggcaggaatcacacaaataagacaggtggatgtgactacaaaaacatgcaaaactttcatcgggaaaaagaaacaccatagagaagtcaaaagacacaaactggaaagatacagctgcaataaagagttatttataaccaagagttaaagctcatattgttattaatcaataagaaatatattctcttgtattcccagcaaaaagcgaagaacacaaagaaacaaaaaataagaaaagggaaaacattaaaattactcagctcacagtatttgaggtgatgcagatttaaacagtgaatcctttttgcccccgtcgagcagactggcatgaatacaaaaaggcactgaccaatattagaattgtgtggagaagatgaaaatctcataccctactggtgaattagaagttggtaaattcttcttagaagaaaacatatttaaagtgcctttaaaatgtatatgcccttcatcctagcaattagacttaaaagtatgattaactaattttaaagaatgaattctaaggaaaaactggacgacaagtgtgcaaaggttttcataaagattatattattatagtatcatataaaatggaaaattttaaaaacttaaaagtccactggtggtgcaagagcgaaataagtgatagtgcattcacagaataggatgctatgcagatactaagcaagatgttctcgttgtacatttattgcttggaaaatgttgcaaaggctgggcacggtggctcacacctgtaatcccagcactttgggaggccaaggcaggcagatcacgaggtcaggagttcgagaccagcctggttaacatggtgaaaccccatctctactaaaaatacaaaaattagctgggtgtggtggcgtgtgcctgtagtcccagctactggggaggctgaggcaagagaattgcttgaacccgggaggcggaggttgcagtgagctgagatcatgccactgcactccagcctaaacaatagagtgaaaatccgcctcaaaaaaaaaaagtttcatgatatgttaagtgcaaaaagcaagtttcaaaacaatgtgtatattatgattccatttcttcctttttatttacacatagtatgttcatagaaaaatgaaaaaggctgttccctaaaagtgaaagtagttaaatctgagtagcgtaacagaatctgttttgtattctgcttctcagtatgtttatagtgaccacaatgactattacattgatcaccaggcagaaagagatggggagatctaaaaatgatttctacattttagcatattttgatagaatataattgtcttaattgactagtgataaaaaatttttaaggccagacatttatttaataaaatgtcttttggaaagcccttattgcaaggacaaaagccataatggctaaaataatagaagccaaattgaaattctaacacacaaggtgtaactagagggttgaagttcttccaaatcaggcaaaggccctcattctcttcagcgtagaggtgtgaagcccagttgacaaacagatggcagaatgggaaatccttcaaagtagttgtttttaataacttcttttgccatctactctctcatagctttgatcaaaaaaggcactggactctcttcacttctctattccaatatgttagaagaaatcaaatactcccaagggagtcatgattaaaaccaatgagtcacccagtgagagaactgcaaggcttgggtttgcagagatggtacagcaactcatttgccacttcactgatggggttttgcaggcataagcagatgctaattcatctctgccactaaagcctttgatattccagtcctgtctgaccaatctactggagtttatgacttttcttaagataatagagtaagtgatcagaatcaatccccagcctactgatcttacctgaattccagtaaccctactgactactccatgtttaaagacctccaaatctacatctcagaaacatgtacatctatgagacccctgactggaaagttcttctcggtattaagtggtctacacagaacagggcttaagacaataaaccctgtttgttgccttaggaataagacagatctgatacagttgccactcaggaactatgagtccttgagtaaacttcttaacttctccaagcctcagtttctccatctgtacaatgggaataatgcaaataatatctactttgataagttgttgtgaggaccaggtgagtagcatatataaggtactgtatatagagtgcctagtatgtagccctcaatgaaggagaaacttgggttttatttttattaacagtattttcttttctaaatgctcatcacctatttctttcaacagttttacctactattcattttagattagtttccagaaaagttgttactctaagatgcaagcatgtatataaatttgagttcgtccttttataccagctgctttaaaaagattatagctaagaatactatagacacaattaaatccatttgtgatagaatgcctcaatgaatctttctgtgaaatttcttgggaatattttaatattttcatgctcatgaacctcagtccaactctataacttactccaaaaatcacagtgaacgtgcttattgtgctatatgtcgtgtaatgacatttagacaaaagcaatgaaatctgatctaacctagcaataaatgtggtatagctgatttctgtgtaaagttatcagttccagcttccagctaccccagacaaggagccttgggtagtcttgacatgaacttaaaagcaaagcctctcttgagacaagaaccaagatctacaatcacatttcaaacggatttatgtcttccaactaattgacttgttaactatgctaatacattcatgtctctgcctttatattttttcaataagtaatgctacagaactcgatgttgtgagattaaagagcaaagaatctagagatttctgtaaacgctttttctataggaaaccagattagacttccaaaacagctgatataatttttgtgcatctccaaatattttatttctgtaggaaacgtgttgcttctcagaagatggctcttttaattaggccttatagcctgcagggagaaaagcttcaactttctctatttagataggaccaacttgatagtgacaatactagatgtgctatgcagtgtcatctcctaccacagttgttcaaaatatgaagaattaagcaatagcagaggttattccctctgaactctgtgccttctgtcattcccaggtggtgctgggggccagcagggcttcctgggctgcatccgctccttgaggatgaatggggtgacacttgacctggaggaaagagcaaaggtcacatctgggttcatatccggatgctcgggccattgcaccagctatggaacaaactgtgaaaatggaggcaaatgcctagagagataccacggttactcctgcgattgctctaatactgcatatgatggaacattttgcaacaaaggtaaggtggaacccatttccagagccacttttgcgtgtctttttaagcccaaatcatctatttaatgatttttcatatgtaaacaagtgtaccttattctgaggttaagatgatcagaatttttctctcaacttaggtaggaattttccaaccaaaatcatttcctaatcatttttgtttgataaaatgagagaagctctgtgtatggtgcagaatttcttccagattctagcaaattattcactgcccgaaacactacaaaggcagtctcattacatcttaatggtgagtgataaaataggtggccttcaaaaggggaatcaggcctgaccctcccacgttaggatctccaatagatcaattgatcagtcaatttctgtagtgaatcagccagtgcaccccagtggtcttgatgcccccaccccctgcagttgctaagagactggattcaagctacactcaccagaaagctcctctggtcagtcattaacatcattattattactcttactcaggatgcctttgagtggctctcagcctaagctaaactgcagaaatgctgaaaaaccacatttaattggtcagcttagagcatctgttattacttggttattttagtcttgaataattcctttaatccccagtagattccgcagagccaatgagcagagtacaagagcccaatgcatatgcatgttatcatttgaactataccctgtgatcctgcttgaccagaagaagaaattgactcaactggtctgtggcttaatttcccatatataaatgagggatgaagagaggaggagctggtgcttttcctaagccacaattgaaatgcatgtaaatcactcctctctttctaaatgaatgtatagcatatgggtaaagttttctgtgagcggttggtgcatctcttaataagaagctttacataagtagcctgttcagactctgatgaatacatggagggttgtttacactggcattattcacacaagatgccacacacagaaggaggaattgttccataacattctctgtacctccaggctactgtttggcagcgctataatatgagcatacaaattaggccagacagggtatgaaaaatgagcatgagacaacaacaaaggtggaaaggaacaccattgcagaataataccaaagcacattaacagtgctattacagtgcatttttctgttcagaacaacatggttccatgattttcctgcggcacacaattgaatgggcctgcagaacacattaattttgcacttgtagaaatgacagtcttgcaattaccattcattgtgcttgatgctaatttaatgcagtcatttccttgccaaagtaatgtctgaatgcaatcaagtaagcactaatgcctgcgagattccactacataagtaccagtttaaagaaaatcaccatccctttatttttggagagttaggttaaacacagtagctcacgcaaaacctctggagattaataggcaatagtcatgaatagaaaggcaggggcatatcctctccaggttaggccacattgcagataaagtgaaatgacgcctgtgtgttgcctctgacattatttcaacatgtttacacaaaagacatctaaatatttccttattatctgtttagcagaatgagttttcatttgattcaattagtgactttaaccaaaaaatttaaatagaagactgcaaaacatatttggaaatcatttatgagcatccttctgagtcaagtacctccttgacttggtagaatgacagtggaactgtttcagaggaatcccacagctgtccaggaaagctttgtctgcactgaggcaagctccatcagggactggaaggatctcccagcctgatgctgtctctgctctggacctcactctccaggtagcctggtgcctgcacagcagttcctgtgaccgccccccacctcaggctggtgcttcagccaaacagctcagcctctacaaagagctttggcattggccgaagaatgagctccatgcaaggccttctctggccttcctttgggagtataggtctatgcttgcagatgtggaaaacatcgctaatattttgccaagtgaatgaagcaaggcccaacctaccacacacagccggactacgtgtttatacaaaataaaacatgcatacacgcagagatgaggcaaacaaactgtgagaatacacgccaaaatattaactgtggttattttttgcaggaggataaaaatactagtattttttcttattttattttgctttaagttctgcgatacatgtgcagaacatgcaggtttgttacataagcatacgtgtgccatggggtttgccgcacctatcaacccgtcatctaggttttaagccccatatacattaggtatttgtcctaatgctctctctccccttgccgccaaccccccaacagacccctgtgtgtgatgttcccctccctgtggccatgtgttctcactgttcagctaccaattatgagtgagaacatgtggtgtttggttttctgttcctgtgttagtttgctgagaatgatggcctgtagcttcatccatgaccctgcaaaagacatgaactcattctttttacagctgcatagtattccatgttgtatatgtgccacattttctttatccagtctatcattgatgggcatttgggatggttctaagtctttgctgtgtaaatagtgctgcaataaacatacatgtgcatgtttcttattttgtttttgcttagctacattttccagtctttgcacaatgatgtatttcctctaacatcattattttttcttctttggaaaaataatagtaggaagccaagttcttaccccagacatttgagggataactatctctggtcataaaatatctagctatttattagatattattggaccatctagttgtactttctggaatggagaagcatggtcaggtgaaaattttatgtaattatattgtccctgagaatctcaatacatttaacaatgcatttgttaaatctcaatacatttagcagaactcattttccacaagcagctgaagagatcacccttcagatgggcatcggaggaagggctgccttgttggggtcaggttgcatgaaaataaagacctcaagacactagtatcacactcagctatgtgagaggctcacactaggacaggcttgggacccaaaatagcccaggtcataaaatagcccagggggacagataagctaagtctcacccctgtatattattagcccatccaggagaatggtgggcagacagcccatactgtttgaattctgtttttccctcctctccttctccccctcctccccatcctccttatcatcctcctcttcttcccttctcttcctccttccttctccgttcaccataagcacaatctttatttctacatcaatccctgtctctgtctctgtctctccatattccatacctactttccctctctccctttcttttgctggagtgtatagttgaatatgtaagtgaaattaccgtgtcttgtcactttgttgaactaggaagacagggctggatttgagtaggttcctcatgatcatctcttctgctttgtagatgatgcactgatactcactattccgcactagtcaaaaccacacaagaaggggacttcctctaacctcttatccaaaacccttttttcttttctttctttctctttttttttttttttttttttttttttgagatggagtttctctcttgtcgcccagactggagtgcagtggcacaatcttggctcactgcaacctctgcctcctaggttcaagtgattcttctgcctcagcctcccgagtagctgggattacaggcacccatcaccacatccagctaattttttatttttagtacagacggtttcaacatgttggccaggctagtctcgaactcctgacctcaggtgatctgcctgcctcagcctcccaaagtgctgggattacaggcatgagccaccacacccagcccagagccctttttcaaagagatgcctaaagatttgaccaccagttaaagtgttagctctcccagggctacttgaatctttagtaggagtgctgactggggaatatttcatggtttggagatagcacaagggcgttgtggaaaccctacaactagaccatgcaggcagtctcctcatctgtcggcagataactgagcagcatcccatcttctcagcacgttcatcaatgaggagcagtttaactcagtggaggtaggtcccttccaatgcagaattccttggcaccccatcggctgaggctgaggggagaatcatcccagactacatggaaggtttaactgtgggtctgtcatccccaggattattggggaccgaatggatagttgcttggtcatgccaaagatagttttctaacattaaaactgctccttcttggagagtcagatcccaaaacactcaagaattctataattatcaatgtcacttttattactaaccagaaattagagacataatttgcagtacactctctgtgtgtcttctctgtgtgtttaagcaagagagaaaataacatacctatagtagaggcagcaatttctgtgtttacttttcgtggttgaatgccatagtagattgaatagtgtcccccaaaattcatgtccacctaggacttcagaatacaacgttgtttggaagtagggtccttgcagatgtgattatggtaagttgaggtcatactaggaggttggccctaaatccaatgactgtgtcttcataggaagaggagggggcacagaggtactgacagacatagaaggaaagccatgtgaagacggaggcagagatcggagttacactgccccaagccaaggaattcctgaggctaccagaggctagaagagtgaaggaaagattcttccctagagttttcgaagaagcgtagccctgagaacaccttgctttcagacttctggcttcctaggaaaataatacaagttcgaagaaaaacctaccatcttcttaattcttgctcttaacaaggatagcagctggtatttattgagaacttgtctgctaggcagtgtgctaagctttctaattgtgttagcatcgtttaatcctcaccacaacctggtgaaatgattgctattactagtgctcctattgtaccaagaaggagatggttgtagtagcctgccccaaggttcacatattagtaagaggcaagactccctttcctttcattttgtagcaactaaaagcatagcctctagtcttaaagctttttgattattgtgattgagtaaaaagaaattagaatattactggatgcagagtttatcataaaaaataggatacaagaattgaacagacactgtttttttttttttgctacatctaggtgtaaggtttattcatttattgactcttattgagcaaacattcattgaacacctaatgtgcccagaagtcttgaatgtatagttgaatctgactacactgaaatttccaaagcattttaatggtttacagatacaaaatcaggcaagtctagaatatatgataggaatacatgtgaattggatatcacccaggctgctgaaaacagttcttcattatgatcctttcaccaagccaagttaagcaagaacttatcatcaagagacacaaagatatctccaaattcactcatctgcactttttttaactataaaaatgttcatgttcatatgccaaaccaggactgcagttgaaaaatacatttctttaatcactctgaaaccattttctgagttagggagttctgttttcttctcaaacattcatttgtttattgcttagaaaaaacttgaagaataaaagtcacaggattactgagtgaccaagatttgaatagtcattcaatcattgcagtgtttccatcatttacagtcacacaaataatgtgccaccctccctgtgttccagctaagtctcctattctccctatgagtattgtgaagttagctaatattttataatctgtattattaagatggtagaagaaattgtttatagcaaattcaagtctcaacctataagatgatgatggaattagatgtcagtttgaatccatctttctcacatacctgttacgtaaccttaggaaaattgtttgtcactgagccttatcttcaggaatacatagtaactacctcttaaggataccttgaaaatcacacagaataatgtgaatgaatttccacatgaaggacctggcacacagcagtccaacagcaaatgtccttttcattcttagcagctctttgctttttggtttgtgtttttgtttttacttaattcatgttgtcctttaatccttccctaatagctttaaatgtcaaatgcctaactggcattatttcggtgatccttgagtattggattgtcatttcggtacttcaggagcagtggcagtgtcctaaaatgtcatttctacttaattttggtcacagtaaaagtattctgaagccctgaagggctgagaagtatgcagagattctggaagatgcaactggaaaccacacccaccatatcggactggttttgtcaatagcgcaagtcttggagcaatgtatccagtcctttcaagaaccaagttgggtcaccttagtaactcctgcatcccttcctgactcaaggcccatcaggagacaagaaagcgctgattagccaggcacactggctcacacctgaatcccagcactctgagaggccaaggtgggaagatcatgtgagcccaggagttcaagaccagcctgggcaacatagtgagaacttgtctctacagaaagacaaaattagccaggtgtggtggcacatacctgcagtcccagctacttgggaggctgagatgggaggattgcttgagctcaggaggtcaaggcttcaatcagccgagattgtgccactgcactttagcctgggcaacagagcaagactgaggaaagaaagacagagggagagagggagagagagggagtgagagagggagagagggagagagagggagagaggcggggtgcgggggagagagagggagggagggaaggagggaaggaaggaaggaaggagagaaagagagaaagagtgagaaagagagagaacaagagagagaagagaaagaaagggaaagaaagaaaagggaggagaaagagggagagaaagaaggaggaggagagaaggaaggaaggagagagagagaagcagagaaagagaagaaaagaaaagaaaggtcccagactcctttttgctccaagagacctcaggctcaagtccacgttatacctctaaggaagagagggttttccacttgcctcctagagaaacatttcttgttggatgtgaggtagtgggtttgccaaaagcggttggaagactgaacaaattctgttccacagctctcagtatgaaacagggaccagaataaatgcatggtctacccttttagagcaggttggagagaaaattaattaatacaaaatatataaacaaatagggagaaaaagaagagaaatgttggaagtatgcatcttagaatttcacccctatgtgaaatcagctaagctgttagtgacaatggccatttttcctcaggtctacctatccagtcttaataatcccagcttggaagacactttcacatcagtagggagagaaacttttcacaggcttctttttcattttcagttggaacaggaggtttgacagatttggaagaaggcccaaaggaacaagaatagaaccctttttttttcttttcttcttagagaattattcaagtagagaaaatatcccttctctcttaatgtatttcttaaatcttcagaccttaggatgcaatttaaaagtatcatggtaactgtgatggttaattttaagtgtcaacttgactggtgttccatagggagcaggtctatgcaagcctacctccaaaggccaagggagctgagaggccaaagaaacagtctgacaaagccagtttctcagaagaaaaaaaaaacaaattgaatagggacttaccaacagaagttgcgtctctggtatctacaagatgagatggtggattcctttacctcctcagacccagggcctatataccatagagaaagggtctacatgcttcagaagcaagttaccctagagcagaatttgcagtaaacagtagataaggtggaaaacttagtggcattctgcaactgggttattcagaagccagcatggtgcattagcatccaagaaggaggtgctttagcccctacacctagaaatctgtaaagcattactttgaggtgggtctgtgaggctgtttccagagaacattagcatgtgggtctgagtggatgaggtggggaagagctaccctcaatgtgggaaggcattatcctgtctgctaggggctgcagagaacaaaaacagagaaaaggtggtagtgtctatctatctactagagatgagatatactgttttggggcaactccaggctccctagcctttgggctccagaacttataccagattctcatgcttttgagcttgggctaagagttacaccattggcttcttttgttctgaggcctttggacttggacggagccacaccactggtaccccagggtctccaccatgtagaggacgtatcatgggacttctcagcctccacaattacatgagccaattcccctaagaaatcccctctcgtatgtctatatctatatagtctgttgattatgtccctctagagagaaccctaataccataacgcatgaaaataatctgattaaaagcttaaaaaataaagagagaaggaagagccaaaaagtcagaaaatatttatggatgaaaatccataagtggacagaagtccacaaatatgtatggaaaaagaaaataattttgacttaattcagaaaagtcaaagctgcagagatagctgccaagtttaagtggctttgttatagaattttgtggtggtaaaataacattccccctagcctgaggttctctttggggtcccagatatttgagaaaacctggccaattaactttcttagagaaagagatttaaaaattcagtgcagaaaaagcaagtcctccgtaaactgttctaaatctaatacaggacaaagtgttcggatttggctttggttgtaggataaataacttttgtttcaagtgtgtgcccttttttttttttttttttttttttttttttttttgagacggagtctcgcactgtcacccaggctggagttcagtggcacaaactcggctcactgcaagctccaactcccgggttcacgccattctcctgcctcagcctcccgagtagctgggactacaggcgcctgccaccacaccaggctaaatttttgtatttttagtagagacggggtttcaccatgttggccaggatggtctcgatctcctgacctcgtgatccgcccgcctcagcctcccaaagtgctgggattacaggcgtgagccaccgcgcctggccaagtgtgtgcccttttctaatccccaccagtgtggggacacagctgaattttttttcctgagtgttttatttgtatatgttgttgagtgtttttatttcctgttcttcagcaatgatcagaactctaaataatgtgaagttcacagaaataacactctttatcttttcccacatattagctccatgacttgagctgaaactctatacatttcttttcttttcttttgtgagccaaaaaggaactggtctgataaattgtcctgagggttttgcttttagattgctcacatgtttggctgccctgcaagcaggtccattcaccaacgtccacgctgcccttgagtactccatcacgtctatgggccatgaagacctgcctctgacatgcaatttcttcactccacaaccatttgcgcgcttatcatttccaacaggcagctctggccttagcaactgggctcattccaggcattccttggctacaggaaatttactttcttaaataatcaagcctgagactataatgctatagcctacccattttatagatcaacctggctttgaactcactcacatatttttacctctattaattccaactggttacaagagtgtttgatttagataaataggcattttatatttttctgtttaaaaccaaatcctgagaaaacaaattatgaagagccagctgctctctctgagccatccttttcttggcattttaaatgtattaccttcattttctcaagaggactgggcacaggatatagtgaaatgtttaacttgactaacaatactttctagctactcttccaagggatatgtttactaaatataaggtggcttttacagtattcaagttctataaggcaaagactctcaattaaattaaattattggcagtacaatttaacattctacattctgtgtgaacgaagtaatttcaagcagtttgatcattaataataattttattccttcctatacactgagcacaagtttagtgaaatacgggaacatgtacagagagcctgctgtgggggaagcagtggattgccagcaaggaaggacaggatgaataagactaggctgggaatgcaatggaggggatagaaccaactgcagcatgcagggaaacaagccagaaggccgagtgagagacccccatggatacccacgctgaaggttctactgggagggctgcctgattcaaagtcttgtccaaggacagcatggcagatagtggtgggttgcacctaattctgagggcgtaatttgggttaagggagaagactctttggaaaacatatatcattaaagcctaaagtctaaagacaaaagttttaaagcatctcaatttttttaaaattgtctttgaaataatacaattgatatttacaagaaatacttatttgctttttttttttttttttttttttgagacaggctttgagctttgttgccctagctggagcgcagtggtgcaatgatggctcactgcatcctcgacctcctgggctcaagtgatcctcccaccttggcccccagagtagctgggactataggcatgtgctaccataccctgctaagtttttaattttttgtagaaacagggtctcactgtgttgcccaggctggtctcaaactcctggcatcagggtatgctcccacctcagcctcccaaagagctgggattacagtcatgagccaccatgcccagcctacttatttgcttttaatattacaaaattgaattgctttagacattaatagtggacaaaatattttaggagttagattagcttaactatttttcaaattatattccaccagccaaaaatatttcatgaggctttgccttctttaatttctaatatgaaaacagtagggaattttttccatttttcaaaaagttattctaataattaatatgattttctcaaaatacacgtctccttgcagttttttcccttactcccacctccagataattttatatgaacctagtggacaccttccccttgagtatttctgccttaaagataactttaaagatacaacttcaaagatagatcaacaaattgatatgtaaaccaggcacggtggctcatgcctgttaattccagcattttgggaggctgaggcaggattgcttgagcccaagagtttgagaccagcttgggttacacagtgagaccccatctctataaaaaaaataaatatctaaaaataaattgacatgtaaataagtttatctttgctttttgttaaaagaggtcttctaaaaacttgcttttatcaactttaacattactaaattttattttagtattctgaagtttagaccttaactaatgcaaatttgcttactttagactagtacaaatgacttatgatttacctgtgccagtagccaatctcactttctgtgcttctccctagggagttgggtcaagtatagcttacagagaaataccaaattctagcccttatgtgaatcatttctcagcaatcctcaaaggcaccaaaatgtcctttcacatcttctatttctttccatcctggatttatgaccagaaacacagacaacactattctaaactaattttgtttaaagaaaggggaaatttgtactttttgagtttatcccaattaaagagggaatcttatattatatagaacagtggaacaagagtaacttgaattccaatttcaacattattaaaaaccaaagtgaacaatcctaactaggcattctgtttctttataaattgcactaattatataaaattcattattcacaaggctgtgaggatcaaatgagctgatggatgtgaaagtgctttgaaaagcattaatgttataaaatgcaaattattattaagtttattaatcattgagtcactgaaagcctctttagtgagaatcctgcaaaatgtaaaccattatctttcaagagctgctaggaaatcctagacagaacttttctatctgtgttgttagtgttgccataaccaacagcaaaacttttccctctcaattgttgacattagtgctcgcccgtctctctgtacagcactgaaatgcgttatccagaagctccgtgctcacaacaatccagcaagactttagacctcagagttatactagttcatgacaggcagtactgtattcatagtcagccaacccttgaatgcatggccctgattaaattcctgtctctgtcatggaattggcatgagtcatttggcctggaacatcattaaagcagcaaacacacttgagattaaataagaatggattctaaaacatcctcttgaggttgttattgagatcgttagcaaatcatgttggttccttgagtatcttatagagtttcaagaaataaaaagcaactgctacattgtagaaagtacatctaaaattttcctcttatcccaagtgattgacagtctctctgcatcctctgccccgttaccaaggatgataactcctgttcagatgaatgagtccagatttttctcaggtctaagccaaatgtaacccaaatatttgaacaagtccattgctagtcactttttagttttcagagatgaataaagctataagtaaaatgctttctaaagctttactattgaagtaatttgatttaaatcccttttaaataggtctattttagcctgttgacttttatatttccttaacaaatgtctcttataaaggaatcttgtaaattcagttaaaaatataaattaagtcatgtaagtcaaattaaagcagtagatcaagttataaattgaaacaagtttataatccctctcctctattaactaagttaaaatgttatcttctgtggcctcatacaacaacctcctgaatcataaaccacctgaggttatgacaaacacttaataacttcttttaaaatatcaaggactattccaaaagacttttatttctgttactataatgaatttatgattactcagactttcagcttttgcgctaacattcaaatgtcattgggttacttattccaacacttcttctattactatagatggttaaaagttcaggaggccccttttgtcacaaaatcaaagtatgtcgtggttgaaaggactatttcattcattcatattcaactgatattttattaaacatttcctgttatgccaggcactgaactaagtgtgttcacatagtttaccttatttaatcatcacaacaacattcaggcattgatatgatcacctttatttacaaaatgaagaaacagagacttctagaggttaagtttatcatccaaaatcacattgctagtaaatggcagattgagattggaatcctaggtccctgactccaagcctagtgttttttccaccatatacactagaatgatgtcctctttataacacactcactggatcagatccaagttgtgttcatggagagcccgggaccacatgaggcagccctcttcctatttgagcatttcagacaactggaaagatttccctcatcctgaaccatcatctctattaaagatggagaatgtctccatgaagaaacagtgggtgtctggctctgggttcaaattcctgtgcctgtaagaactcagaaacacctatgcaccttcaaaatccccaactctgtggagataaggaagagcacctggcctaagtttgacacaaaaggggtatttaatagctgattcattccttactcttctgtttcctttaccaaagtctcaatggcccttaaaactaatatgctgacacacggtcagtggtccaatttgctatggctattctcccaatgccccaggaggccttgaaagatattggccttgcttgttgtccaatgtagaatggtaaattaatgagatccttggataccagataacacagcttgccctgtgtgtcctctttctatcttatcaccctgatgactcagggcaggcctaagtcctaaaagttctgaagaagtttcccttctttctttgccgttctttctgaggccctctctgtgcggttgagcaaggaaacatacacacacacacacacacacacacacacacacacacacaaacagagccaggtgtgagctggacctgtcggtttctaacaataagtcttagataacaagataattctttgtgtttcttagggtgccacccacacaccgtatccatgcttttgtgttaatagcagagacttctctttctgaatatatgaggagaggaataaaacaagggatgtgaccaaataaattcttctgacatgagagaccactttagattgccttattacaaagaagctgatttgcagggtaaacacaggccatgccctgtaagttttcttattgatgaaattcatgctttgaattactgattgatggttgctgaaggatggcaatttctctgttccagtctggagactgcgctacgtaaaacgagcttctgatgatggaaattctaaaatccaaacaaaacatggaaacaattttttaaaactcgacatctatttctatgaggagctaggagggtggatgcaattggtcagctccagctgtttccttgcttttattgcacagttgttacaaagaggaattcagtgtacaactatgagcttccggccgctcaagctactgcattacactacatggccatactctgatcccaacatgagctttttttcctctagccaaaggataatgtaaaaattatgacacaaataaaatatttatcctctaggcatgagtaaaggaattcacaaatcagaacatagcttgcaagcatacaagagtatgcttgagcagtcccctctttttaataaaaatcaaccatatgaataaaaagctgccctgccccaacttcaccccctacccatcacagaccacaccaccaccccaccatccccgcatacatgcgtgcacacacatgcacacacacacacacaaagccacccactaccattgcagcagggaatcactgatttttttaaattaaacttttagagaacccatgagtttagatggaaaaaatcgtgggagagtaggaatagtttaaggaatgtgcttggagaccagccactcttcacccaaaatgatttcctttgaaattcctgacttgttccctttctgtcctgtgacctattgttctattaggccattctattctattacagcatcatttgaatcagtaggagtgggtctgggaggatggtaataccatctctttaatacctcaatgtggacggaattgaaatggccaagtccttacccagaagagctgtcctgaagaaggagcattgagtttgaagggaggagccaggtgtaatttaggagtggggaagacattggacaagctttgaggagatagttaagatgacttccatgaaaacagagagctgaagcctgttagtaacagactggaaggaagaaagatactcctttctttgctgatcttgcctaaagccagcaggtctgcactggcaaaaagagaggaaactgtctttctctcccctctggcagtttctcttctactaagatccagaatccaagctaatggcattagtgctataatttggtttcactactaaataatctttagttattgatccatgttagaattttgtactattggaaaatgtattctgagttcctaaaatcaatttatattattataatgtatgtaccgtactatcattatgtacatagtattagcatatatagcatttcattcccttgaaaccacttggtcttcatacccatcacttaaaaatactgcttcatattattccacccagtgggtttaccaaaatttatttaacctaaatatttcacaatagggaaatggcaatttcaatttctgttcttaaaattgtttccaatttttttattgtaaataatactgcagtaaatgatttttgcaagtggcatttcaatattttacattatttattgaggatggattgccagatatggagaggtagagttagaggatgtaaaatgcttaggcttttcacgtacaaagctagtaagattttctaaacacagtgccaaagtacatgcagtatacactgagaatgccttgttctctgaacactaccagcaatgtttttcttttttttatttttatgaagataataagctaaaatggtaacctatttgcctttacttcctccaaaatccctagaaaaggatttcaaaatttttttgaaggtaagagtcaatctaaacaaagaggacaggagaggacagcaacatttagaaagacggcaagcaaatggaggaataacacacttagtagacaaagggaggccaacccctaagctggttgagggagaagctcaagagcaggcaattataaaagggcagttccttttataaggaaccgactcctgcaattactgccttaactcattcatgaaggtggaaccctctgggtcaggctctggtgagggccctcttctgggtggcagaagctcaagggcatggctcctcttctctttgcccttctgccatgggatgatacaacaagagggctctcacaagacgacatcccctcgatcttgaactttccagtctccagaaccacagccaagacatttctgttcattgtaaattatctgcggtattctattatagcagcacaaaatggactgagacaggctgctatagcggactgccatagcagtctctgttgcactagaaggctcagaaatgggtagcccctggcacctcagaaagatagacttaaaaacggaaggatcagctaaaaatttctatatgaagacaatcttctcctcactcttgcagctgggtaactgccccagagccaaataaggcagaagacccaagatttagtgtctggaggggcttcttttatctcttgaagatttggaagattgtgttttccaaggacggctgccacaaaagctctcctgacacctgtgcttccagagccaagtgactgctccatcaagacgtgatatctagttttcctctccaagaatctggacagccttgggacttgcttaagccaacagaatgtggcagaaattatgctgcctgacttccaaagctaggttatagagccaaggtgacacgtgccttggggactgggccatgcacattggagtactgattgcccaggaaagcagtcaactgccctgaggccaccatgctcaaggaactgcactaggttacgtggatcggacacatgaaaaagctttgagatgacctaaggaggtagagagaggccaaatttctgattcacagaaaccattagagataatgaaataattgttgttgttttaaaccagcaagtttggggagcaatctgttaggtagcaataaggactggaacagagaagatgaataatagttttttggttttccaaaagaacttactctccaagtattatctttgtttttgctaaatcctttgtattagtctaggctcttagagcgacagaatcaagaggagatatgtacctatatctgtatctctatatatgaaaggagatttatttggggaattggcacatgcaattatggcagaagtcccacaatcggccgtctgcaacctggagaaccagggaagccagcagcatggctcagtccaagtcttaaggccacagaactagggaagccgatggtgtagctctcagtgggaggctggagccctcagacaccgggcggccactggtacaagttctgtagtacaaatactggagaacccagagttctgatgccaagggcaggagatgtcccagccctaggggaaagacagagagagagagagagagagagagagagcaaaaaaagaaaaatagaagaaaaaacatgcattcaaatcattttgtaactcctaattattaggacgataataaaagaagattccagattccagacctagagagcaaccagtacagactgaacaaggaagatgaagagctccatggggactatctttgtctttagtctctttgggctgtgctaaggattgaatgtgtcccccaaaaagcatgcactagaaatgtaatcttcaatgcagaagtgttgggaggtgaggcctaatgggagatgtttaggtcgtgaggactccaccctcatgaatggattaatgctgtaattgcaggagtcaattccttataaaagaacaagtctggtccccttttgtgcactcttgctctctctctctctctctccctctcctctttcctctgtcttctccctctctctgtgtcctcttctctttgtccttctgccatgggatgttcaacaagaaggctctcacaagatgccatcctcttgatcttgagcttcccagctagcttccagaaccatagtcatatatttctgttcattatacattatctgcagtattctgtgatagcagcgccaaatagactgggacaggttgctatagcatactgccatagactgggtggcttccaaaacaaacattgatttctcacatttctagaggctggcagtctgagatcagtgttccagcatggtcaggtgctggtgagggccctcttctggattgcaggctgctgacttactgttgtttcttcatatggcagaaggagagttcagagagctctctgggtctcttttataaggggactaaacccattcacaggggctccaccctcatgtcttaatcactttccaaggcctcacctcctcctaccatcaagttaggggttaggatttcaacatgtgagttttgatgggagacaaaaacatctggtccataacagtcaagaaaaatataaaacagtttacttctgtttccttccagtggtgagataagggatgagttagtgatgagtgtgcagaaaacaaggcaaatgaagaaacaaaagattgcactggaatgtaaatgcaagtgttttacaacatatatgatcaagaacaatgcaagcttgttacttagaaatatgaagttgatgccaaaaataagatggcttctgaggagtgggaagtggggaggtggagtggagacttccgttaatgtgtttcagggcttacagaagcacttgagtcctttcttaaaaatgtgtaaatttatggcgtacaagggtaattttgttgcatgcatggattacatagtggtgaagtcagagcttctaaggtctccatcactcaaacaaaatacattaaataaactctcgtcatccacccctacacccttctgagtctccacactctatgtccatgtggacccattgtttagctcgcacttataaatgagaatatgcagtatttgtctgtctcggtctgacttgtttaacttaaagtccttagactatgtatgtcacaacattcataaaaactgatcaacttaaataccacattaaaatgattacagaaaaacgcaagcaaaaatataataaagtaattttttcccctccctcaaagccaactgataacgaaaagaaagaaatggatgaccaaaaaaaaaaacaaaaaacaaaaaaactctccatgcagtgagccgagatcacgccattgcactccagcctgggctacaagagcaaaactccgtctcaaaaaataaaaaacctccaataaaatatggcaatgctcattgccacaaaccacaaattaggaaggatacgtgacacatgccaactactttgaaatttgcatcagaatgagagaggaggcagttaattcatgttttcttaacttcactcaaagttcagcaattcctttagctctatttcagtttcttcatcctattgctttcttatgaaatatgactttatttttttcctataaaagtagcagaaatgattgaaagttctttgcattttttggcggtgtttgaatttttaataagggccacatgtgtctttctaaaaattaacctattctctttttaaaaattaacaaataaaaacttgttctctttttaaaaattaacttatttgttctctttttaaaaaatgaagatttttttcctcaaaatgaatatacttttgaggtaagaggattttcacctagtattctaaaatcacaaaaacaagtttattatttttattttattgcaaatatttttcctacatggttattttcagatcaaataataggattttggaaataccagcctgaccatactgcacagattgagaggttaggtactaaattataggcttttagagggaggtaaagatattagagtccatctccactccactccccacagataagggccaaggccaacctagccattaggtggggtggacacaacccacgttttgaggggcccacacatatatgttaaaatttctttagaaatcagaagaatacaaatgaacttcggggtcaaagaaaatattttaatatttaacattaatacattttctcttgaggccaacattgtcatgaaatacacattttcataatttttttttgtggaagaaagggaccacaagggcaagtgtgcctggggcccatgaaagtcataatgtggccctgatgaggattctgggacctaaaaagattcctgtaattggtggtggcagagtctggaccaaagctcagggcctctaactcctcctctatggtgctttctgccatgctgttctctggcttgggtattccacacactccatggtccagcccacactccttatctgaccttacctctggccatcagtcatagttcatcttctgctccagttaggtaggcccagcctcatttcctgtaattcatcacaaacactctccatcccagctccatggagcctcccattgttcctagtccactgctgttcattcccagcactggctctcactcctcccactctccccatgtggagaatccttcccgtttccttctgcttgttcaagaggatcctcatctctggagactttgtcttaacactgcctttttttttttttaactgaaacagggtcttgctctgtcgcccaggctgcagtgcagtggcgcaatcagggccaactgcagccttgacttcctgggctcagatgatcctcctgcctcagcctctcaagcagctgggattacaggtgcatgccaccatgcctggctagtgtgtgtgtgtgtgtgtgtgtgtgtgtacatatttttttttgtagagacggggtttcaccatatggcccaggctggtctcaaagttctgggttcaagcaatccacctgctttggtccccaaagtgttgagattacaggcatgacccaacactcctggcctctttcaagtacctttaaagactcctccagccttgagtgatctaccctatgtataaaagcatttgccatttagtaacaaattatcttttcttattcatatttgtcttatatgtcttagttttctttccccaattatcttgtcaggtccttaagctcagaagcgatattagtcaaggttccccagagaaaaagaaccagtaggataagtataatatagataagagggaatttattattggaagtgacttatgcaattatggaggccaagacagtctatgatatgccatctgtgagctggaggcccaggaaagcccatggtgtaattcagtctgagtctgaaggcctgggaacagggagccagtgtgtaacctccagtccaagacgagaggcctaagaactgaaggaagtggggtgggcggagtcccagggcatgagaagaaggatgtcccagctcaagaaaaaaaagagacaacttacccttccttcacctttttgttccatctggcccctcaatggattggatggtgcccacccttattggtgagggcagatctactatactcagcctactggattgaatactaatttatggcaacaccctcacagacacaccccaaaattatgttttaccagttatctgggcacccttagcccagtcaagatgacacatgatattaaccatcacagaagccatgtctcatatactcactgagcatatatatgatcagcactcagtcaacacccaaatgattgtcagaaatctctcacaactccccctacaataatagggtcaagtgctacctcttctgggtgtcagaaataggcttggctttcctttctctttcttgtatttgtaccctctgtgatgaaagtcacgctgtctgattgcacattccttctgggcaagggctgatgtcttctcattatgtattgtcagtctccagcacagtctgtgctacaaagtaggtgtttggtaagtatttgatgaatgagcattttctagaaccaacttttaaattgaatttcttggtcctggagatgtttatttttcatgtgagttttccatctctgaaaaaaataggaaaagaaaagacaaggaaatgagaaagcaacttgaaaacaggaaaatattggtgaaagttattttcacagaagtcttagttgacctttctctgtagcattaaattccttccctgtagtattaaattcacaacctaagctatagctagctttccaaactagacaagcatcccacttaagcacaattgatctcatttcagtttgtgtctttgggcaatgaaataccgcaaagactttttctacctatgctttgatgctttttaaaaagtattttctaaatatttttaaaatgtttgaaatacacaatgataggataactccaaagctgtcatatttgtcaaataattcaagtcagaatttaatatatcctataactgagactcttttataaaattgagacaggcacctgaagaccatttttatttctgtattttcttggtgtcccaagcaaccccctttagagaaatcactaatatttcctgagcaattgaaccacaataaagaccgtggaaagaaaaaaaatgggtctgctcagacattcagagcacgcatccttacaaatgcattctactgacctgcaaaatgttagtgggaatttataaatgcctacaaaaagaatatccaagtcaacatttgacctgtcaaatctaatcagtttggttttgatcattgtaccgggttgctattcgcaaacactaattgaaagcaaaaacacaaacagcatttttaaagagtttctaggagaatatcccatttgcacacacgtcagattaattttccccagagttgagcaatttcaggatcaattgattactgatcccaaggaacaatcaaaaaagaaattccctgaaaaatttttttgactgtcaagactcagcatgggaaactatgccatgaaaatgcagtttgaatagcttgtcttttaatcccaagtgaaataaatcaatcatctattagacttttctagttccttgtgtagtcagggatagaagagttcgctgcagcaggattcggaggaactggggggatctgggtccaggaactcgtctgatcactagaatggggcagggagtgagcagaggagtttgcagcacacagtagaggaagctggtaggcacagaatagtaactggcaggcttacagctgggaccagaggggtccagcaatgataacagctcccggcactttctaagtgtattaattaactcatttattcacacaagaatccaataagggagatagttttaatagacccattttactaacatgaaaactgaggcattgataaattaagtagcttgctcaaagtgacccatctctttggcagagcaaggatttgaacatagacaattttgctctaacacctgtgcccttaaccactgacttgtaactgttccagggagaagatgagcctcttttgggcagcagggcagtggacagccactgaaaatgtgagagctggcaatattcaaagaggcacattgagatccttccaggaaagtctaactgcttgcaccagggtccaggctcaagggagggattcagggagcagcccctagaagtaagtgctttcacttgctaggcagtgcttccctgactcttaggctgcaaatttctaaaaggaaaaaaaacaatgttaaacacgagtgccagtttatatacctttatatattcagttatacattttgtaaatatattacagaattaatgtacatcataaaatacacacaaagggaaaaaaatcattcctttacatcaacaacctactataaatttacttcaaatagcattcatcagtactagcactagaaatgtgtgtccctgacgaaaaatatgtttttacataatttagatcttttattttgaaatttatcagaaatttcttgattagaacccagttttcctagaattattccctacttgttagattatttatccacatatagatgattccgtgaaaaaatgcaaagcaagacccttgatatattgtgtaatcctgaaactatatattaaaaacaaaatagtcttttagaaagcctgcagcagtaccccaaaataaaggtcacccaagaagaaaaattctccctagaataatgcctttaaatcccggaaacgaaagctcaagtgtttacccgttctttttaacattttcagagcaatacaacagagtcaatgtatgaaataaggcattggagttcagtgtaagctaccaccaatgacagaacatgtccattcagggcaaagatttatttttctgattataccaatgacccacacatacacaaagaaaaattaaattgaattaaaagaaagcatttcagcaatcttgacaggcttgagccctctgacagctcctagaattctatcagccgatcatcatcgtgttgctaaagccagctgcctcttgaaaccaaatttaatggaaagaggaggagctcaacaaagcagcttaaacatctcaccttcaaagctcattgaaaactaggcttcctatcagtcatgtgtcaaaggttcccctcatcctacaccatacagattagttcttcaagttccatttgtgtggtcatcctttgagtttccttgaagctctaaaaaggctaaaaggttatttccatctggagccactggagccttaatccatgtatcttttccctgcgcgaatctcaacatggcggaactggaaagtgagactcccaacttccatgtgaagggaacgatgtcaggcaggctgagaagcctgagggtggctggttccaaagggactgacccaagcctgtagcgagcaaggaggctgcctgctacccagagccaccaccccccatggcagcagatcacagcccctgttctttctcttttgaagcttcaggttagggatgggcaattcatagcaatttgtctttgaggtgataggtttggcaaaggggcatgatccaagaagtaagaaatgtgtgagaagtttcataaaggttgatggcgattgtgaccatgtgacctgtgcaatctttaactcatcgagtatctaatgtagattcttaactgccttgagtgcttttaagggactccttctgtgggggcttcatggggatttttcctaatggttaagctatgtaaatgtcttccacagctcctgtaaaatctcccatgctgaaataactacatccctgctctacagctatgaggattgtgaccgtatgtgtcccagcaagtggtagccaccatcataagctttggaggacactgtgttcttctagatactccctgggccatcttttcagatgtgccctttcagaagtggtcgccctttcagatatgtccttgtcttagcagttggttaaagcttcataggatatttgtattcaaggtgctagttcaaaaacatgaccttgaattcatagctgcgaagctcaactgagagaaaacatatttaggaggatggaatccacgcattgccgtagaaaactccttctcaccctggtggatacaacttttgaaaaatattgatacctgggccccatctagaaattagtctcatgtgggtgctcagagaacatagggaggtcattggggatggagtagaatgagcaaagaagagaagaaaatagggtgagagaaacaatggggtgtggaatggggagaagaggtgcagattagggagggcatggcaggccatggtaagggcttggcttttgcccagagggaggtggagttcatagagggttttgagcaaaggagtaacatgatatgacatatattataaaatgatcactctggctaaattaattccttttgccattgcatccttaaaataaacctaaaaatgcagaaaaactgaaaacaggaaatgattttccaagctgctactcaaatgtctaataacaagaagtgactagaatcctaaatcccagaatggtccacgtattatctccccagattcctgatagagatatgtagaaggcacatttcaagcaggcttatattgttttattctaagagggctgaactgggaatgtgaggtttcaagtccttctttgcttaggtgtatccagaggtaatacccagaaactcaaatttagtggtttgagatagactgtagacatcctgttgttaaaatgattccaatgcccatgtcgaaaacacgtctccaaaggctggaaaaatcaactgacattgacaaatgcttttagttttcctttcttggactctatatagctgtactgtctatacagtaaccacaagctacatgtggaggttgggcacttgaaacggggctagttcaaattgagattgtgctataagcataaaacactcagtagattttaaagacttagcatgaaacaataggtttatgtgttagtcaaggttctccaaagaaattgaaccagtaggatagagagagatacataagagggggtttcttaatggaaattggctcatgttattatagaggccaagaagtcccatcatatcccatctgcaagctggagaaccaggaaagccactggtataattcagtctgagcccaaaggcttcagaaccagggggacaactggtgtgagtcctggagtccaaaggctggagagctagaagcaccaacatctgagggcagaagaagacggatgtcccagcacaagagagggtgaattccccttcttctgcctttttattctttccaggtgctcaatggattgggtgatgcccactgacaattatgatcctctctattcagtcgactgactgagatgctaatctcctccaggaatgccctcatagacacactcagaaatcatgttttatcagccatgtgggcatctctcaggccagccacattgacacacgaaattaaccatcacaatgtaaaatgtctcaataatttttacatagattacatgttgataaaatattagatatactaaattaaatacaacatattattaaaattcatttcacttttttactttttaaatgtggctacaaaagaattaaaattacaaatgtgggtcccattacacttcttttctttctttctctctctttttttttttttaaagacctctgtctcccaggctagagtgcagtggcacaatcatggctcactggagcttcgaactcctgggctcaagcaatcctcccttcctagcctcctgagtagcagggattacaggcatgcaccaccaggcctggctttcacattatatttctactggacaggactgatgtagagcttttcaaagactcctcttacataggaatcatagccctctatgataaccttcaaaatacacctacgatgctaccattctccgcagtaatttttttaaagaaaaatgctaaattgcttttttagatctttcttgtaggcaagatataaatagaaggctttgaaaggcaatacaacatagtagttaatagtaagaacttggtagatgtgtgactgcaggcaggttgtttaccttctctgaatctccattccctcgcctgtagaatttgaataatatgtaccccatggtgttgtgagactaaataacatagtccttaatgctccataaatggtagagcctttgtaattggtgctgaaatttaaagacaatgtggagttatcttggattcaggtgatgagattcaacataagaagcaatgcctcaagtccttgcaccaacagaggtgcagaaattcatcatctccctaatgaatcttgagttttctttatacttctgtcatttgattagaaacaaactctcagcatgtcagatttatattcaaatctcagaataaaaataattacagaagcaaaatgtcatttggaaagggtgtgtttggtggtcagaattgtggttgccacgtgccttcgctaaatatcatgactaaaagggaaagacatgcagatctttgctaggaaggcaagagaaagaagaggtgaataaaaggcttgaagctcttgctactctaatcaaattgttttatttgtgagagttcgctttagcttgctctttatgtttgaacctaagtcttttcacctgtgacctcatcaccatttttctaatattgctcagctcattagccttgaaatttataatttagtttttacaccattttatcctatttcttcccattgccaagcacaaacatttactttgtaaaaaaacgtgactgaatttattaaaccagtttgtcttcaaaagtttcccttttttatagacatgggaagactcaaatagttggtttccctaattctcaggagacaaaccagtgaagctgaagccagttttgtatgcaactaaactttgtgccccgtcctttgggtctccaattagaataaaatcagggatgggcaggcagcgtgcattttaaatcaccatccatggtcactattatttccaaactcaaaggcaccattagaacagggaaacatttgcaggcatttcattacaccttgaactattaaaaaaaataagacattagaaagaagtgattactttaaaactttcacacactatggaacaaaagaaatggcaatacacagggagatattatagtaaacaaattgacgcacacggttgttgttagtgaaggacagtattacaagcagatgaggcaaatgaatgagttgggaagagagtcaatctcacttcctgaagcaggggcccttgagaagcctgtgccttttaggctgtttctttgtaggattggcctgggtgctgaaaatagcatagagccttttgcagaatcctttatttcaaggagttgcggtatttcatatgtggcacggcccctcccttcaatggcctctctcctgccactggaaggtgtttttacagttccccttgtgacaaaggacaggtcagagagcaaacctgtgagcaaatcaggcttggcacgcacatcactaagcaacagatgctttctggaaaaccatttgggagtgtttcagatagtagtatgtgtgtgtatatacaaacatatacataatttctggggaaaaaatacatacatacatgtgtacatccatactttctgaaaatcacacacacgcattttccagaaactcatttgaggttgattttatgtgtacggagacagagaaagccatccatccatatagaaagccttttgcaagtatttttaatttatttcatagaagcctgaatttatttcacacaacaatgaataaatccattcttttgccacagacgtggtgcaaaaagaggggtgtgcttgaagcatctacaaaggggaaaaagctgctgatacagggaaaaaatattaaagtaaaattttagttgtcagctttgtaattgaagctgtctcctcacttgaaaatattgtttccactgaagtagaagacaaagggggatctggcaaatgcccccacgatgttcatttccccagataaattacacacatcgtgtgtgcatgaagatgaccagaggctctcactgtgctggggatacagtccaatcattcattcaaggctctgtgtagtcatacaacaaacgcgtggcctaaatccattctttttcttctttttcctttctcttctcattttttcttttttcctccttcttctgccaaaagacagataaagtataataactttgatgacaacctcattttcaggatctctcgataaatcataatccttcagttgtattttccaaaacctgcagttagccaattacttcttggtttccttgaggtgaatctttgctttttaattatattttatcttcttcaaagaaaccactattgaaaaattatagctaatggtagaaatacatcactaagatgtcttggattttcttttggggaggagaggtgggggaataaaatgaaaaaaatatgtatatggccaaattggtctgtgataccattaattcatgttcattaattcaaacagtgtacattgcatacctactatgtgctaggagttgggttgtactccagaaataaaaagtcaaataaaacgtgtttccctcaaggaaactatgttctccagcatctgcacatgtaaactaccaattccagtttagtatgacaaactctttggaagtattatattttgaatgtatttcatcgagaaatgaatgtgggccaggcaaggtggctcacatctgtaatcccagcacttagggaggctgaggtgggtggatcacctgaggtcaggagttccagaccagcctggccaacaaggtgaaattctgtctctactaaaaatacaaaaattagctggaggtgttggcctgagcctgtaatcccagcttctcaggaggctgaagcacaagaatcgcttgaacccggtaggcagaggttgcagtgagccaaggtcgtgtactccagcctgggtggcccagcgagagtacatctcaaaaaaaagaaaaagaaagaaaagaaaaggaaaaaagaatttctaagtctggttttcatagaaacaagtgcaaaacaagccagaggggtcattgccaaactagaaagaagcccagggccagaatatgcagggttagtggagaagcccagtgctcctgggcctgaccacctcttggactcggtataccatcataaacagcattcagtaaacatcttttttgaagaggcatagtaaagaactacctgctaagagtccagaaaccctgtgaggcctcagataactttagtaggaaataaccaagctcttgagttgcttgaagtagaatcccattagcttctaatgcttcctgtatttgcgccccattcaaggaagcaactctagagaatttctttgaatcctgttacttccatttgatgagtgagactcagctgtgatagtctatctgctttaagactgccgatacgatgtggcatgttctctaaagaaggcagaaggcttgaggacggtttgtgttgattgaagaacatttcagtgatgagttggaatatttagacaaatttcaaggcttaattaatatatgaaataaagtagttgcagagataacgaggaaaaccaaagttataatctatagttcatttaccttccttggtcagggcaaatattacaaaagatatgtactgcttttacaataatcagcaaatgggaatgactttgaatttcagaacacatatgggaatgtcatcaacttcgactttgaaatgtggctttttaaaattaaaatataaatcattctattgttaacaaaagtttatcaaaagtaatagggcttttgtagatttttggtttttcttttctattaagatctttactggtagagaaaaataaaattttattaattcaaagattccattgtgtttttatgtttgtgagtaataatcagtggttcctggtatctcatttcgtttttaattcccaaagcaggagctaataagcaaatcgctttgtgggtttctgtgaaaacagctagagtttgcacaatcgtcgcctagacagagggaggagtgtgggctctgaagttcagcagatttgcatttgactcttgactctgtgattagctgggtgtccttgagtaaactactcctgtaagcctcagttacctcatctgtaaaatagggatgatgacatctgctcaaagcgttgctgttgagtaattaggttaaatgagataaaaagtgcccattggcacctattggaactcagtaggagctcatgtcttcatggtgtgtaaatatgtacctggctcccatccacaagagtcctcgctgaatcaacaaactcacaagtgcctcttttcactagactgagactaaaaccgcgaattaaaatggtgtttgtcctcaagaaccactagggtcaagaattctacatggctcaggcagatcagctgagcacgtgagaaaataaggaatatgcagtctaagtacagagctcagatgaagcaacttgctgcctatcaacagaaagggtggaaacaccctggtgtgtgcaacaggcacaaatcatgtaattcagtaagtctacaaatatgtagttaaagaaacaatataatttctaaaagcagtctcctcgcagcaaactgtgaagttagcagcacagaagcaaactgaggcagagtcactggattggagacaagctgatttgtgaaagctgcttgagtaattgaccaacctctgcacaactatgttgcagtttactaaaccagtataaaggagaaaaaaagcagtagaaattaagagcattcgttaagctgtaagtcctttcattcttttggatatattattctaaatgcatcttataacattttcattaataaactgctgttttaattaatgatgaggtctcagtcaactgaatgacatttctttcaagaagcccacttcatacgcacacaaaagaaccctgaaatttttcactaaaggaaaggccaatgtgatccaactagttgaagaatatactattgcaattaaaaaatcatttaattccattcggctcaactcaatgaacatttattgaatatctgctggaggccaggggctagctgggattagacacagttcttcctttcagaaactcacagtctagagagaagcctggtgcatgaataaggcattcacctttaacctccttatccctgttctgttccttcccttctcttcctggtaaggcacgcttatttgcaaaagactttctacatgaaaaaaatatatatatgcatataggcatatacacacacatgtataaatattcatatataccctcaaagtagtttcccaaaattacttgtgtgtatacaaatattcatgttcatatatatatttttttatagaaatgggactatggtgttgtattaatgttggtttcctgactccaacttgctctcacatggttcaggaattacatataatatatattataatatatttaatatactagatatgtaacattaaaaattattttaattatatataatataatgttaaatataaatatatttaaatttttaatatttatatttaaattttgactaccatttgtattatatctaaatataacatatttaatatgagagagaaaacaaatatagtgaaatgttaaaagttagggaatccagatatggatgatataggagttattcatactatttttacaacttttcaaaattatttcaaggtatattggtcttgtaaaaaattttaaaataagggattcaagaccttcctggcctcaatcctgcctttcttcagcagcacctgcagccgtacatcaccccacatttaataccaagttatgtccaacatcctcccgctgtcgttcctgacgctgactgcacattagactaatctgagaaaatgctgaaatatgccaataggcaggcctctccccagacaatcagatcaggactcctgggagtttgctccagccatggttttttccaaaaacatagcctaggttgggaagcctggaggcctgtttcccaaacaccatgctgctgcattcctcatgccttggtgcctgctgtttccagtacttggagggtccttgtccacctcttcagtactgtagattcctattattttgtcaggatccaactcagatgtcgccttccttagtgaaaccatccaggcatcccacgccccacccacaggtagatcccatccttcccgcctcctgctatttatttctacacactctccttctacaggtttcccacactgttgtaatgctgtgtttgctctgtctcccaacccaccgcaaactccgtttgggaaaagtatatatcatgtttgcttttgtcatcagcatgagcctcacatatagtaggagtctaagaaatgtttactaaattaaatgcaaacaaggttatacttgttggaataaagttataacaaggagctatgggacacttgaggatgtgcactcttacagtgcaggcggcacttgcggaaggagatggagctcacgcagaatcgaagagtgaataaatagctaagtagtcgggcaggagagggaaatgggaacagcccgcctcttaggctggctggagccacgtggagtacgcgaaggagaatggccgctgaggccaagaagggagccagtccagacgatgaaggggaccaagagcgttagtcactctggaagcagagtgagcacctcgcactgcgctggcacacagatgcctctcagtcaagcattttagagaaataatgagtgaattcttttttgctctttttctttacatttggcaggggagtcatgggaccggattgaaactaactttcttcccagaagaatgtatttgcacatactttcccgaaaatgtcagaagatttacaggttttctgaaatgtattcagtgacacttcccccaaaatgatatgccacattctaagaagagggatatattttaggtttaagaaggacatggttagactaggatgtaaggcgggtcactgaaagtctgtgaaggacagattataggaggtaagatgcccattggaggacaccctttaagaagtcatcacagcgtggtggctcacgcttgtaatcccagcactttgggaggccgaggcgggcggatcacgaggtcaggagatcgagaccacggtgaaaccccgtctctactaaaaatacaaaaaaaaattagccgggtgtggtggcgggggcctgtagtcccagctactcagagaggctgaggcaggagaatggcgtgaacccgggaggcggagcttgcagtgagccaagattacgccactgcgctccagcctgggcgacagagcgagactccgtgtcaaaaaaaaaaaaaaaagaggtcatcacaggtgccaaagtgaaacccaagtgcctgaaccagaggcatgacagagctgtgcccaagagagaacagatgcaaaaggttacgaggcaatgcaaacagagagcttagggtgtctctaggctttctgcctttgagtgaccatgcagatgcagtgtcattggtcaaactagaaaattcggggagaggatcagatttgtgggaaaggatgaattccattgtgtgaagcttgagtttgggtttcccatgaaagaacaaggcggagtttccctacagaaagttgcaggttgggagtgatggagatgaggctctcctgatgagtgagtatagagtgtgatggaagaggagcactggagggaaaacctcagtgccccaacattttcaggatacacggaggaaaaagagccaatgccttacagagaagctgaaagaggggaaaggaaaaccaaagagagtttccaaaggctccaagagttgagtaaatcaaataagggcagaagtggtctgttcactttggtaactacgaagttcatgaacacctcagtgacagcaacttcacttcagtgaatggagttcaggccaaaatcaatgattaggaagtgaaaatgaggagatgagaaggtttctagaatttccccagttagattgggaaaatctaactggacctctgaacagcattctaacctattggtcagctcctctttcttgaaaaaccctttttccttggcctcattcagacctcgtgttcaaggggtccccggggtgccctaattacttcctctctgttcttcctttgcaagctcatttccctgtcccagtttgaaaagggtgacttctcagggccctcctgtcttctctcttcacacacttctcccagggaattctatccatgcttgcattgtaaataccatcataaaaatgattttaaaatgaatatttcagcccagacttttttggctctttgacttctatgcttccctgacacaaaggcacctcaaacttgacctgttcaaagctgaactttgttgttgttgaaacagcatctcactctgttgccccagctggagtgcaatggtgccatgatgggtccttgcagccccgacctcctgcactcaaatgatcctcccgcctcagtagctgggactacaggcttgtgccaccacaccggctatttttttcttttcttccttttttttttttttttttagcgacagggtccccctatgttgtccaggccagtcttaaactccagggctcaagcgaccctcctgccttggccttccaaagtgctgggattaccgtgtgagccacagcacccagccaaagctgaactcttgatacctgccatatccccaaccccaccaagattgcctgcctctgtgttcccataatcagaaattgtcaccaccatctatccaaaaatccgagtctgtcttaacactctttccttcacctttttaattcctaaacatcatcagattctgtccactctactactccaaaccatcattatatttattctgtcccattgcatagcctattcaatggtctacctatattccctcttttctctttccaatgcattcaccaaaatgcagccagaatgagctttcaaaactgaaatcagattatgtcacctttgcttaaaacctttcaggagttacccgttgctttctgtgtaaaaaccaaaatcctcagaataccacgacctttctatctagcctcacttcctactatggtctcccctgagggtttgtcatcttggcctccactacgttcatcctcgacattctcttcttcctcagagcctttgcacatgctcttttctcttcctagaatactttccctacccccgttaccagcaaaatctcactggccttcaattattaacttaaatgtaatttacgacctgctaaatctctgtcagctcatagttcacagatggcagttattacatatttgaaagaatggattaaaaagactgagtgctagccagaggaaaatagaggttcagggtaggggggcctttaagatgagaatgatttaaagcccacagcaatgaaatgatttgcctggccaaggtcaaaaagcgagttggtggcaaagccagggctgcaatccacgacttttgattcttggcctccccatgtcccacactaatcctttattatatgtcttagatgaagttagctgtagtgaagccctcatctcatttgctgtccccaaaacattctaacctgttgaccaccatgcacaacaggaatacgtattaacacagtttcaggagcatgacccaggaaattctataatagatgcaaactatcttcctgtttaagaccctagtagagttgttcagtggtgctgctcttaaattccaatccaagaaggccacccggctcccacacagtcaagccatagctgattgatgtgtttacagtaatatacttcacacttgtgtcttgtgggccacacgtgccactcaggataaacttagagatttttctttggcattttttctccattgtacagattcagacacttaaagcttattacatagaaactgacctagaagtgaccgggcctttggagagaatggcaggaaattggttacaatagatatggacccacctggggaaacagaactagcagaggtgaacgttaacccatcccaggtccaatgttgttagtccaaaaagattacagtaagttgaagaaaacatcaaacaaacagaataaaaaattcagcaaggaaattcagagtggtacacttggggagaaaaagcagattttgccaatgtaagaccaggagaaaaactggttgtgtttcagcattgcagtatcttgggagaataacaaaacaagtttaagcagagttgtgccatgcagattgcctggaaggaaccaggcctgcctgatgcagaatcatgatgcatgcagaggatgatgtccaaggtccccgggagcagaactccataaaattcacttaactcttttactaggtgactaattaaaaagcagttaatgagagtgatcattctgggcaatggaattcagccatgaaagtggttaatgacctgaggctgcagctcagttctatgcctcctctagcatggttctggctcccaggagagcctcctagactttagcagaagctgcacagagcttcaagaatccaggatatctgggaagaggtaggagagcgcattgggcgacagaaaggagtaagcaaatattaaagggtttatttacagcagaaggtaaaaagaaagaagctcaccacaatgggagctcaataaatgtggtttgcttgagcgactaccttgctgactgaaggagtggatagagcacgtgcatgaggcagcttgcacagtctgggagacctcgcttctcagctccttatttaatgacatcatgttggtagcttgaagtcggacaaggtggcagtattgacatcatgggaaataggcaaaaactataaatcagaatttttccctccccctcaagccagttgcttaacatctaccaacttaccattgggtcacttcgttgaaatccctgtgggagcagagttccctggggttcttaccttaagaataaacctgaaggcgttttggttttgctttcctattttaattactaatatacagtggcactcttcagtaatcttttattacacaaccagagtggctcagcatttgtgaagtctcctggcaaactcaccatcatttaaaacattgtttctgtggggaagttttccaagttgcaagttactgagtctaaaataaatttttggaaaagagcccatttgcaagttgggagctttcaattctgagtcctgataggaaagttagaaaacaaaaagaatcatgccaattttaaaaatataggttgcaaaatataggttgcaaaatcctaagtgaaaaggcaaaaggaatagaattatttaacttggagaagagaaagatgaagagcaattgaataataggagtgagtgccagctgttgtttgcttttggtttctgttttttgtgggtttttttttttctcccactgtaagcctcggggatttggttaaacaaggagataaatatctttatgttattattctggaatgaataattggtggattttatgtcaaacatctgcaaacttcttttcctcaatcagggataatttacatataacctgtgatgaggaccaagaaatagttaagacaaggttatttgtctacttgaaggttaactgtcaactttgtgaccctgagtccacagatggcataatgtatttcaaaactttgagaaacatgatataattaagcaaatcctttttatatcatagaatatctaaatacagaatttattatttttctatcaaaaatgattataaaacttagactattagcattatctatagtagtattatattgtctatatctgttagtattgtctattactagtatctatattactagtacaaaaccttaaaccaagcattctaaatcaatactttttgataattttacgagggaaatgatgctattttgggcttgttaatttagagttattttcagttattcattcagaagagatgagagaattgctttcttttagaatatcttttagatattgcagtaccctgatttggcattttcttaaagagatgtgaaacaatgaaatggcagctgtaaatctgccacttggagccttagagggcttacatcactcccaggctttgctttaacagttggtttatgatgtggtttcagaataacacttttgaacatggtatatcccttcctgcaaaactgacataaatccataaagcttttaatgatgtctctaaaatacagccaaagtagtctctgaggcatatttttggattgtttatctgaaatctctagattgctgaatctcccttcatgatctgccttggaatggctgtctccagggcagctgataaacgcatcatgtctcacccaggcggggaccactcagcttcgtgccccatcaggtacactaccctgcctcagctttcaccccaagcatctcacacccttgtgcgcataagtatcacctggggacctgcgaaaaatgctgcttctccagaacccctgagctaaattctgggactaggcctggggaccagcattttaacaggctcccaggaaagtggtcacagaaatgatgtgagagtctcagctctacatgctctctgactccagttctggcttcgggatggagtaactggagagaggctgacaggtggaagctgaggttcttgccggtgacacgctgcacctgtcactcaggtgctggggtctctgctgcccagacccttccctccctaggccaggttctgtgctcctcagtcttgaatttcaagcgcctggtatgcgtgtcttctcttgcacatcatcctgcctgccccactgtgattcatttgaatgccccagcctccatctctagcctgcctcccaccctccctccaagtcccaggtccacctcttctcacccccgccagagcctgttctcaggtaatgaccccccacattctctagcagaacctctctctgtggcaaactgaactgctcagtgtgttttctccaggcggcccgccctgcctgcccttcctgactcctcctccctcccctgtcctctgttagacacatttacagaagcctgtcctaggagtgtccatctgccccatcagactctgaactactgagggcaggggtcacctgtgccttgctcacgggatccccaacacccagctgaaatgtggtgggagcctcgggggtctcaagtgaatgactgattcttaaaaagaagcacgtgaagtttgtccaggcggcatgatgcctcagacttcagaccctctcactgccaatacactgtgccttcagctagaaagctagtcttcatctccgccacctacctgtacttggctacccacctctggccctccaggtcccagcttagatgtcttttcccacagcaagtcttccaccacccctgtgttccagggggccctgtgtctacctgatcctgcacttacccctctgcattctaataatctgtttacctgaatcctcctccaggtccggagctccttcagagcaagagttgtcagcacccagcatcgtgcccagggtgcagtcagtgctcaatagatgtttgctgaaagctaactcagcacatttaggtagtgagatggggttctcatcacatagctgctaaataaaccgccataacattcactgtattgtactcacactgttgatgcgtctcctcccacaaccactgctagatggaaatcttctcatgggaagtgattgtattttgttcatcttcacacttcagtaagtcaggcagcaatgagcatggattaagtagctgttcaatcctatgttttccaagaaggatagttttggcatgtggagcaggagaattctttttttatttttatgtatttatttatttttgagatggagtctctctctgcggccaggctggaatgcagtggcggatctcggctcagtacaacctccgcctcccaggttcaagtgattctcctgcctcagcctcccgagtagctaggactacaggcacctaccaccacgcctggctaatttttgtatttttagtagagacggggtttcaccgtgttggccagaatggtctcagtctcctggcctcgtgatccgccagcctcgacctaccaaagtgctgggattacaggcgagagccaccgcgccccgcccaggagaattcttaattgcataagacagccccacacattgcaggacatgctgctgtccttgcccgtgcccactaaatttcattggtatcccaatcattttgacaactaccccacctacacacacagttacaaaagttttgggggtaagaggaccaggaggaaaattgcactgcacatagttgaaaagctatagttaagtcttttccttacaacttggtgagaagcaatggactccgtaacagtgccatggtggattatatgtgtcaacataattaacagaaagaggatctctgaaatataagatatttatctggaaataaagcattgcaatgggaatatgcatgccatagttaactacatgcatattcagggaggtgaagacaaaagtttttaaaggaaaaaaggaggaggattacataattgttttaaaataattatccttggctacaaagatcaataacaagggtgacaccagtccaagtttggacaggcaaattcagggcagttgttcttgtagaaccgtttttttgtgtaaggttgcaatggtgtttgggcaatgttgtgctttttgcagagtctctgtgatagttcttttgatcaggcatttattcatggccttccccagctccatttctcagggctttcttttttttttttttttaacattagtgacttcattttgattctgacaactttcacacatgtgtgtggtgatgtgaggtgggggccaggacatgtcaccctcaatatacaacggtaacctgtctttgtaataatagttcactaatctttcctgagcacttatatattccgggcactaagctgtgtattatatagtttacttaatcctcacaaccacctatgaggtcccattttttagggacgaaattgaggctgagaaagtttcaagacattgacccaagttaacacggctgctacagacaagggcaagatacacccccaggcgtcggacttcgctgctctgtgccgacctctttaacaagaacaaacatcaaaattcccagttggaagactcctattaaaaactgtcctctcccattaattataacgtagagcagttttgcacaatatattctgcatagtgttaatttagtgggatgtcaagtgttgtgagattaacggttgcatgggcgatggagtgtgggaaatgctttcagcaaggcccttgtagaaggccgtgaaacagaaaccgtgaagaccacaggatccctaaggtggcacagcccttcacagtgagtcggagtgatttagaacattgctgagcaaacagcagggagaccggcaacaggagcttgctggccatgaagtgcctaatatccagtaagcactgctcaggctctaggaaaaggctgatgcaggaagggtttctttcttctaatttctcaataataataaaaatagatactatttatggagtactaattactctccacttcatagatgaaataccaaggcctagaaaaatgtgttaagtaacttctcctaaggtcacacagctatttagtggcagagccaaatttgaacccagttctctctaacttcaagacatgtgattgtaaaccctatacacaaagtctctaaggacgtagggcttataaaggctttcctgtatgaatatccaagcaaattcagtctcaaagaggatgcccctatgggttccctgtaccagggatttatttttggcatatctcttcaacctgacaattcgttccttggtctgagtacatgaaatttttttcagggtatgtgaatttttttcttggtatgtgaaatttttttctggtataatgtaagtttcttaaattttactatttttttaattttatagatttctatatgatatggtttggctctgtccccaccctaatttcaaattgtagttcccataatcccctcatgttgtggaagggacctggttggaagtaatttaatcacaggaggaggtctttcttgtgctgttcttatgataatgaataagtctcacaagagctgatggttttataaatgggagttcccctgcacatgtgctctctcttgcctgccgccatgtaagacatgactttgctcctcctttgccttccaccattattgtgaggcctccccagccatatggagctgtgagtccactaaacttctttctctttataaatcacccagtctctggtatgtctttattagcagcgtgggaacagactaatacatcataccctgttacatgctttttttttttttgataagagtatttgtgttgatgcaatagcatctttctccatagaacttactcagatgcccttcctggagccagtgcctgcactccatgaactgctggagaggtcattgtagggtatcggcatcagacctctcctcatttttcaattctctctctcctttataacagatgttggtgcattttttgaagaagggatgtggctacgatataactttcaggcaccagcaacaaatgccagagactccagcagcagagtagacaacgctcccgaccagcagaactcccacccggacctggcacaggaggagatccgcttcagcttcagcaccaccaaggcgccctgcattctcctctacatcagctccttcaccacagacttcttggcagtcctcgtcaaacccactggtaaggacaaggatacccagcctctgccatttaacatttgggcagacagaatgttctagcaagagtctatagattgttcttggtttgttatttattccccataggcttttttaagcaagtcacataacttctttgaaccccatttctctccatgaatatcaggaaaacaacttgccagctgggtgtgttagagcaaggtgttagagtaataatgttggtgaggcatgttgcgttctttacaagaatgctgttgcatgaataagagatatgtttgcatgtgtaatgattattttttctccctactaaataaacacatttggctggacactgtggctcacgcctgtaatcccagcactttgggaggccaaggtgggcggatcacttgagctcaagaatttgagaccagcctggccaatatggcgaaaccccatctctacaaaaaatacaaaaattagctgggtgtgatggcacatgcctgtagtcccagctactcaggaggccaagatgggaggatcacttgagcccaagatgtcaaggcttatagtgagccatgatcgtgccactgcactccaggctgggcaacagagtgagaccctgtctcaaaagaaaaaaaagactaataagaaagactaataaaacataaatacattcactaaatgtgctaaacagagatgggctttgaatgagtaaaattaattttacataaattaattttatcctgatttatgatagtataccagtaggttgttacagaacatctgaactttcaataggagtagaaaatcagaaatgtcttcattcccaatcctctcagaactttaaattcacaaagtgtatccctgtcataaaggttgcttaaagcaggagtttattttaattttttttgaaacagggtcttgctttgttgcccaggcttgagtacagtagcaggatcacagctcacttcagccctaacctctcaggctcaagcgatcctcccacctcagcctcccaagtagccgggatcacaggcacataccaccactcccagctaatttttttaattatttgtagagttgggggtctcacgatgttgccaggcctggtcttgaactcctggactcaagcgatcctcctgccttggccaaagtgctgggatgacaggcatgagccaccatgcccggcccaggggtgtatttttacttgtaatatcctgggccatcttggtcgtcaaacacacattaagccagagaggatctgagtgcacctaaaattggcatcctgaggagaatatgcaaatgggcttgtgacccttcagcagtgacctctgagagacatctaagaagccctggagtgtacaaacttgctgaacttgagaagtccacttcctctctgaaaatgaactcatataccttagaattctaagatcactcttttttttttttttttttttttttggagatggagtctcgctccatcaccaggctggagtgcagtggcgcaatctcggctcactgcaacctccgcccctcgagttcaagcaattctcctgccttaacctcctgagtagctgtgattacaggcctgcaccaccacgcctggctaatttttgtatttttagtagagacagggtttcacatgttggccaagacaatctcaatctcttgacctcgtgatccacctgccttggcctcccaaagtgctgggattactggtgtgaaccactgcgtcagccctaagatcacttttttaatgaataaaaatattttaagagcatgcaggaacaaatctctctaactcacttcccattggagccgaaaatatggagactctctctcccactgcccattgtttcctgcccttcagtgattattccactgttatggcatcttaaagagcaagaattttggctgggcactgtggctcatgcctgtaatcccagcactatggaaggctgaggcaggaggattgcttgagaccagtagttcaagattagcctaggcgacatagcaagacaccatttctaccaaaaataatttaaaaattaactgggcatgaaggtgcacacttgtggtctcagctgctcaaaaggctgaggcaggatgattgcttgaggccagtagttcaagactagcctgggcaacatagcaagactccatctctaccaaaaataattttaaaattaactgggcatggtgaggcacacctgtggtcctagctactagaaggctgaggggggaggatcgctggagcccagaagttgctggagcccagaagtgcaaggctgcagtgagctatgatcacgccactgtactccagcctgtataacagagcaagaccctgtctctaaaataaaataatttaaaaaaaaagaaaaaaggagatcaagatttttcccatgggagctagaactgttattactaacttaattcagcttgagttttaaaaaaacagtaaattaaactccctctctaggaaatgcactgttgcttaaaaagatggaggaaaaagtatgttccctagtattttccccttctgaaattattcctaaagaaataagccaaaagtcaaagattcatcatgaagatgttcatcataatgtttcgttttgttttttgagacggagtctcgctctgtcgcccaggccggagtgcagtggcatgatctcggctcactgcaagctctgccttccaggttcacaccattctcctgcctcagcctcccgagtagctgggactacaggcgcctgccacaacgcccggctaattttttgtaattttagtagagatggggtttcaccgtgttagccaggatgatctcaatctcctgacctcgtgatccgcccgcctcggccttccaaagtgctgggattacaggcgtgagccatcgtgcctggccaacatcataatgttaactatgaaaataaaaattgaaaagaatctgaaagttcaacttttagtaaaatagtaaaagagggagttgccattttatggaatattatgtatctattaaaatatttatgaatcgtgattaatgatatggggaaattttatgtatgttaaaccaaaaaaacatgaacaagatccagccttgaatgtgaaatattagctccataaaaaatatagggatagaaaaaaaaaagcaataatgtgaacacaaaagtgtttggttggattgtggatgatttttttttctcctgagcagtacttttgtatgcatgtcaaatgctttaatcagaaagatgaaaacagtaagtaaaatcagaaagtgaggatgaaagagagagaagtatggagcccctggtcttcaggagttcatcagtttatttctcctggatcagggtcaataggtttttttgacccactgatgttcactacccacatggaccagcctcccactgggcagataagaaccttgggtttcttctcaggtccctccccaggaggagggctctcacccagagactgtcaagaagttggtgaacacattcccacacatacttttattgtctgctcctcgagtcactgccacactagatttggtcctcaactgtattcgctacctcacatgcccactgctacacacccaccgctgctgtgccttcatcacctgccactgctgtgccctcatgcctgtgtgaggactttcattgtcttcaagggcgttgatcaatggattctgtattaatggccaccatttaatgaagctcactttgtgcccaaagccatcctgaatggtgccatgcattaattcccatgagctgcacaactctatgaagtagatactattattatttcctttctactgatggcaacacatgagtgcatggaggttgagtgccttgcacactcagaggatgttgggccaggctggggtttctcagcctgggtgtccgattccagacccaaagctccccaccggctgtactctccagggcaggcatctctggaactctcagtgttcttggaaggcaaagctgggtgggttctgtctcactgttacaagactatcctcaaactgctggtgaaaattcagctttttcagacttcaaatacaacatgtttttattatttgaagtttaaagttagaaaaaaaaggaaatcattaggaaaaaacatcagtaaggtctacgccaaagtatcaggaaaaagctactagaaagtctccactaaacaccctggcatcactcacatttcacatatcgaaagctctgctcactgtcctccagaaccagctgcccccagcaccaccactgcccatcagacacttgtgttcccaaggtcagtgtcactcaccagtgctccgttcttccctgcttttgtgggtcacccaggcaaacaagtcctgtgaattgaactcatggtgtccttttcctccccaccactactctctgaggcaaatatcttttaattcccagtagtgtttacgtcatggtgtccatagaaaattattatatttgaatggtaccagggtaaatggatgaggtcatgttttggaggccacctgcccagtgactccagctgccatccccttcttcatgtctgccacggtgtgaggggagccttgctcctggtaccccatcacccatctgtaggacagccgtgggcttcagcttgttggctgggaaattctctcccaatccatctctctgcttccagattctccccctcaccctttttcaccacagccagcaccgcctgcctttatagggtgtcttattttctgttgcttgtaacagaatacgtgaaactgggtaatttataaagaaaaggaatttatttcttatagttatggaggctaagaagtctgaggccaaagggccaaacctggtgagggccttattactggtgggaactctctgcagttctgagacagtgcagggcatgacatggcgaggttaagctgccagctcaggcctctcttcctcttcttatagacagtcccactcccatgagaacctgttaatccattaacccattaatccatgaatctatgaatggatcattccatgaatcgatgaatggatcattccatgaatcgatgaatggatcattccatgaatctatgaatggatcattccattcatgaggacagagtcctcatgatccaatcacctcttaaagggctcacctctcaatatacccatattagggattaagtttcaacctgagttttggaggggatattcacaccatagcatagggatattgcttaaaagggatcttgtataatgtctttattaaacactcagtggtgccccactccagcaaaaccaggagagactcctcagtgccacaaacttttaagtttgagacccaccaagctcatgggtgagatggtggcctgtagagctggaccgtctgggtttgaggtcggctttgccttttgtcagttgtcttgggcaatcagttggcagctccatgcctctgtttgctcatccataaaatagtgtctccctcacaggagtgttgtgaaactcaaatgacaatatgcatgtgtcaacagttattatttcccaggtccacggattcaatctacattctaacgcatattcagcaacccctactcttcgttttgagaaactcattacccctcaagcactctgtggtcatatgtgcacctgactttatgcctgcaatactcccttacctagaaatgccccaacttcctctctagccagacacctgcctttcattctaggctgagatcaagtcccacctccttttgatgacttctccttgctttaaactcctattccacttactttcaatgtcatttgtttggcatttaatgtactgtattgttatctgtctctgtgataaatatgccctgtcttcccagagagatgaaaagctcccagcactacatctcctgcctacgatcagtaccctgtaagtgtgtgctgatgataatgatgatgaccaggagagaataaatctgttaagcatgttatttgctgcatccaataaaagagaagtcccttataactgctttaattcacttgggagatgaacatgagacacagaagtgaagcacctcagcatttgaataatgttttattttaatggacaaatactagcattcttcctaccatcatttagcggtcctcttctgctgttatctgaaaggaataaatacatcatttaaattggattattcaagaatatcaccattactgtttatagatagtcactatatataaatttaaagttccaactcatctttctttctcaaagccaataatttctgctgccattaagtgaagcagttataggaatttaaaatcatatttacaaagtccaagaaggacagaaaagaaaaaaaagagaaaacaatgctgattttaatagagctgaggaacataaaggggccagtgacaaagtgacagcagagaggaaaatgtccagcgttttgcataattgccggttcctccgacctctaggcctctgtgtgtttgtatcctcagagccacacacatattgcctgacccatgccaggggatgggcatggctgtatgtgttataagtggactctacacttgtaaccaggcagaaagcctattttcagacctttaaaaaaaaaaagctgtgctttgcacaggaactaaatatatgtgttctgaagaaatgaataagagatgaatcaaggcagctgtatatttaagaaaactggctgggatgatatgatgtcagagcaccagaaataaggcagagagtaaaaacctaagacaatcaacgtgttttttctgcgtgttgccaaacaactgcctgatcatctccgtcattcccaaacaatggactattttaatgctattgggtaaaggaaaaaccgagtaaacactgaggggtggagagagaagcagctcaagaagtaggagcagcatattcaaaggccctgaggtaggaggagatcgtattttctagggaataagagaagttcgtggtagtttgaatgtaaaaagtgacagtgagtggtatgacttgaaaataaagtagcaggaggaatgcacatcagacagggcattgcaaccgctatttggaaagtacatctttattctgtaaagaattggaaggctttgaaggattttaaatgacccaataaaataatcagttacacattttgaaaacatggggaagaagacggtacagaagcagggagactgtattcatctgttctcacgctgctatgaagaaatacctgagactgggcaatttataaacgaaagattttcattgactcgcagttccgcatggctggggaggcctcaggaaacttacagtaatggtggaaggggaagcaagcacgtccttcttcacatggcggcaggagggagaagtgcagagcaaaggagggaaaggccccttataaaaccatccgatctcatcacaactcagtcactatcatgagaacagcacagaggtaaccaccctcatgattcagttacctcccactgggtccctcccatggcacatggggattatgggaactacaatttaagatgacatttggatagggacacagccaaaccatatcagagaccattcagtcatttattcaacaaatatttattccactcctactgtgcatcaggcactattctagacattgggaatagtcataaagaatagaaacaaaaattcttgctctcatggagcttatctttgaataggagaagacagacaataaacaaattggtacaatctatagtatgttgtgtgctaagaactgttatggggaaaatatgaggcagaaaagggagggcctggccaaggggaaggagagggtaaattccacttttaatgaggaagtcacagaaatgatcactgagaagaggacatgagagcaaagacctgaaggagtgagggcatagccatgcagagacctggggaatgagcatcctgaacagaagaaccggtgactgcaaaggcccttgggtaggaacaggaagccaatgtggatggtgaggagtgagcaaggaggagagtaacaggaggttaggtcagcaataatgaggagatcatatggggcctggtgagccattgcaagaagtttgatttttactctgagacggggagttactgggattttgagcagaggatcactctgaccaccgtgtggtgaggacactgtgtatctcagggtcagaggcccagtgggatcagggaaggttggagaaaggacaaaagctagtataatcccagcaaaagacactggtggcttggtccagggggtagagatggagatggcgacaagtggtaagattcagggcatattttgaagatcaagccaagaagacttggtgtcagatgacacatgtcatataggagaaagaggacagtcaaggcttttggcaagaataactggaaggatgaattggcaattcactgaaatgtggaaaactgcaatggaatacttttggggagagaagatggatgttctgttgcatatgttatgtttggggttgccagtaagatatctgagggaaaatatcaagtagacagtttgtgaaagagtctcctcaatgccactgtgtctcctcaaatgaatgtgctgaaaagttatttaactcactcttagtaagaaactactcctagaatttattcattaattttcaaatgataatttcacacttcttgactggaatatcattttgaagattgctgataagtacaggtgtttctgtagcttattaataaaaatatgctattattaaaaaaaaagagtctggagttcaagagagaagtctgactagggtatgaatgtggtgtctgatgggcatacaccttattcaaaggtcctacataggataggattgttggagtaggtaggtagacacacgagcagggcagaagagggtgccccctcccaccaaccaccaagaatgtcagacaaccatcaggtgatggtcaggcagttgctaaactgtctctctctaaaatgataattggctgcagctggcaccaaggaacgaccgtctcccaatagatagaaaacatctggagctggtgatcagcagcttcccaatcagatctcaggagttgggcaagcgggcccaagcatgcacactaagaggcaaaatgatggagtttaacgggtatatgaccttcctctaggaacactcaactggaaaggggaaaaaaaatgcctcaaatgagcatgcgcactacttcagtaaacacctgtgcatgcagcccctcccacgtgctcgcaggccactgcgcatgcagacagcccgccccaagggaagaatcaggggagaagaaaccaaaccccagaactatgccaatgtataaaaccccaaatcaagggccaaacagggcacttggatctctcaagtcgcccgcttggccctcttccaagtgcacttcctttctaaaactttttaataaactttcactcctgctctactaaaacttgccgcagtctctccctctgccttaaacctacttctgcccctcaagccgcattctttcctctgaggaggcaaggatcaagtttgctgcagaccctttgggattttccttcagtaacaggatcaccatggaaacaggcctgaatacaaaagagaatatgcttcagggctggtctttggggactgcaagagtaaggtgccccaaaacgaggggaaaaacaggtagagaaggaaaaccgaaagagtgtgtgctggaagccaagtgttcccgggaggtgaatgaattctgtgccgagtgaagatgaggcctgagagggacaattgcctctacttccccaagggtcacgggcccagcaagagaccgtggagcagggaagacagaagtgagacagagggctcatgctaaaatagggacgggtttggaggcagcaagtgtacccatctcttttcatggggttcggagcaaagaaaagcaaaggataagaggcctcacttgagagtgaaatgaggtcaagagcagtaatttttaaagaggaggctgactaagacccaccatcttctgcaatccaggcagaagatggtgcaggtaaagcacaggtgaggatgaaccaggagctctgtgtggagctgcctcagccagggagcaggctccctctggaattcacacaaggacactgtgggtgccaacagaaagcctgtggttaccgaagtggaaaagagtgagggaatttagatagatttaggagacgaaaatccaatccacggtgcttagttgaaatgccaggggcaaaggagtctaggatgacattctaaggtaaaactcagaaatagtgaaggtttgttgaatttcgtttagaaaacaaatataggaaatgtaattagctcttgattattctaacaaatgttcctttgaaatccaggaacatggcaagtgtaatgttaggatgcctaaataaggaagagcacagcgtgtgtgtgtgtgtgtgtgtgtgtgtgtgtgtgtgtgtgtgtgtgtgtgtgaaagtctggaaggagctactcccaagatgtttagaaaaattatctttgggtggtgggatttcaggtgactttcttttattttttttctgtttactttctatgttttaattagcatgttttattttgtaacttaaaatcagaatatcagttttgttcccctaaaaaggaaatgaaaggtgacaaataatccattaggtgatttgcagttggtcaaattcttgctagattgctggctccatttttaagctctgagatatcaacatgaaaattccaatttgagtaacaaatgagataaaatattgatgtctttaaaactcataactaagatataatatttatgcttgcagattaactaaaagcaggatctacattgtcatattagttattttcaatattgttttttattgttgggacgaagcaaggaggaaaaaaagaatatactgttgaggcaaagtgaactatcattgagggcaaaaagggactcaggggaccagggaaagccatctttcctgttgatttgcatttgattagtctgtaagctaaaataaaatttattacttggtctcaatgaggccacccaaaatctcatctttaagaactatgtttggccaggagcgtcggctcacgcctgtaatcccagcactttgggaggctgaggctggcagatgacgaggtccggagatcgagatcatcctggctaatacggtgaaaccccgtctctactaaaaataccaaaaaaaaaattagcccagcgtggtagcgtgcgcctgtagtcccagctactggggatgctgagacaggagaatggcgtgaacccgggaggcggagcttacagtgagccgagatcgcgccactgcactccagcctgggcgacagagcgagactctgtttcaaaaaaaaaaaaaaaactatgtttatttttaatattgtatgctcatgattcttttatatgcccaatgtcacactttgctgacggggtgagaacatccctgcactctgcatttatttttttatttcacatagtgtttcgtgggacctgcagatgtctcctccctgcagtcctatattgtatatgctctcattctttgtgtccaggcataatcccaacttggatcatttaaactatttgcatcttcaactttgagacgacagtcactgaagttcactgtgggcagattgtaaatatgtgcgagcctggtgctgtcagccgatatgggtcagtaggcctctgagctcgtgaatccaaattcaaatattgaatgttatctgtggacatcaagggagggagtaaagtttaacagaaattggatgggcatggtggctcacgcctgtaatcccagcactttgggaggctgaggcgaacggatagcctgaggtcagaatttcgagaccagcctggccagcatggtgaaacccccatcactactgaaaatacaaaaattagccaggcgtggtggcaggtgcctgtaatgccagctactcaggaagctgaggcaggagaatcgcttgaacctgggaggcagaggttgcagtgagccaagatcgcaccattgcactccagcctgggcaagagcaagactccgtcaaaaaaaagaaagaaaagaaaagaaaggaagaaagaaagaatctaagagcaggaattgaggggatgtgacattaaaatgaaatttagggcaaacaaattactgagctttcttttttcttctataggaagcttacagattcgatacaacctgggtggcacccgagagccatacaatattgacgtagaccacaggaacatggccaatggacagccccacagtgtcaacatcacccgccacgagaagaccatctttctcaaggtatacatacatgtacatataaattacatataatatcgcattatagtccctgtccctataatgcttggccattggttttgttttgaggggatagaagtagaagagatgctttttacactttctcctacaagtgcataactagtgaagtagaaatatatataattctgacaaggaaagacaatgatgaagttgaagacatcttttagggggaaatagaataaatgtttattccgtatagtctttctggttttcccagttctagatccacatatctatcaatttactgcttttatccattgcaccatctttcttcgccaagctctcagacatctgaaacttaccgtgtttcccagcaaaggttattttggtttctccgacctacttctttcactgctccaacacaatacaaagagctgtatttttctctctctctctgcagagcctttgtcttaaaaatcctcaaaacagtctttccccagaatctcagactctgactgtgggctttcggcacacaaagggatggttttattatgacactcaaattttacttcaggttcattgacgaccccggccctcaccactgatttttacagtgaagaaaccagcttgggaaacaccatgaataaaacataatgtgaggaggtctccctgggagctaggccaagacatcaaggatgggaactgtcactgcattctctagaaggagttcaaaatagatgcctgtcaggagaaagaacagcaggaggatgctgttttgtcagtaaagtggagtgtcatttggcaggggttcagcagcctctcagacctcattctgattcggctggatgctgtgggaagttcaggttgcaaagaaaaggcacaagccctatctcttttgagcactggtggatgtcagattcataacttgatatggagtttgcgcgtggcctttagcagtaaatgctagagggcattttaaggagaggcctttcctaggaaactgacatgcactgtttcagcttactgcgccatcaatcaaaggtggcataataaggttctctcatcatggtcgacagagtcccagagcccagcacagtacctggcacacattaggggtgacaaattctttatggagtaaaccaagcccatctttaaccaagttttagtcagaaaagccagcaagtccaggagacagatcgttttacatcatttcatcaacattgtctccctcggcttttgattagagactttttccattttaagccacccaatttgtcacctcttttaaagaaagtgacttatcttgccattttaccattgcgaaataatactaaaacttaaaaagacctaaacaatggcttttcagacagtataacagcagagacccaccacagccatagaatcgtatacagtttaccctcactctctgccacagtgaattagagaaagacttgaggaaggggagaggagtggatgatttttaagacttggggctttggaggcacagaaagccagagatatagacagtggagcagccagagacctgcagagaatccaggggatgaatgggtttgggggagggtctggttctattgcccaagactattttggttgcaaatgatagaaaagcaattcagaagtaatttgttggggaaaattcctagggtaggtcatagaattatagaatttgaaaaagataaaaccaaactttgggaagagaatctagggagcctggagaattaaaactgtggactagaataccactaggtttctctctcccttccttccttccctccctctttttcattctcatctctgcctctctctgaagactggattaattacctcttactgcatgctccatctttcacatatcctaggccatagtcacaggagtactgggctcatgtcttcccaattttgttaccggaagaaggggtcctagtttcttgacactcattttaaaatcccagggaatctctgataggcctggtttgagtcacgtgctcaccttgttgggtggaagggggaacaaagacccatagtccctaatcacatctcttgattagagtggggaacttgggaaactccctcaaaagaacagaatgcagttccagaaaaaggaaggagataggacgacaggagtgaaaattttggatgcacgattctgaggtaggagaggagaaaaacctgggaagtgcttcctcgattccgccctaggttctgcacctggaagtgttgggagatccagctctccctccttctctgtcatgtaatgtaactgactgcagtaagatttctgaatgtcccaacccacgtgagggcaactaggaaagatgtcacggcctggggagctccaatctctcagcccagcctgtcccatctaccctgggacctgcccaccactgagggcaaaaagaaagtaaagatagaggtggtggaggaagacaagatgtagttcctccttatggaaaagcagatcccagggcttctcactcccatgccccactttctttcatgcagggaggccttgcagacgtggaagtaattcggaaagtgctttgcaacaccaaataacactgcaattttttcttaaaacaatctaaaaatccatcttgagaacttctacagcctcaactgtgtgtggaaagagatataataaaatgttcacagtgatcatctgtgtgtgaagggattatcaatggtttgatttcctctagagttttctatttccccattttctattataagcacatgctgcatttttataatcaaacagaaatatgaaacagccatatattctcaacctattctggtagtccccagttataataacatatgataacaaaggcatttcaataatttcaaattaatatttatttatttatagtcaaagaacaaaaataaggctaatgcaaagatgaatggtagatcacagtgctgtggaatgatgtctttggaattaaggtgaatgttgatgcatttatacatgctcaaacatataatttagatgatcctcatcagtgtttatggtgtctttaaaagcaggtttactttcgtagctgggtttggctaaagctaacattaaattaatctgcattccctcagcacacaccctgtgaaacagcactgagcacttgagggaaactgaccttggatgaaacatttgctgccaaaagacaaagtacccagtctccacatagataacagggaactgactgtagtagttatcagacaccagcgtgaaccagaacccatggcatacctccagtggcatcatttgtgaaaactcacagtcgcatcagggagaatagcttaaggcttaatgccagtcaaaatataaacaaacaaggtgcagccagagagcacctgaaaaagtctggcatgcagtgaaaaattatgtcaattagcatgaatccaaaagcgaaacattctaatcaacaattccaaagccttgtgcaactaaccctttcttcttcctttccttccttccgtcttgccatccatgtttcttttccttcctattttttcctttctctcttcccaaccacattgcacaagggatctaagggggtttacagggagaatattaaatgaaatagagagttaatggaagtcacaaaaagtaagtccccaagatcgagaaaatagaacatgattatcaggtcacaaggtcttaccacttggataaatttgactgtgaacttctcggcagccagaagtatgcaacccataaggatgaactaagccagttcctcttgagaattgaaccttttgttattatatcatttttattttatttaattccatggattgtatttactgacatagaaaatgcccatagcatactccacttatacaacatcacatacacgataacagctcacatgtattggtgcttactgtgtccaaggcaacgtgctaagcactttagacacattttctcatttagtcatcacaaaaactttatgaagtatgtgccatcattattcccatctgatgtgttttggaatgtgtccctgtccaaatctcatgtcaaattataatccccaatgttgaaggaggagcttggtgggaggtgattggaccatgggggtggatttccccctagatgttcttgtgatagtgagtgagttctcatgaggtctggttgtttaaaagtgtgtagcacctcctgctttgccctcttcctccttctcaggccatgtaagacatgcctgctacccctttgtcttctactatgattgtaagtttcctgaggtctccccagccatgcttcctgtacagcctgtagaactgtgagtcaattaaacctcttttctttataaattacccagtctcaggtagttctttatagcagtgcaagaatggactaatataccatcttagagatgtggaaattaaagttcataaagtaagatgcaacctgcccaaagttagaaagcggtaaatggccacagcatagtcgaacccaggtccgtcatacttcaaagtgtacacaggctcttaaccttgcttaatagacagatgtctggaaggatgttcacaaaattttagaagcagatacctctggctggtaagaaattaagtgatgttactgttattaccataagatagttcaaaatatgcaaaaacacagagaataataaaccatatgctatgtacccaccattgaaacattacaaatttcgacattttgccctatttcttcagatttttttaaacacagcaacaattaagagtctgttgtcctcctggttacatagtgggccccaataaaagtcagagtcaatgccctcagcagcatttctgcaaatgtatttgttacaaggctgttagatgctgaagctccttgggaaagtaaagcttcccattttgaattcagcccaaacaagtctgtagagagtgaggtagagcaggatgatggacagatgaagaggccaaaggctgagatgatgcagctttctgaaattttgaactgatcctaggataaaactagctggaaaatgataatgaataaactacatgttctttgaataattatccatgacaatcacacatttttgggtttagatgtgagttagacaatagagagttcagggatatattctctggcacagatactcggaatccatattctctacaaatcaaatgaacagatggtaaggatgtatcattttggctttcatctaactagagggccatcttatctttgccaagaagaagctaacagattttctgcaagcaaaataaggcctttcttagaaaataattctaggtcctcaggaacaaatgatgattagatccccaagttcttacaccaaaaagaggatgactttgattattttcactgggaattttcaaaacaaatgttcaaaaatatcactgaattctgttctttaaaataatataagcacggtaatttcttacctgctactaatctgaatttcaaccaaattgtataaaaacaattgcatcaattgttaattgaactaggtcctgtatataaatcttaagaactgtcagagaagtgtcaaaaacattagcaacatgtagtgtgctaggtgctagaagtagaagaaaggatacaaatattaggatgatgccagttgctatacaaattagccctcaaatgtccatgttttaacccaataaaagtctgtcttacatcagatatattttcagaaaaggaaagttctctggtctccagcagtgatgaaattgtgctgggcaggcactctgaggacctgccactgccaccaacttccctgcttccccaaccctggattaggccaaattattgtccattattcttgaagccctcctgggctccatcctctgggaggctcttccttgtgtgtgttcagccatggcctcccctgaattatgtgccggataatgtgctccttacagctgtgcagcaattatttttttttttttttttttgagacggagtcttgctctgtcaccaggctggagtgcagcggcacgatcttggctcattgcaacttccacctcccgggttcaagtgaatctcctgtgtcagtctcccaagtagctgggagtacaggcgtgtgccaccacgcccagctaattttttgtaattttagtagagacagggtttcactgtgttagccaggatggtctcgatctcctgacctcgtgatccaccctccttggcctcccaaagtgctggaattacaggtgtgagccaccgcgcctggctacagctgtgcagctttaaggcccatttcctgcaggttcaaattacactaagggttttttacactcataagccttttgtggactagatctgtgctttcttttccaatacaattccctcaaaacccaaggtggcttctgatcaatttgcttctggtaagtttcatgtgctggtaaatgcaccctaagctcttccctagacatcaatcttagacttactcaatcatttgcctccaggcgcccatgcctctctctctcaaggtaatggcagctactttggggccagtggacacaaaaggcttgggtgggaagtaaagacccttaatttaaatgttacccgtgaggctaagtcagtttgctaaacagaaatcttactgccccattgttggtcaaagcggtttgcagtgttatttcttactctctagtgtaaggctctaaatatctagacttttttctattcttttcattgattattgggaactggtcaattctttcctgaactcatctgctccatgacatgaggagcaaaaagcaactgacacacacgaccattctgtctcttttgaagaactttccttaaagctacttaggcatttagtctgccttccaggttatgtgaggtgacagttttacaaaatattttattgcatactatattagtctgtcttgcactgctataaagaaatacctgagactgagtaattcataaagaaaaaaaaggtttagttggctcacagttctgcaggctgtacaagacgcatagcagcttctgcttctggggagacctcaggaagcttagatggcagacagcaaagggaaagtaggcttgtcttacatggcaggagcaggactgagagagagtgaaggtgctacgcactttcaaacaaccagatctcatgagaactcacatattatcaggagaacagcaccaagagggtggtgctaaaccgttcatagagctctgcttccatgatcccatcaactcccaccatgacctcattttggacactgggaattacaactcaacatgagatttgagcagggacacatatccaaaccatatcacataccattcttcctctgtctttcaagtccctaatattcattcctgcaccacctgccaccttaccacaaagccaatgctacatgtgttaggtttctgttatagcagcaccctgccttaagataccaatgtatgtattcgttagggttgtattcgctgctataacaaaaaatcagaggcttaatacaaataactttctttcccacataatagtaaaatgatttctagttggaaatcgtaagcaatatataaataggctgataaaaaaggtgtttgtactaatgtccaaaaataatagagtaaaagacattgtggttctatgctataactataaggctttgaaggaaggataagatgttaacctgtgaatggggggcaagagaggacatggaagaatatttattatggaagagggagaaggagagggaagatgtgtgttccaaaagagaacatgatgttaaacaaagatgctagcagagtgactatttcatagatttcatcctgtctctatctcatgaatagaaaagaccactggagaagactcagtaaaaagtcttacctggagaaattctcactctgaaatatgtaacatcaaatggtctgaagtcatttatgaatattgaatgctgtaaagtcagtagtctgaggcacatgcagagtggtgtcaaaaattgttggaagaattttatcagcagcaaaatgagagtaattcaattatggactcctagggcagcaccaaatgttaattgacgtgaaacattggtggccgggggagccctagttcaccactttctatatgtggaaaagtgtacaattgtaaggactttcacataacctcctcaagcccagagaaaaatctctgtagacttgagagggccttaatgatcatgttaggtagtgctcaaagccctttcttacatatcgaaatgcttgcccacattgccattctcagccttatgaactggaaatagctggtgctattagtcccattatatacatgagaaaacagagattaagaagtcccaggccaggcgcggtggctcacgcctgtaatcccagcacttcgggaggccgaggcgggtggatcatgatgtcaagagatcgagaccatcctgaccaacatggtgaaaccccatctctactaaaaatacaaaaattagctggacatgggggtgcacgcctgtagtcccagctactcagggggctgagacaggagaatcgcttgaacccgggaggcagaggttgcagtgagctgagatcgtgccactgcactccagcctggtgacagagcgaaactccatctcaaaaaaaaagaagtcccaatgatgaataaggtcccagtgctcacaagagacatgatcttctctagaacccagctaaccagaccccgtttccccacttagtttgctctttgttgtctttgcaagtgggcaagagaagcaagctcactcctgttcatttgccttataaacttttgaaattttttaaaaatgtttacgcaaaattaagtcttttgaggatttgtgttttctttggagtcactaaaagcaatgactttatagcgtttcgtagggggtcataaaaccctaatttttataatcaaagagaactacaaggtccaacgttaaggctagtgtttttacagcacacagtatcatacacccataaaaattccatctcattctttaagtaaatatgaacataacctcttgtctgtccattttaggatccttcttttctgtagaaacatggagcccagactgaaattagatactgaagctcaaataaattatttaaaaatgtgtgcctttattacccttgaactttctgccaataaagaacaatactaacaagcatatggatgtaaacactcctaaaaattttactatcagaagttgttcatgcctttattaaggaaaataacacagtttggaagcactaaattttttagggatgtcagaacaaataaagaaagttgacctagctagcctagggcactgctcttgaaattacatttactgtaactccttccctttggctaatttagtttttatctactctggatgataaactcacagcctgggttgtgcaatacaagcatgcttgacagaaggcaggcaattgcaagaataatgatgagccatttgaacactctggcttcttcccttccagaagaacttttacctattatagcactggctctctattgggattcttagcaagtgtattagcacttaactttccactttaatgaacgactgacatgtataattctatggagagcataggccaatattttattagtttctgatagtattacaatggtttgagtctattgaactgatatagaagatctatgggaagagaagagagagggctacatatattgggaagttgcccattaatttggtctgtatatgagtcagaattcattttttcttctatatttctatgtatccagagaagcctgttcatgattgagagacacatcaaaaacctcatgacctcattagcttttgtaatgtcgcctctggttttgggttgagctatggctcctcggcccctgagaaagtatttgagcacgttttcattatttggttcagaaagtagcagtatttgacaaaatgtttctgaaaagaggaaacaagatgcccaactaccagagcctcagattcctctccctcccagtaccttcaaaccagcttgaagttttaaactcaggccacctccacactgagaggtctggccagcccgtatgcaaggacatggttcctaggagtgtggtggaggcgtgtggtgaagatcctgctgaagaagacagaaggttctcaagatgtccaggactcttctgttatcaatgtacttctcttctacttaaagccacatggggtccctaagaatttaacatgatgatatctaattgacattctctcttacccctgcctaccactaaacccaccacatggtgagaaagttccaaacagcaatcgtttctgaagcctgatttggataaaaccagatggtcaccaaaaccattccattaggccatttactgatgtggaatgcaattaaaattgattccactttaatcaaaataactttgaggagaacaaatatgtgctgagtatctacaatataaaagaaatttggatagataatgatgagttggtggaacagtaggtgactcatacagggatgaataaaatgtatcttttacaactcaaggagtttatattctgggaggggagaaaagatgtgtccagtcactaggcattttgtcagataatagaaacctgttccacctacttctcctctagaagacagtttgacaagtctccttatcaacatgtaaataataaaaagggtatccagcaaaagagaatattagcagtttggggtggtgataaggacacagcacgtaacgagatttccccttgaggacaatgtcagtgtaaacagagaccccacggattacaaactgttgaattcagaggttattattaagacataaatttaaaagggtctttattgataggctaccttactatattagggctctctagcaggacagaactaataggatagatgcatatataaaggggagtgtattaaggaatattgactcacacgatcacaagctgagatcccacagtagaccgtctacaagctgaggaccaaggaagccagtcagattcctaaaacctcaaaagtagggaagccaacagtacagccttcagtctgtggtcgaaggtccaagagtaccaaagctgacgaatttggagtccaatgtttgagggcaggaagcatcccagcatgggagaaagatgaaggccagaagatgcagccagtccagtccttccacgttcccctacctgcttttatcctagctgcactggcagctgattagatggtgcccacccagattgagggtgggtctgcctttcccagtctactgactcaaatggtaatctcctctggcaacaccctcacagacacacccaggaacaatactttgcatccttcaattcaaccaagttgacagtcagtattaaccatcacacttacttaatagctctgtgttctctagcaagttaatgaaatctctgttgacttaatttctaaaattggagtaagtccatcttttctaatgcagtttgtgtatgttaaatggaaatacaaaaaaaaatctagcatagtctatgacccaataaaacggtagttttcttccttcattcccaattcccttctctttcttaaaagcaaaaaataaaatagcagatgtcaggatcagtaccaacaggctctttgggactatggtttctttccattgatttgtagttcaacccattaagcatattctcagcacctagtatattcccagcatgcagcatggctgttgcctccatgagcccagtccagtagaagaaagaccatcagtcatacagatatgaaccaagtgcccattgaagtataagcttgtgctgtgggagcacagaaaagtaggggaatgaataatcctgaggaggaaagagtggatcagagcagtctcacaaaggcatttgagctgttccttcaaggtttccatggtggaggggggaggatcacattagcttatttattttttactacagagattcaacatttgcccttcataaaaattatacagaaaatatgttaagaaaataagttctaagccatcaagcccatctgatctgaaacagaaaaagactcataatgaatatgtcaacacttccacatttttcatttgttttctaaagcaatttcatctgcaaatgaattatgcactccagggctagacagtacctccattcctacactccagaaaaatgtgtttacttcgttttacatttcatgcagctcagtgggaaggcagttgcaatgcaatttctgatccagtttagggtttgagatgtcagtcctctctttctttctccagaatacggctaaagcttgtaagaccaaggttgggagttcacttttttttcctccaagtgcattaaatacataaatcacctctcaagaaagaacataaggttcctggatttctattttgtctggcatgaaaactaaagtccaatctgcaaagcatcatactgttatatccatctgcagtgcactaaaatcactctcaaagattgtaactcttggagcaaatttttagcacaatgggcagagcgggttgtttcttgcccaggtaactgaagcaggttcttatctcacctaaattcatcttctgtctgaaaagtaagtgtatctcaacatgcggtttgaggttctgaagggttccacgctgcccttccactcaggcagggagaagtcagtcctgggattgagtctgaagattttgatggacatggtcctggagcgagttcggagctagtgttaaaatgccctctagtggtcattagctgtaaccagtgagcgtagggaagggaaaatcttgtgaaactggcttgggtgtggttttctataaacaccgaccaaaaccagagtcctaggttatagcgcgggttacttgcatctgtcgcggataccgcgatggcggtaggacttggtattacttatagaaatggaagcttgccgttgcattcaaagggtacaatccagggatttttcttacgctttcacatctcactgctctgtccctgagccctgggcacacacgagagtttcaagaagtgttgactgagtgactgaatacgtgaaggaatccagtttatgaatcatggattctgtgcacattcaatgagcttggctatttgaaagtgcacaaattcttcctgctttctgaagtattaaatatatttgatttgcatcctttccccagtggtcgcttggtgagctaataattgcctttcctcttatatctttgagctgaggaaatataatcaaaatgttaaggagaggggcaacaaaccccccctttgtgggtagaagagaaggtctgggctggcagctcaagagaaaagatgaagaaaggacatccaaaaagaagtggaagtcagagaatgaataaaacacatgagcgaatggctgccatcctatccgagcatccttcctgatattgtcacccagggccaccagcagaggttacatggtgagaacagacagtagaaatcagcccactccaccgatctgactcctggtctcctggggaaatggcattaggatctaggttaccaacatcatagcttctgccagggcttgtgtgcttaaccccaacagtggaacaccacaaatgcacaggggcagtagcctccaacatcctgaccatctctgagaacctgtcctgctagcagaggggacagaggctgtacaaatcagaaagttgacgtattagtccattttcacgctgctgataaagacgtacctgagactgcgtaatttacaaaagaaaagggtttaatggaaaagtcacggttccacatggctggggaagtctcacaatcatggtggaaggcaaggaggagcaagtcacatcttacgtggatggaggcaggcaagagagagagcgcttgtggaggggaatgcctctttttaaacccgtcagatctcgtgagacttattcactatcacaagaacagcatgagaaagactggcccccatgattcgattacttcccaccaggtctctcccacaacacttgggaattcaaaatgagatttgggtagagacacagccaaaccatatcaatggataaaaggaaatgtaatgtcaactaaagacaaaaaaaaaagaaaaaagaaaaaaaaaacttttgaagaattaaagttggttttatttagaagtcttattggggactgtagactgaggcctacaacccacaagcagtcttttacagaggttttatgagactgcgccagcacagtattttagcccactgtgtatatataggtgctaggggtttagcatgtgcaaagttatatgaaacttgtttagacattatattaaagtagaactacgttaaggtttgggtgtaagggtatatctggttctagattatagaagtgtcatcactaatctccccagatgttattttatgcgtaggagaaggtaaggactaggttcatttgtcttttaaggaatatagtgacttaggtaggagagatgggggccaggtgttctgttttattttgtcgttttggagagctgtatgtcatcacagagttggggctttgtgaaattatgttggcacagagacaagcaaacttagctgcttatgtatgtgattttgtctcacaagttctctctttaggtcacaaattaactctggccatatttataaaaacaatattgattgtgttatgtagctgagaaggctgttttttaggaaggttggtaatctttagttgtagttgtaaggaatgagtattgagcccagtgtgtatatttatttattcattggaaaatatgttttggattatatttatgttttaattactaggatttgttagggtttttgatgttgcctttttgggggttttgtgtgtgtgtgttttgggtttttttttttttcaatacagggtttcactctgtcccccaggctggagtgtagtggcatgatctcagctcactgcagcctccgcctcctgggctcaagcgatcctcctgcctcagcctcccgagtagctgggaccacaggcatgagccaccacacccggctaatttttgtattttttgtagagatggggtttcaccatgttgcctaggctggtctcaaactcctgagctcaggcaatctgcccacctcagcttcccaaagtgcaggggttacaggcatgagccaccatgccaggctgttgcctttttttttaatctaatataacattttaataggacattataaggatattatagattacatatagtagtctatatttaatagtaatatgatttatagattttgaaaaaataaaaccaataaaatcagaatatgcatttgtatttttttactaattgtaccttttgtatttatatttactagtattttttatgaaaagcaattttggactggagttgattgagaatacttttagagaagaatttggaataacaactgggttgtcttgtgcatttcctgtgggcatgatgccagccttgctcttctatggcaaaggatacaggttggcacatggaggagcttggcctctgcaagcccacagacctctgggctagctactcagcaactatgtgtcctctagacacagtaacttaatctctgtgcctcagtttcctcaactgtaacatggggcgaataagagtatgtgccgacagagttgtgtgcaattaaaaaaataatatgtgtaaagtacttatggtgggatcccacctgcagttcgcctccaggaaatgttagatgctgatgtggaggaggatgaaggggaggaccagatgtttttcctgctgctggcatattctgcgcgctgctcttccttctcccaaatcctttcagcagcattttctttcttcccgagattgccaagggaacccaggcagaatgccaggaactaaacctctctggaagattgacggaagaagagctgggatttgagcaagatagagcgggctcagggtcaccatgaggttcaaggtctgcagactcccccaagctttctctcgagtagatttgaacacacaatccaagtccaaatccaaatttaataggcttctgtactgagaattcagctcagccaattgtgttagagccttaatgcacatgggtacacacacacacacactcagtgcacacaatgagcactcgtacagggccgggtcacaaaagaagcgaatgtccatcatctcccttcacttcccctggtcttttctagtctccattcctcaccatttctactgaattctcccatccctctccaccttctacttctggaacgagctccaaacatagcattaaaaagcttcagtgtttccagggaacagagcattgctgctttccataaactggcagaactggtcgttaaatggaactttcaggcattcccccacattctgaagtcactctctatgtaatgatcttcctgatacacctttctgctctttcacctggaaaagaatttgaaggatgtggttatcagtcctctgatgatgccaatgtttcgactccatcctgaatattgttattgctgccaaaacctactggtaaagtaatatcaatagagccaccgtactaaaaaggatgtgtctgctacgttgttttctttaatatcaaggactttaactatattacagttaaaatcaatagaaatgtaaccttttcaaccacataaaatgagttcatttttattattattctttttctgctgttacagtgctgtgattgcaaaagcaaccgggtcaacttaagctttattgaaagaccattaaagaaacaaactcaaactcatttaaatactgaagctggtgcattaaaaagatcaataaagtaaaagcaactggggttgctttacttaaacaccccacatacgagaatcattccacaatcacaatttgagcaaacctataaaactaggagaccagccaataaagaagaaaacgctgtttcattactaggtttagacccataaagcccttaactttagtctgattagacatactgcatttaaattttctctcagtattttaaaacatcatccagcaaagacttattgatcaatgaatgtcatttacttaggaaagccattagctccctgagttaggggaatgactcagtggtagaaagtgcagtttcatttatttaaaaataaacacaagattaggctacagtgaagggaagttctagactcacagggagtcaggaaattttctttctatccttgctgagcgtggtatcttgaacatagttatttgtattcaattgaatgtttactaccaattctgtggccatggattagacacaaacctctttgtgtgtgcctcagtttccccagaggtagaacgcattaatatccttttctccctctttctctggataagaaaacaaaaatgattgacacaaacctcttcaagttcttccttaaaaactataatacaaactataaaccttagtggtaatatgtacttagaataattttagaatcagattggtccttattggccatgagtccaacccttgaccagtctctgcttatattactagttatggaaaacatgctatttttcttcttaaaataccatttattgtgtttttctaattatacatttaaatatatttattatagaaagtacagaagagaacacagaggaaaatcaggtttgcttgtgagtcccatttaaaatcagccctcgacccttctccaccaaacccgtcttgcttactccagggcattgctgagcagttctctgtcttcgttctctactgactcattcccatcagcaaataagcatgcagatatttctcttactttaaaacaaaaatttctcctgagaccactttccccacatctttgtttttctttgcaataaaacgcccggcaatagttatctatgcttgctgtttcgggtcagcttctcccattctctctctctctctctctctctctctctctatttatttatttatttatttatttatttatttatttatttttttggagatagagtcccactctgtcgcccaggctggagtgtagttgtgcaatctcagctcactgctacctccacctcccaggttcaagcgattctcctgcctcagcctccccagtagctggaattacaggtgtgtgccaccacgcctggctaatttttgtatttttagtagagatgaagtttcatcatgctggccaggctggtctcggacccctgacctcaagcaatctgcccacctcagcctcccaaagtgctgggattacaggtgtgaaccaccatgctcagcctctttcttcagtcaactttactgaaatgtaaattgcatgcaatgaaatttacacactttaaatgtacagactgatgagttttgacagacgtgcacacccatgtagccaccaccacactcaaaatttggaatatttctaatatcccagaaggttcccctgggcccctttcccacccaccattgcccccaagcatttactgatcaaatttctatttctataaagtcacagattagttttacctgttctataatttttttttttttgagacagagtcccgccctgtcatctaggctggagtgcaatggcacagtctcagttcactgcaacctccacctcccagattcaaatgattctcctgcctcagcctcccaagtagctgggactacaggcacatggcactacacccggctaatttttgtatttttagtagagatgaggtttcactatgttgaccaggctggtcttgaactcctgacctcatgatctgcctgcctcggccttccaaagtgctgggattacaggcgtgagctaccacgcccggcctacttgttctataattttaaacaaatgtccagctcctttcattctgcataatgattctgaggttccttcttcttgtcgtgtgtatctgtggttgtttttttaattgctgggtggtaatacacttatgaatatacccccatgcatttattcattcacctcttgatggatatgtggatcattttggggatattatgactacacctgttaggaacatttgcatacacatgtatagagcagacttttttttatttctttcaagtaaatatctaggaatgaaatcaatgagtttatggtaagtgtatctttaactgttttttgatgtaatattccctctaggaagacagcagaattccagtgactccacgtagtcactagcacttgatattgtcagtctttttaattatagccattcaactggtgtgtggtagtatctcattttgggtttaattttcatttccctgatgactgatgatgtttagcgacttttcaagtgcttattgaccactggtaaatcttctttcgtgaagtgtctgttcaagcctttggcccctttttaaaattggattgtttgccttattattatgttataaggattctttacgtattctggatacaactcctttgccagatgcatgtactgtgaatattttatcctcattttttcttattcccaatcccagctgggctgctgtccaccactgcttaaagctactcttatggatactatcaatgaccttctcaccaccaaacccactggctacttcacagttctcctgctgctccacttaaaggcagcatctgaaaccagggagcccttggcttttagggaacactgctcctgtcctccttctccctcatgggccccttttgctctgtctccttcactgtttctctccttcctgacctccttcagtgggcgtgcttccagtgctttaccatttgtattcactcctgtgatgatctcatccaatgtcgtgctcttaaattttatctctgtgcctcaaactccaaattattatctcaacccaaacctcgccatgaactgccgactcacacaccaaactgactcccagatatctaactgattcttgatgtctgataaacactccgaacacaatatctccaaatctgacctcctgatctgccccttcccacaacctgccctgcttatagcctttccaatttcagctgatggcaactccatccttccagctggtcaggattaaaaccttggaatatcactagaacatcactcactggttctcacagctcacatccggtttttcagaacctcatgctggttctaccctgaaaacatccaaattctgaccagcctcccaccttgcacatctgctgctcgggctccagactccatcctgttctgcagaggcctcctgacgggtctccaagcttcctcccttgcccttgcaggagcgtctctgacatcactaccccatctgtttaaagtacgagttctctgctcaacacccactgacagtcctcgtttctctgaggacaagccaaagtctttccagtgacctgcaggactccacaggaactagccccgtgaccctccccttttcatgctacttgagcctcactggcttcatgccgggaattctcccgccttggctgctctctctgcctgagtgttctttccctgggtttctgcagggctaacccctcgaatccctcaagtcttcattgaatctccttttctcagtgaggctaccctgaccgccttatttagggttgcagtctgacttttacaccaggcctcttattgggctctaatttgagggaaaagacttcgaatttatcccctcctaccatattacatcatttactttttctctgtgtctctctatactaggaaggaagcgatatgagggttaggatttggggctttttgttcactgatgtatcctaagtacctagaacagtcagttcaaggcaccttatgggcacttgacaaacgtttcttgaatgaataaacggacctgtgatgtgactacagattccttcccacacgatgcactcggaggcccctttcttcccacccagccagtgccaggcattctgcagcaacactgctccatcatcctcttttctctgcccctgcagattgacatcttcagctccctggccaccagattatggttgggttcagctagcagaacactgcaggaaaacacagggggaggcacgagagatcggggtctgtcctgtcctcacctctatcctgcttcttcccaaagtgctgggattacaggagtgaaccaccgtacccggcctcattttacttattatagccacaggttcaaatctattcatatttttgttttgctttgttttttctgctctgtttagagtcggagtctcactctgtcatgcagactggagtgcagtcacacaatcacagctcactgcaatcttgaactcctaggctcaagcaatcctcctgcctcagcctcccaaagtgctgagatgacaggtgtgcaccaccatgctcagcccatatttattttttaacccttgttctattattacctcactctctgcaaagacttctagaaccaactacttggagttaggccaaactttacagctccaagggcacagtcctccacaagactggtctcacgtcaaaccccagctgcaagcccaggggtctccaggtgaccctcatttacaagcagctggctacaaattcagaggttcccactactccctcaggtcaataatttgctagaatgatttgcagaactcgggaaagcactatacttatgatcaagttttactataaaggatacaatccagaccggccaaagggagagatgcaggtggcaagatttgtcccaaatgcaaagcttctttgtcctaaggacacactaccctccctgcacatcagtgtgtgacaatgcccagagtattacaaaccagggacatttactgagcttcggtgtccaaagttttttttagaggtttcattacacaggcttggttgattgaatcattggccacaaaggtgaactcaatctccagtccctctgccttatctggggtttgggctcaatgctcccaactctaattgcatgtttgatgaaaagaagggagaaggaaaacataaaaaccctcctccttacatgaatgcccttctctcctcagttctcatcactgctcttctagctagctttctcttggcccaaagtacacaaatggtggctccagcaggttccctattcctggacattttcaattctaagcagcagcctcaggcattggtgatcctattggatgatccagtcacatgttcttcctaaatgccaagggtatgattatgctacattgcttggaggagtgtgcagccttgcctcattctgcagaagttcccagccatgctgtagccccagttccatatacgtaccacagccaccaacacaggagcctgtagggcacagtcagaatccatcttctttacctcttgggttcagataaccaagcaaagttctcctccaggccattttcatgttctctctgtcttcaatacacattctcctatacatgcctcatagtcctgattaggttagcaggccctgtggttgagcagacttccaatttgggaattgaatgtcagtttcttcctacatttaggcccagaatcaccctactcttgcccaatgtctttgaactgtttcttcatccagatcttttcatcccttaatacattctttctctcaagaagaatatcagtttctcaaggagagagatcctggggtctctccagacacaccgacatgtgcttgagtcccaacgtagctacacatgaactaattcgtcagccccttagggtcttgatcaggtcaccttgagccacaattttcaccaacctttcctctctgatggaaatctgaagtcctccctgggatttccaagggttctttctgcttccaggtgctttcttctgtgggtgatctctctgatccagagaatatccacccagaatgaagctcagcacttcctttggttcacaaacacacaaccgcccaaagcattcactgagcagtagcctctattgactatttcagggtcggggagaggggtacacagcacattaacaaatcactgcaagtcatagagtagatattcatgccctcaatagttcctttacccatccttctatagaggcttctcatagcccttcacgccaggcagtgccagtctttctgctttcaccccaggcagtgccaggattttgatttctcctgattcatgctccctggctccccacctgcttcctcactcatctccaggtctcccccactattatatacaataacaagctgactcttcccaaaacagggtccaagcttgctggcccagagtagtcaggtgctcaacagatgcaaaaacttggatttgaccccctttaaaggagttgtggttacaaataacaacaacaatgagaatttgggggtgatcctatgccagaataacagagatagatagatacatagatagatagatagatagatagatagatagatagatagacagatgatagatagatagatagatattgattgatagatgaaaaactgtaaccccagttttgtatagatcaatccaaactttgcatcctagcattcaaagcccttcacaacgtatcttccatttaccttctattgtcttctaccattcttttccaaaacacatcctaaggaccagcatggctggtgtcgtctaccattttttttccaaaacacatcctaaagatcaatgaggctagtgacctcaacacccttagagaaatttggtttattattcctccttcaaaacgcctccactctgccaatctactgtaccatgatgacacttattctccatattacatattttagaattaggggtaacattttacatttaattttagtagattgtcttagaatattattccttcattgtttcatgtcatgttttccaaacaagaatctaaagcgccttgagcccagctgggaacatctgcacgtcatcagctggactccagtcccagtgctcaaggtggctggaccacaaaaccacatggaagcccttgcataatgttaggaggtgtcagcaagatgatttgagtcttacgccgaggcctctctcttcccacagggggtctgcaccacccccagcagccaagttaccctgtgacagtcattcatctgtgctctgggtggcccatgggatgagtgtactactgggcaggtgtaacttcaggggcacacacagcagacatccccagctgacatgacaacctactggcttctcaagatttgactaatcatatatagtcatcccacaatatcctcggggtatcggtttcaggacccccaagtacatcaaacctcatgcatactcaaatcttgtggtcagctctgaggaacctgcatctagcaagggccgactttgcatatacgcaggtcctgcatcccaagaatactgtatttttgatccgcatttggttgaaaaaaaaatccacttgtaagcagtgcagttcaagcccatgttgtttaagggtgaactacatttctgtgaggggatcatcttcaaataaagtccttgtttctgtaccagttacagcaaaggccctgctttgagaatttaacagtcagagtagccacccacttcaaaactgaccagtcccatccgtggcaagcagacgatgtgacatcaacggctcttaccgcaccaggctaatacagttatcctggtcgtagtttcattttactgaaggccttattaaagcgcccccacacaactcagccaggaattcaccaggaaccaaatttaaacaaatcaaaccccgaaaacgtgctcaacaattcaagattacagaagggaataaagacgaaaataagaaaagcctcaatcatatttgtcatatctccatcgtttctcataataattctcaaagttctttattcctttcatttatttaattaaaaacttaggccatgcacgttggctcatacctataatcccagcactttgggaggccgaggtgggcaaatcacgaggtcaggagatcgagaccatcctggctaacacggtgaaaccccgtctcaactaaaaatacaaaaaattagccaggcttggtggcgggcacctgtagtcccagctactcaggaggctgaggcaggagaatcgcttgaacccaggaggcggaagttgcagtgagtcaagatcgtgccactgcacttcagcctgggcaacagagcaagactccatctcaaaaaaaaaaaaaaaaaaaacttaaccataacattatacaatttaagcagcatcatatttgttaatatctattttcaaaagcgactcttcctaattttattgttttcttcctcccttttccacgcatttgtttgtttttcttcctcctagaaagtcatgttctaagttatcaaaatgtgtttttcctcgagctcttcagggaaaaaatgccatataaaattaattcatgattattttatgtaaattattatctaaagtactcactatgtgtaacggttaaagttgattgttactaaagtgattctaaatatgaaagtgtataaaaccatgaactattctcacactacatctcaaagaaatttgaaatttctagtaaatttcaaatttactagaagactagttcagatattgtttttaatgatttacaatcatcttctgaattttcatttgcaagtcaaagtcacaaaactaaaagtgctacatgttttctgaccagattctctgaaataattatatagtgcttgagccattgtgctataaatatctttgaaatcaatgctattaaagaaatgctatatcagctgtgaaatgagaatttctcctcctgtccgttgacatttacaaaaattatacgaacttattgatagaaaatccgtttgcttggtttctttttaaacatcttatgctttaaataatattcagtgtttttccagtaggtggagtattagtctagataaagtaaatcactgtgtgaaagctaattttttcttcctactattttgagaaatttttgatataaaacataaatcacctaatagtttcactaattcttttaattgcatcaatatggtatgatttcaattactctagaccttaagaggcagatatattttactgattacattaccataataacaatggcataatgacaatagcagtaagtacttattatacctctcattttaaaattgcttatcaagccattagagaaacctcctgacatctctgaaacagaaattacacaacaaagaaagatctgtctcttaaatcctttctctctcgagccttaagcatttctgggaaactgcgttccttgtgagttgaatattggttcaaggctgatgctaccacttccagtccaggaatctgagacgatcactacctctccctgggattctgcttccccttctaagtttgtgaaaagatggtgataaactacatctctgaggcccctccctacctgaaaatccccaaatgaacctgaaattgacaatcttatggctgaatgtcgggagccaagtctgccgagatgttttagtacatacggcaaagatggcacttgttatacggtctggatctcaaaatggaaagtgagagaatgatgcctttccagggcaggtggacgcttcctcccaccctccatccatcaccaaaaccggtcgaagttgaatagtgccctgaaaagacaccttcaagtggtaccctagagttgtatcttcacagatgattctgctcaaagcccccagagacatgggaaaatactattccttagggccatggtagcagaacatcttcaaagaaacctcacagaactggttcaacctcctcactttacaaatgaggaaactgaagtccaagaaggcttcctaacttgataaacatccatttaacacgtggcagagccagggcccatctcctggccccattctcatccccccaggccacctctcctctcttacactggaagtctagaagctggtttgcaaggggtccctgaatgaccttccatagaggacagtgccttaccgagaagaggaaacacatactgaaaccagccacttttctctttttgccttctcacagtcaggtgattcgggtttggagagagccccagctcccatgcgcaggggattttctgtcctagaaaggcttaggcacagtggattcacctggatctcttctagttttgcagccagtttttctttcttgctcttggaccggagagcccccagacccaggcgtaggcttaggtaaagggggctcaggagacaaatctgtctgctttggccctaggctaggccacctctggccttgccaacaattaattaatacattagttaattaattaattaagtcaaagtcctccaacgtggttgagcccagctggggactggtaataaagtgagtggtttagagaataattcccagaagaagcacaaattgattattgtatttggtgaaaggacagcagaagagcattctgggcaaaagatacagctggtctaaagccctgagcacacctgggagtgcacagtgcctccccaggtgtgagagtcaggtcacagcacaggggcaaggtctaggcgagggcactgcattctcgcctctccattctacgaagatgccccctacccctctgatctccccagggccatttaatctctcccaaagaggcaaaggctccctgacttatccatctgcagttacctgcaggattcggttaactttcccttcgtaaaggcatccgccgtgaaacacaccaggcacctccaggaccggcatgcatcgctaacccagtgacaaaagcatggctgttgctcgtttattccagagttctgttaggggagagtgtttcttggcctctttcttcttcttgagtatctctataagtcggcaggatttatgagtagctcaaccaaaaacaaattaaggtagacaacgtgacctctaaatgggtcagcctcccaaatggtgtcctctcatctgcacccatggctgttcttgggattggagggatggccgcagggcttggcaatgtaggttgggagggggctggcctgctgaccctcaccctgatgggcttgtggctctcagcaatgtggtcccaaaaacaagttgcactgaaatcaagactctcagagcagagcaggggcaagtgtctcttgcatgaaaattcggagtcccagattcacgatcagccagtctccccatcgatgtggtctgggaggatggagccaagctcactcactcaaactcgatgtcaataaaatgctatgagggcttcagtccactgagtcattcacagagattcctccctctacaaacagaagttctaatggaagtaaaagctaggaatccacaccttaaacacacacacacacacacacacacagacagatttacatacagatacatacacgaacatggctcagccagtgctgacccatttaacacatgttaaatgagcaccttgcatatcacaggcccttttcatgtggatcgtaaattaactggaaggtttattagataacactacagagaaagaaatagccgaaagtccagaggtgaggtgttagccacggagctctgacaaccaggtggatttccactgcacctgctgagcccactgatcagtgtttaacaagcgtgtgttatgccacgctcctggggcaggagtggtaactgaggcagcgtccttgaacccacagggttacggtctcaccaagggaggatcaggaacagagctgcaaccctggactagcaggagagtcacacctaatcctacttctttatctcccacacatctacatttgctccatgtcctctccattatcaggaacaaagtgattctagggttaggaaggggcagaaaacatttagatgaacgtatccttgatactggggtcaaggcctgcttgttcgtattttcaattgcaaatggccctaggcttgtgtatacccttcatagaatggagattccgatggggagaaagagatggtctccactcttcaaaccctctcttctttgaagtctgtgggaatttctagtttagaaggacgggtagacacagataaggggtgcgagttgagctgataattgtttctcctacctgaagtctatctgcatcagcctcttcttatcttcagccttgggcttcaacttggagtaaataaaacattcatcagatgatatgctctaggctgggcgtggtggcctacaatcccagcatgttgggaggttgaggtgggaggatcacttgagcccaggaatttgagacaagcctggacaacatagtgagaccccatctctcctaaaaataattttaaaaattagccaggcagccaggcacggtggctcacacctgtaatcccagcactttgggaggctgaggcaggcagatcacgaggtcaggagttcaagaccagcctggccaacatggtgaaaccccatctctactaaaaatacaaaaattagctgggcatggtggcatgtgcctgtaatcccagctacttgggagactgcagcagaactgcttgaaccagaacttgggaggcagaggttgcagtgagccaagatcacaccactgcacttcagcttgggcaacaaaagcaaaactccgtcttaaaaaaaaaaaaaaaaaaaaaaaaaaaaaagccaggcatggtggtatgcacctgtggtcccagctactcggtaggctaaggtggaaggatcacttgagcctgagaagtggagtctgcagtgagctgtgactgcgccactgcactctagcctggatgacagaataagaccctgcctcaaaaaaaaaaaaaagaaactccttagtcatacacctaaagccaatctctccataatcactttattgggaataaaatgatattttgaagaaaaaagatgatatattctaaattcaatatcgctgagctaattccaagtattccctaaaattaacgattaggaaaaacagcaagaaatcctaggcctttgtctaggccatggaaaaagcgggatctgccttgaaattgtgtccttcatctcaggagatggggcccggcccctccaccggtccaggagaacccacgccatttaggtatttcttctttagcttctccactgcatccccaaagcgtaaacggctgatgaaatcccttcaaactctgccaacgcaaactgtggcttaaaaatggaaatgaatggatattgcaaaataatacctgaatagacgttaaagctttaagctccacgtgtaagacacaaggtcctgcctaaatcagtatgcttctaatggcttcatggcaaatgttgaacaagttagtgttcactcaaggttgtcctggggtacatggagtcacagtctttaattttaatgagcctctattacacaatctcttatcgcctcttaactgccagtgaaatgaccaccagctaaatgtacagcaaaatacatttctacaaaagagctcacttggaccccaaagaaattaccttgaaattattacacttaaccgtggcaaatgcaccagggttcatttgaaaagaggtggccacctggcaatacgagtgaaatcatataatatgtcatttccttaggcttttcatgttaagcttttctcgctatatctgatttaaagtattttctcttttaaatgtaaatatttaaaatgtagctgatcctctccctctcctaattgaggtgactgggctagttcaagagactgtggcctgcagctcaccgttttgtctctggagtcagagtgccagccttggtacttactctgtgactggacactttataatatcaaagatacgagatcatacctatctaatatctattcaataagacaatacatattaaaagatcagcacaaagccttgtacacagcagttgctcaatatgtgcttcctcctttttcctactattgaatcccaccagccaagaccagaactatatctgcagttggacaaagttgggtttatcccttgttgcagtgagggcttagcagtttgagtcaaacgggagctggaaaccacagtcggttaaaatggggtgataaatagaagcattaactatggcaaacagcaactccaagatgtaaggaaatccgtgcagtttcctagtggccccctagggctgagggagcccatccagggacaacctcggtgggtgtctgaccgtaatggaggcaaagctgcccctgtctcctctgacagtctccagctgggcctgagagttaagttgacgtaggagagactaacagaggaaacgcaagccaatgtttacaggcatgtgagggccttcacaggacaccaagatccaaaagcagccaggcctaagtgcttatgcaacagggtgaacaaaaagtagtaattttgaaaaagtaactaactatatggagatactaaagacaagggttattttaacaagagctttttaactgtcaaaacactttttgtttgtaccgatttccctcggcctcaactccccgcctctggagagaagaatgttcttttcttcctggtagagagaagccatcttccatatgaaagtttcatctcctgctttcaggaagaaaaggggaggtcagagtgtcctttgtgcatctgttgtttttctttttttctttgagatggagtctcactctcacccaggctggagtgcagtggcaccatctcggctcactgcaacctctgcctcccgggttcaagcgagtctcctgcttcagcctctcaagtagctgggaccacaggcgtgcaccaccatgcccggctaatttttgtcttttagtagagatggggtttcaccatgttggccaggctggtctcgaactcctgaccacaggtgatccgcccactttgccccccaaagtgctgggattataggcgtgagccaccacgcccaacgcatctgttgtttttcaagtgcctttagctcaaaattgtccccatctcaagccagcatatctggaggtggcgtgttctgaagcccttcaggaccttgctggagaaggtgtgtctgcctggcagagagcagagacccctgcttagccaagctggagctggtccggaattgctgggggagcgacaggctggctgccctctggagtgcaggtgggggagcaggcaatagcaatggcggtgggggtgagagtgaggggctaccagggcggttcagacacacgtccagaggtctgtgggcaggttgccatggctgagacgctagggtcacagagggttctcttaaaaggcctgcgactcagacaggcttcacctcatgtcctcgcactctgggcagagcctctgctatccccctcctcgagcctgtgctggaaattgcagtaagccccttcctcttgcagtgtccctccagagcacgctactgagaaagcttgacattgtgctcaccttaaaagcaaaatctttaaggaattccattgtttatcatagagcttatattgaagggtgcattgggagccaggaagcaacgagttgattgataattgacgcaaagggacccatataccttagagaatgacggggtggctctaagagtcaggaagggcttattttaggaatcaggcttatggtggggagggttcaaggaagcaggtgtctctaatcaactgggtgctctcagaaaagcagggctaattcagttattgggcctcttaatgcatttcatctgggaggcaggaagaatggagaacactaacgttgttattgaagaaattgccgggagaaagagatgttttggttttgggttgtacaaggtctgttattttttaatttcttgtattagtttcccagtgttgctgtaacaaattgccacaaacttaaggacttaaaacaacatgcatttactatctcacagttccagaggccagaagtgcaaagtcagcgcaaacggctgaagtcaatcagaaaggctggtgccttccgcaggctctgagaggagaatctgtttccttgcctttctcagcttctaagagtctcctgcgttccttgggcccttcctcacgtcactctaacttctgcttccgttgtcacatcttctctccactgcgaccctcttgcctccctcctataaagaccctggtggggacctgagacccacccagggaatccaggagaattcccctattatcttaatcacatctgtaaagcccctcttgccaaggaaggtgacgcgctctcaggtcctgagaattaggatgttatctttgggaggcatgattccgcccaccatatctccatattcagacaaaattgcagaatggtctcgtgtcacatggtcaggtcctggagagccctgatccgatgctgctgttctgaattatgttcggcagggggacagcaccacctggtggtaacactcggcaaagcatccgccgtcagctgcagagctgcttttcctttggggtcctcttgctttaacccaccttccccacaatcccactcatcccttccggccacagcccgccttcttagacacaaggcaggcaggagtatgcgagagagaagacgtaaggacgccttgctcgtggtaagatcagagactgatcggagaacgctttcctccttccctcctttgagaatttcctcaggcactgcagcttcacctttgtgaatgttgaaggctttctggatatcctcgtcacttctcatattttcctaactgagcaggtaatttggattagaactgtacagcatgacccatttaggttcctgttcactgttttgaaattaatgacttcatcaatgagttaaggctaggagtgttcattatgttttttagaaaagtcaaaaccgagcaggatcaccgagaagcaagatgacacaatcaacaatcaaaaacctctgagtagaggctattactgtgtttcaaaacaaaatatataaaagtggccgggtgcggtggctcacgcctgtaatcccagcactttgggaggccgaggtgggcggaacacaaggtcaagagttcgagaccatcctggccaacatagtgaaaccccgtctctactaaaaatacaaaaattagccgggcgtggtggcgggcgcctggagtcccagctactagggaggctgaggcaggagaatggcgtgaacccgggaggcggagcttgcagtgaaccgagatggtgcctctgcactccagcctgggcgacagagcgagactcagtcccaaaaaaaaaaaaaagaaagaaagaaaagtttatataaataaatgtaaaatttagcatttttggttaaagccatcaaccacgcagacataggaagggaatacacttatagagatcaactaggaattttattttactgtagctcagcaaaaataatataaaatggctgccaaaaagccaaggccgtctagtctggatctgcagaaacaattcaggaaaaggaaggtacctccactgtgtgggtcatgccaaacctgaggacggatttcccttcggtgctcgcgactttaaaagttgcattaacaactgttaatgtcaattatcaagatcccaccatgtattgtattgggctgtattgggcctgaggacacagaaatgtaaaaacctaaacatggaaatttaatctttaaaactgtgtactatgtatccatagaacgaaatactagtcatccatgacaaatgatttttgttgtatatttattgagacagaagacattcataatatatcgtcaagttaaaaaatatacaaaacataatatgtgttagttgggttccatccctttttacttaaaaagttgaaagaatatacattaaaagttaacattgactatcagctggcagtttttttctgcaaatctatatcattttttctataacgaacgtatattacttgtatccatttttaaagctaagaaaatagaattttgttgtatttttatcgacacagagcgacattcataatatatcatcaagttaaaaaatatacaaaacaatgtgttacttgggttccatcccttttttatttaaaaagttgaaagaaaatacattagaaattaacatttattattagcaggcaactttttttccggcaaatctgtgtttttctataatgaacatatattatttgtatccatttttaaaattctttaagaaaatagaactttgttacaaatttagttttttgttttgttttttttgttctgagatggaatcttgctgtcaccaggctggagtgcagtggcgcgatctcggctcactggaacctccacctcccaggttcaagccattcccatgctacaatctcctgagtagctgggactataggggagtgccaccacacccagctactttttgtatttttagtagagacagggtttcatcatgttggccaggatggtctcgatctcttgatctcatgatccacccacctcggcctcccaaagtgttgggattacaggcgtaagccactgccctgatcacaaatttagtttttaaattgtaagaagtatgaggtggagattatcacctcctaaggcattgccaggtaggctattggttaacaatggcattttgcatttaaccatttaacaaaagagagtaagtaaacagaagtgcggtggcagttacccatgggtgtcattagatggcagcaaagcagctagctaatatttaagagcagaaactgaagagcttttgctccaaagaaacatatatatgagattttaaatatttaagattatctgaacggaataagtgtttttgtttgtttgtttgcttccagacagggtctcactctgtcacctaggctggagcacagtggcatgaccacagctcactgcaggcttgacctcctggcctcaagctatcctcccacctcagcctctcgagtagctgtgactaccggtgcacaccaccacacccagctactttttaaaatttttatagagataatggtctcactatattgcccaggctggtcttgtactcctggactcgagagatccacaagcttcagcctcccaaaatgctgggattacaggcatgagccaccacacctggtttgttttgttaatgatgcatttgacgttatagaaaacttttcaaaatgatagccaagcatgcaaatgtttactttaatagtttttgggggtggggtgcttttggatttttgtggcaatactactcatgcacaaaaacctactgtaccagttctgtgggtcaaaaatctaaaatgttcttgagatgtgaggaccctttgactcttaaccgtgactgtgcaatgatctctaagtttctaggaagcagtttcaagattctgctgcagacagtcattaataatgaatgactattcatcgtagtatgatgtggtgatgccatttgatcacttgcctgccctctttcttcactgccactctctccttcctcccaagagcacagctagcttccagcatctttgctcatctgaaggacagttttttgcctaatcaggcccagtttgagcaaggactctggatcgtatctgcttctgagtctgtgctgctgccttcaacaagttgctgcttgttctgtctccttcctctacacaattgacgtggcccccatgggaatgcccatgtcggaaagcaatgctgtgctttcttataacccgcacctctcgtcatgctgaccttagcacgtattaaactcacttcagaaaaatgaatgcttacaaaagaatgttttccaccggggtggggggcccaaaaaaggcccagaaagctctaagagctcacagttggagaaacacatctagactgtataggtggtaaaaagacagctgagaagataaggcaggaaaagccacacagggacacaaagggcaaggccagtgattctgacaccaccattggcactttgtccacgggcaacaggatcagaaacgtgcgtcgcttccgtggttactgtctgtgcaccgttcccaacagcttcatttctctccctctgctgccaactcgcccaaccacccctgcctgtggcaggagaaatcattctcattgggataaccgagaaaactacaactgtttaccccacttgaccctcagcatttgagtgtgtgtgtgtgtatgtgtgtgtgtgtgatcatgtcacaaaataaaatgtttccgcaaaacttcattgctgtagatgtggcatattccctatcagaggctgacactggagattggatcaagcagatgttactccattaaaaagaacatggatcttaatcctgtaggtaaatcatccacagaaaatgtacatcacctggagagccgttcataaaggatcttcacttaccatcctcagattttttcaaagaaccccagcaaaggaagacatgggtttccattttctcggggtggtgttttagagtcagtgctgatgaaataagatatcagaaaaccagggttcaaagagtgatgtcatccccacagggaagatttggttccacacagggtagagacgtgcttctaaaagtgtctcttgttttcctcctgcagctcgatcattatccttctgtgagttaccatctgccaagttcatccgacaccctcttcaattctcccaagtcgctctttctgggaaaagttataggtaagaatgtggttcgttaggtataaatgcgtgctacaaatacatttgggtaatgtgagtttggattttaaaactatcaggtaaatttctcttactggggccagtcacgaatatcttctctgtacaggaaagttacgtggttgttctcggtgttgcacaagcaaagcgtcaacaaattatctttgggggaaattgctcatgtaactcattctaaagctaattcgcctttgaaatacattgtgattaggctgggcatggtgggtcacgcctgtaatcccagcactttgggaggctaaggctggtggatcacttgaggtcaggagttcgagaccagcctggccaacatggcaaaaccccgtctctactaaaaatacaaaaattagccatgcatggtggcaggtgcctgtaatcccagctactcgggaggctgaggcaggagaattgcttgaaccccggaggtggaggttgcagtgagccaagatcgtgccaccacactccagcctgggtggcagagcgagactctgtctcaaaaaaaaaaaaaaaaaacaaccaaacaaacaaaaaacacattgtgattggtaatgggggcttctaagtcagcgatggtaatggaacaaacgttgtttggtgcgtggcataaactacaacccaagcgaaggcaaatctgctccaggcttctctatgtagaatttggtctattacagacctctacctactagcaatatgtaatttaacgtttcctttgtcaaagcatatcaacatgattctatcttcctctcactcgtaagaaagcaccttgatattatttgcagataagaaggccaataaggaatttgacagtgtgacagaacacccttccccatgtgcgactgtgaattccagagtctccttgtccctctcttcaccagaggagattagcactgtgcaaagctaaaaaatgtaccatgagccacagatatgtgaagattacaccctaaatttttaaaatatcgatatgattggtgaagtattttaaaatatttaatgtgaagccaatgaattttgttcatatgaggctgtgtactgtgaactgcaatgaaaacagtaagatggtggtgatgtacaggtgggagggaggtcactcggcggccagtgtgtagaagtgatcagaatagcattaatggtaaaaatgctcacttaaaaacatgcggcaggggtcacaaaatgaggagtgagtaggagactgaacctataataaaaataatagactgggcgtggcggctcatgtctgtaatcccagcactttgggaggctgaggcaggcagatcacgaggtcaggagatcaagaccatcctggctaacacggtgaaaccccgtctctacaaaaaaatttaaaaaaattagacgggcgtggtggtgggcgtctgtagtcccagctacttgggaggctgaggcaggagaatggcgtgaacccgggaggcggagcttacagtgagccgagatcacgccactgcaccccagcctgggcgacagagggagactctgtcttaataataataataataataataatgtgcacttatgtaagatttactgtaggccaggctccagtttaagcacttgacagatattagcccattcaatcttcgtcacaattgtatgaggtagttaagattatgatctccactttttagatgagaaaactgaaccatgaagagattaaataaccgggccacctggctaatcagtggcagaaccaaaatttgaactcaggcaatcagacaccaagggagctctttactgtgctgtaatccctgtggcagttaatctagaatgcaaagagaaagacagagaggaaagattgggcaggtgataaatgctgaggctgtccaggtaagggataaagcctatatcttgtgccaggaagtggtcaagaacaaaaaggattcctgggtttagaaccaggaacacaccagtccggctggagagggaggcatccagaagagagggggaaagcaggtgtgtgcatgaagcccaagaccacacacctggtgaacaagacagtggggagtggcaagtgataaatcaaagggtggaactggaaaacaaaagagggctaacatgtattgatcactgagccttagatattgtacgatatgaaagataattaaatagcttctgcttaatcctttgcatcctgaaaacagcactcaggcacagtctcaaatctagctttggattacctcaccctgatgtccttatctgaattttctccaacactttctatagttgatgtatttttacagatcttatcaccacttttatgttctgtgaacaagaagagactttgtgacatcacatgttacacgtgtaaatataagaaacaaacgtcacaacaatccaatgaaatgagatccctgattatgaacctcattttgcagatgagaaaactgaagcagaagaaggtcaatttgacaaaagttactcaactaatactggcaaagcagagtttggaagcgaggtctctctgaagacagtccagactcttaagtgggtcaaacaatcttgtcattcatggtgaagctccagaagagggatgtatttgaaagttgagcgatgccatcagttagcaacaaaaagtggctgtttagtggagtagggccttggcattcatgagtcatggatctgagactttggtgagtacccgctttctaccagaggtactcccacggttcagttgagaatactttaaaatgttaagtgctccttcagaaccatatgattccatcaaaacaaacgctacactatgatatggtgatgttcctaaagatactacactatgatattcgtaaagtaacatcaactataaacatacccgaaaataatagactttttattactttgtggaacctgcaaagtcaaattttgatgggaatgttggatgatttctaggttctgtcactatgagtaatattctctggttcctctgttttccaggtcatgtaactagttcacatttcagcacaattccaatatactgtatggcatggaccttcaaggtcgtgaacaaataacatcataaaggccacattttctacaactaagaatgtaccttgacatcaatctgtgcaaagctaaaagtgtaccatgagcctcagatacatgaaggttacaccctgtattttttgtacacccaagaaaaatgttgctgcatacacaaactaggtaactgtgcatgtggcagtgagttacagaaagtacacataaatacctgtaaggaggtccacaattccaagatggaaatggtgttatgcaggtgagagtagttagggctccagcaatgggtccttggtgcactgacttctagtggagattatctctcatccctacaagcctgtgacctccctgcagaccaagaaagcatctcatagttccaccatatactaacaaggagcaagtgctcaataaatatttgttgaattaataaagagtaaaaggggaaggaaacagaaagatatcattgtagacgtatactgcagggtgaaagggtatggatgatcatcctaacagaatcagtaagattcgcacagaggtgagagctgcaatcctcacatatctcacagcctaaaagtaggcatctgacgatcatgaagtagaaagaatgtggacttcggaatcaggcagagcttgttagactggaatccagttctacctctgttagcattgaaatcttgaccatgttgctttcttagttgaacctctcagagcctaggttctctcctttgcaaaatggggaacacaaatgcctacttgcaggttgttaactccctgagggcagaaggcagagactttttttgaaactaatctatttacagcaggctgatcagtgcctagtatacagaaagggctcaaaaaatacttgtggagtaaatgaactactcttttaatattaagctaataacgtcttaagacatacacaacacaatgcctaatacataaataattaccatttttgatgctagctacatgccggttattatgctatatgctgtaagtacaatactgtctgcgtttctcacaacaccacagaccattgttaccctcgttgtatagaataaggagctaaggctcaaaactattaagttttcttcttaaagtggggtttcccaacagcagaactattgacattttggatcagaaaattctttattatggggctgtcttgttcattgcagaatgtttagcattctccctggcctttacccactagatataagtagcaccccaagttgtgacaaccaaaaatgtcttctaacattgctaaatgttccccaggagggaaaaattaccaccccagttgaaaaccacaggcttcaagctactcagcgagtcagcggtgacgctgagatttgaaaagcgtgatttgtgacctaagacctatgctttgcttcctgatgacacctgcaccttccagaatggtgaggaagcaaggacgaggttcttgctactctgaagctaaaattctgttaataaaattgaaggagtctcagtgaagaccccaagaagacatgtaagtgcttgagaagctaatcactggccaccccttcaagccaatactcctttgatatttgatcatttcacaggggcaggaatatgcttaaatgtctctttgaaaacaacatatacttcagtgagagacaacccatttgcattccccagttgtgtaaaaatccatctgtacagacatacagtattgaacttgcaactgatatgtactccggccaggttttgaaaccccctggagtttcatgctccaaagttgttgctttacttttataggatcagtttctgctactcagaaactgattctataaaagaaagagaagaagatggctctaaatacctaaaatgacttcacactgagctctttgatgagcactcctcaaaaagggacacagaaaaaggatgaaagaaaggctacctaatcaaggacaagtgtgatctttataaaggggatggaggatatatattcaagaaatagtagtgtgatcactgccaaccaacagcaaacttttagaacggattcttacataattctgaatgcttctagaaggaattcagaatcactagcaatcagcaaaggttcacaaaggagaaatctcactagacatagttatgtccatctttcatccctcatatccatccatcttttaccagccgagtgatgtcatagactttatctttcagcaacaaatttaatggtctctcaagaaatcttcaaggaagagaaatataacttgaagccgaaagtggggtgttctgtttgctcatgtccttttcaacatctctattaatgccttggagaaagacacaagtagcatgtttattaagtttgcaaatgtcacgaagctgagagggatggtttaatatgatggattataaaaagcatttcaaaaccatcttgacaggctagaaagatgggataaaaataataagatgaaatgtaatagaaataaacttaattgcagcacttagataaaaaaaatatatacaatcacctaaatagaagatgggagacccccagcatcatgaaaaaacttaggaaattggtttgatggaaagtctggtacaagcaatgttacatggtgatggattcttaaatgaatgtgattctgagccacactagtatgagaatcatgtccagagcgagggtattagtcatctgaggagaaaaccagataaacacaagacccgtaaaggaaatgtcagaagacctgggaatgtctgatcagaaaaaaatatgatttgagagacgagagaatcaattttcagtctttggtaactgccacatgcagggtggattagacttagttgaggcttactcagcaagactgacatggaccaaaagcagaagatatgaagaggaaaatctcagctccatataagaaagaacttcctaacaattagagcttttcaaaagtgagtggtctctactttgaggtaatgaactctctattattgagaatattcaacaaaggctaaacggaaatgtgccctgtatattaaggagttgtctggattgagtaaaaccagattagatatagcctaaataaactttgaaactttaagatttgtggtgggagtaattttcttaattaaaaaggtgaaaatgcaatattatagtagagcagggtctcctgttccattggcaactagggggataacatttagggttccttgatataaaacactgttatgatgcatgatgatagatatgaatttagaagaatatcaatgtacagcgatcaccacatcactgtgagttgtgtaattacatacacgacctgtttccaaggtggcaatatgcattttaattttatttctgagccctctttaattaatcgtttttcaaattaactatttctgccatcgctgtaaatcagagtaatataaaaccgtaatgaagtagatctattctgaaataaaaagacggtagcttctctgtgtaaacttgagaagctgtgcttagaaagaagctgaatactaatgcagtgtcgttgttgcttggctgatcattgctgttgtcagtggcgatgtctggggtggtaaaaataaagcgaacttctatccatttgaactaactagagtttgtaagtcatattggtctcagatcctcatatttcccaaactaccattatccaaagcaattccaatagaagtggctagtagcccctatattatttctattataatctaaattgtgaatatcatgatcctacacgactttttattgattaaaaagtcttattctaaggctttctaaaactttctggagctttggcaaagcctcttcacacagaaggaactgacatacttagatcttcatttgttggtgaaatcatatactgtgataaccatgctgctcacagaatatttctggccagagttatgaatggaaaagatttgtgtgatttccaggctagaacatttaagtgctcatgcaagaccctctagagtccttttatccctttggcatggtgactgacaagcctaagacagtgattttttccgtaagcctgggtccctctgtgactacagtgaacagaaaactcttgacttgtgatgaacatatagcatgagataaaaaaaactccttgctttgttaagccaccgagactatagggctgtttgttactgtggcagagccttggcctgtcctgactgaggcataaggactgacttaagggcagactttgctctcgcacccttgggtttgatctctgatatagtttggatatttgtccccaccaaaatctcatgttgaaatgtaatccccagtgttggaggtggggcctggtgggaggtgtttggatcatggtggtggaagcctcatgaatggcttgggccatctccttggtgataagtgagctctcactctgagttcacacaaaacctggatgtttaagtatgtagcacctccccccaacactcttcctctggatcctgcttttgccatgtaccctgcctgctccaccttcaccttctgccataatcataagcttcctgaggcctccccagaagcagatgccagtgctgtgcctcctataaagcctgcagaactgtgagccaattaaacctctttccttataaattacccagtctcagatgtttctttatagcagtgcaagaacagcctaatacaatctcttactctaccatttgccgattgtatgactttgtcgggttacttaacattgtgtgtatctgttttgtcatgtgtaaaataggaatagtaatggtctctgtgtcacgggattcagcaaaataatacatgtttagcggttagcacagtctctgctgcatagtatgtgtgtaatacatattagttttttactttgcataatcagcaaatgtatactcatcatatgtcagatgccaggcattgtataagtccctggaacatcattagggtccaagacaggcacagtttctgcctttggaaactttatatattcaaatccagttctcagaggtttctcttgggagaacccaaagcaagataggggatcatacaatgtatcaatatgcactgggtcacatctttagagcttcagtttctggaaaagaaggtaatggaaagtcaattagaagtaaaaagacaagagggtgggataaatgaaaagaagtatagaattctttgggagcaagtagggagggcacttgagccagtccaggagtgagggaaggcatactagaggaagtaacacagaagctgggaccctaatgaagagttagaatgatctgggtaaagcaatgggctgaagtagaggccataagggcgggggaggtcagttctccattctgcacagcagtccacccaaaactgtgtggctcaaaacagtagtttattatttctggcaattctgtggattggcagggtggttgttctgcttcatgactccaggcagggtgtaagaatgactggatagcccgaaatagcctcattcatgtggctggcagcaagtgctggctgcccaggagctctttggggccacgagccaggggctgagttctcccccaagggttccaaatcatggctgcttgggctacctcatggcatggtggctgggctccaagaaggagctttccaaacagcaaatgtagaagctgaaggtctctaagagccaccattcttgccatatgctattgaccaaaatctgggttccagcccatgttccaagagagaggaagcagaccctacctcttggtggcatcgtagccaggtcacattgcaaagaaacatgccatgggagttacggttgtgacatctttggaaacacagtgtgctatgagagaaatttgaggaaccacaagttgcattcagaatggtggaaagtcggatgtgaagatgcaagtgataaaaatgctgcagcataagcagggttcagatcaaaggcggctttaccagcagggccacatgtcctgctttgcctgggacagacccaagctactcctgccaggacaagagtacattattagcagtgcccacttttactctaaaaataggactacgcagttgtatgatcacctatcttatttgggtgttcccaggagaaaccctgcagaattcgatttgaatataagaagtttacctgggagacaatcccataaaacaagcaggaaagtagagacatgaaacagggaaagggatggagcattatcaagccactcaccactgtgggcacctggaacataatcccaccaggacactctggaagacagtgcgagacatgcctccgagtgtcccaaccaaggcaggaggaagccagggcatctcgccacctcctcccatcctgcagtgatgagggctgcttcctgcggtactaactccccagcacttccagcttgtcccgtgtttacacccaacacactgctgaggccagaggaaagtgcagatgacagcgaatcgcagtcagtggttcctggagcaggactgaggtgaatgccgggcactgacagcatctgccatattacggatctatttataagccatgttaaggttttaatgttatcttaggggttaaaggaagtcaaggaaggatgttttttaatccatagaataacgtgatcagattgacactttagccagataataccatctgcagagtgcaaaatgcataacaggaagtgagaagctgcagggagaccaaattggaggttgccatggttatcacagaattgcacattgtaatgcacaaagcagctcacatatgtggagaaaatgcaatgtctttatctgtgtctgatgatgtcgtattccttctgggtagcaaaggcaaataagctaaacatccaggctggtttaaagctgattctgacttaatcatttcaaaattccttcctggttgtgctctgtccctcatgaataaaaatgttcagtttctcgaagagcctttcccgtcctctgcttctttctataaggtggggaccaggtgtacagaatataaaaggagacaggcagcaacatgtctagctttagcattctaatgataccgtgggcagggagagacctggatgcatgctggtccttgagtttgcatggccaggcatctgctggcctccagcccagtgtcctgtgtccctgagtgctcttctggccttggagcttaaatctgtggttgatgaacttagagtccctttctttgactcaggcagtgttcccagggagcacctgccatcctgccctttgcttacttgctgtgccctcaatctcccacttgagagacccctaagccctaagtctctttcgcatcctccgtctccccatggcaggttgtcgtcagctatcaagcagtgagggctttcatctaaggcttcatgctgcacgagaatgagatgatgcacgtgaggaccagagaccctgtcggcttactcttcttccctctctacatgaggcttggctgccccatgttagtacaggaccgccccccaccaccaccgaccccctacacagcaacctctccccagagccccagactgggaagcaaggcaagagccctaaacccttggtcccatccgtcatcctttagaaacccacttctgctctctgggccaaagcttagctctcgtctctcctgctgtatctcctccttttctcatagtcttctagggcattaagaaagaaaaaagaaaaaaagaaaaaaagctttgcttttacttcctacaaaaaaaaaaagcaccatctaacaaatagctccaaaactcaattgcttaaaacaacaattctatttttatcactaatctgcgggtcagctaagggccgaagtttctcttgtacacctctcgtcttcctcctgggaccagggagttagcatgggcatgtttttctctggcagagacacgagagaacaagccactcacacaagcactttccaggcctttggtcttgtcacatccactaacatctgattatctaaactaagtcatgtggccaaatccatagtcgaggagaagagaaacttgctttcccttcagtgaagaaaacagcaaagtcacatggcaaaggccacggatacagggaagggtaaagaattaggggccgccaatgccatcttccatacttaggaggtggatgcaggagaactctgtgacctcctcgatgtactaaaaagcctgagtaggcccggctcggtggctcacgcctgtaatcccagcactttggaaagccgaggcaggcagatcacgaggtcaggagattgtgaccatcctggctaacatggcgaaaccctgtcgctactaaaaaatacaaaaaaaaattagccgggcgtggtggtggtcacctgtagtcccagctactcgggaggctgaggcaggagaatggcgtgaacccaggaggtggagcttgcagtaagccgagatcgcgccactgcactccagcctgggcaacagagtgagactacatctcaaaaaaaaaaaaaaaaaaagcctgagcaaaggaacttggggaaatcattttattcactcaaaagtatgttcagtgctcacatgtaccaggtgctaggcacagaacaatggataaaacagaaatctcttatctttatgaaccatgtactctcatgagcatagacagaatgagaaaagagttgtgtaatataaatgttagcaataagtgctatgaagaaaagtaaaagaggcttagcaggaaagcatgttacaatggccaggaaagtcgtctttgagaaggcaatatttaagcagtggccttaacaaagtgagaaagctggctgtgtggacatctgctggaaaagccttccaggaagagagaatggcagtccaaaggctgtgaggtagggacacgcctggcttgttcaaggacaggaagaaaaccaacatggctggaatacagccatcaagggacagagtggcaggagacagatgaagtcagagggttagccagcagccaattgcacagatggagaccatcatggagagtctgcattttattctaaatgagatgagaaacagtagaaggttttgagcacataagtaacacaatccaatttacatattagaaaggtcattccagctgtgggatgctgtattaactgcagaaggggtgggctgatataggggcaggatggacactaagagaccatttcaaatacagttgtggagtccatgtgagagttagaggcacgtgcaccaacgcaacagcagtgatggtgatggagaaatctttggactaggaacacactgaagtcagagcccatagtatttggtgatcaaccggatgtggtgggtgagagaaagagaagtcaaagagcgtttcccaaggtattggcctgaatagctggcccagtggtggggctgcctactacaatgaggtaccctgggagagaagtagtttaggaactgtggaataaaaattaagacttccattctagccacattcaaggctattccatggatgcatagcactgaggtgcatatcagaaaccgaacaccacctgtaacacggccttttcctgtctttatctcccatctcctcctcaggcagatagatgtcttggcttgactaggacattgatcgttactgggaaaggcaaaaaagaaaaaagcctattgataaatgtcagaatatatctccattataaagtcattcaggtgttgcatatgaacgcaatgatgaagaagaacaaattactgatacacaaaacagcttggatgaatctctagagaatcgtgccaatggaaaaaaagccagtcccaaaaggttacatacccaatgatcccatttatgcaacatttttgaaatgacaaaattttacaattgaggacagattagtgagtgccaagggttagtgactaggacaggagggaaggggaaggaagagaggtgtggttagaaaaggaaaacaaggaggccgggcatggtggctgactcctgcaatctcagcactttgggaggctgaggcaggaagatcacttgaggtcaggagttcgagaccagcctggccaacatggtgaaatctgtctctactaaaaatataaaaattagccaggcatggtggcccatgcctgtagtcccagctactcgggaggctgaggcaggagaattgcttgagcccgggagacagagaagttgcagtgagccaagatcatgctactgtactgcatctaggtgacagagctagactccatctcaaaaatttaaaaataaaaaagagagattcttctgcagtgggaattattcattatcctgactatggtggtggatgcacagacctacacagatgataaaattgtgcagaatcacatttgcacacatacaagagtacaaaatctgaaataagatcattggatcatatcaatgttaatatcctgatggtgacactgtactcctgatttgcaaaatgtctccaatggggaaactgggcaaaatacacaggggatctctctgtacaatttcttacaactacatgtgattctacaatggactcaattaaagtttcaattagaaaaagcaataaaaagccgggcacggtggctcatgcttgtaatcccagcactttggaaggctgaggcaggtggatcgcctcaggtcaggagtttcagaccagcctagtcaacacggcaaaaccccgtctctactaaaaatacaaaaattagccaggcaagatggcgggagcctgtaatctcagctacttgggaggctgaggcaggagaatcgcttgaacctaggagacggaagttgcagtgagcagagatcacaccactggactccagcctgggcaacagagggagactccatctcaaaaaaaaaagaaaaaagaaaaggaaaagcaataaaagtaaaagaagaccaagtccaccttcttctgtggagccatttattcatgggatatttagtcagtgtctcctaggggctagtgccatccaccctgggggagcgtgagggacaggagagggacctgcagcgattaagccaccggttctacccattccctctttactttcctgcgctagccagtagagattaggaaatatgtgggaattattatttatttacagcttagaattttgtagttcttttagagtcattattgaagagaatgattaatataatacatttctttaaaaaggagctagagaaaatggggtagattaaactgcctgcaacttctctcaaggaaagtccccgatggcagcttatcgccttgtgatttatctctacctcctaagagtagaatgcagcaaaattgataaatgaacaaatggcaaatagttaattgaaatttctggtcagttgcctttgcgttttactataaggacagaagcagcaggaaagcactgatgagaaagctcattgaagtgataggtgagaaataatatttaaactgaagagaagaaattatgtcctgtttttcatatcctaaagaacatatagcgtagtcttaatgtccagaatcttctcaaggctgaaggaaatctattttaaaagaattcactcagggagttctagttcaaggctggcttctcattcttttttaattgcattgactttcattcttagacatttattgggctttattattattattgccttatagaatcataggaggccctaagaaataatttgttgaaactttgtcacattacagctgaggaaaatgaggcccagaaaggttaaatgaagccaaggtcacatagctggtacttcacaacgtttcctttttttttttttttttttgagacggagtctcactctgtcaccaggttggagtgcaatggcgtgatctcagctcactgcaacctccacctcccgggttcaagcaattctcctgtgagtagctgagactacaggctcacaccaccacacccggctaatttttgtatttttagtagagacagggttttaccacatgagccaggatggtctcgatctcctgacctcatgatccacccacctcggcctcctaaagttctgggattacagtcataagccaccacacccagccttcaacgatattttcaatataatatactgtcaatatcagaataatctttgcttatcacccaaatgtgtctttaacaaggacaataaataattaatacatcataacctgcaaacatactctcaatatctagataaaacagctgcaaaggcaaatcttgtcataagtgtaggctggaagaggatattttgaacattgagggtcaggctcaatacaggctctgtgtcagaacacctgcaattccagttgcctcacctgctcgaggagctttaacaggtttcttacaaatctcagcttcagttttcttaaccgtgaaatgagaatgatagtagtgccaatatcataagctttgttaggaagatgaaagatgctatcatgaatgtaaagggcttatcacacagcctggcacacagtgagtgtccagtacgtcttaggcagtatcattacatctaatctttgacttttagctaatacaaataaagaatggctgactccaatcctgggtcactcataaaaagaacactcaaacaatgaaaaactgaaaaaaacttttgattgaaaaccaattggtatcatcatctttccatggtttccaaaattaaattatttttaattaacaaaagcaacccccaccaaaaaaaatcatttattgttaaaatgtgatgagagatcagaagttctgttttaatcacatttttagtatttggttaaagaagattgtcaaaacacttatttctgtcccaaatcttcaactcacctgtctttgacacacaacatacttttgcatacccaattgttttgaaataaacaaacatttgaaagccaaaattctaggctgggctcggtagctcacacctgtaatcccagcactttgggaggccaaggcaggtggatcacctgaggtcaggagttcgagaccagcctggccaacatggtgaaatcccatctctactttaaaaaactacaaaaattagccaggtatggtggcaggcacctgtaagctcagctacttgggaggctgaggcaggagaattgcttaaacccaggaggtggagttgcagtgagccaccaagatcatgccattgcactccagcctgggcaacaaaagcaactctgtctcaaaaaaaaaaaaaaaaaaagaaagaaagaaagaaagaaagaaagaaagaaagaaagaaagaaagaaaggaaggaaggaaggaaagaaagaaagaattcttattattataacattccaaagtattccagaaggcatggaaaatttttgaatttcttatttatatacagttgatcattattattatacatttcatatttacaaattcacctactctctaaaatttatttagaacctcaaaagtagtattcttggtgcttttgtggttatttgcagacatgtgctgtgcagcaaacaatttgtcatcaatgtgtacattctcatttgaagtcaaacaaggtgatgcccttgccttctagtttcagctcttataccataaacaagtatcatttttgtagtctattcagtgccattttttttgcattcttgtgtttttattggtgattttactgtataaaatggcccctaagtggagtgctgaaatgctatctattgctcctaagcacaagacgctgcgatctgtcctgtggagaaaatacatctgttagatgagctgtctttaggcatgactgattgtgctggcagccatgagctcaatgttaataaatcaacaacatttatttcaaaactgaatattaaataagatacacacataaagcaaggtaatgtattggttggttgataaaatgttatgaccagatgcttgcaggaacctaaccctgtatttactttaggaacaatgttttagtattcactaattgagtgttagcagcaactgtatgaaacatagctactgcaaatagtgacaattgactgaattatttttaacctgcatcacatgaatatgatgatacattatgtttttatattattttgcagtttaaacagctcttccacagctattatcacacatgatgttcatggagcgttacagtttggctgtgtccccacccaaatctcatcttgaattgtagctcccataattcccacttgttgtgggagggacccgatgggagataattgaatcatgggggggtttcccccatactgttctcatggtagtgaagaagtctcatgagatctgatggttttataaggggtttccctttcagttggctctcattctctcttgcctgctgccatgtaagatgtgcctttcaccttctgccatgattatgaggcctccccagccatgtggaactgtgagtccattaaacctctttttctctgtaaattacccagtctcaggtacgtctttatcagcaaagtgaaaacagactaatacatggaggtaagaggagagtggttactgctcagcacactagattaacaagtccaactaaggctacccaggtagagcctggtcttctccttctggtttgtgaaatctcatggtgcttcctatagcataaagactggctgtcactcaacaccactgcatcttaaggtccgtggaaggggaacataacatgtttcgaagaaaaaggtctgggctacaaagaccctttatgtaatcttgctaacgacctggaatttaaactttggagagcttgaaggttaacaaattggaataaaaagaaatcaagtcactccttgtttgaatgctctgaagaacaaaacagaaaaacacaatgaaatggtaacagaagaagcagatttggcccaataagtctatgctttgaatgttcctccggcactaacatggccacatttgggaagactggcatccccacagacttttctgtagcactttgaaggaagaatagagcagttgtagaaaaacaaatgtttgcatgaaagaattattcacctcttaaaaatctatagggtgtgaataatcctgctataaaaagcattaaatgtttataacagatatttaatgggactgttatgttttttggcagcaagcatggctagattttgaatgtcacagctctgtgctctggtgataagacagactctgtggtctaagtaagaattattttcctgcttttaaatgtagctgttaaaaaacaataaagtgtatttatctaaggaagataatcttctaaaagaagtgtttaataatttttaattcacaatttatactacttctccaaggtaaattcattttccaactgttactccatctttattgactgggaggaattagcattcaaaatacaaactcagaggttaaagcaaagccatacacagaagtgagccttattccattgtcttttatcacgggtgccagatttatttaacagactgtctttcagtctcacttacagtaactagacaggtactatggaggacagtgtatgttgaatgccttccaagtgtgaaacacctgcctggcactacattatcactaattctaaccttgcaagtaagtgcctacttaaatctgcacttgacatgtgaggaaagaggctctgaagttttaaagtgacatgtgccaagtcatatagctagtaagtggtagaaccatgattccagggtgggtctttctgtgcttgttggtttatttactgtctgtgtttgttttatgaaagagaaaagaccctgagagataggcatagtacaggtgacccttgaacaacaggagaattaggggtgctgaccccctatgcagtcaaaattttgcatacaacttttggcttttcagaaacttactgccaatagcttactgttgaccagaagccttactgataacatgaacagttgataaagacatattttgtatatgtattatatactgtattcttataataaattaagctagagaaaagaaaacattattaggaaaatcataggaaagataaaatacatttattattccttaaatggaagtggaacatcataaaggtcttcatcctcatcttcttcacattgagtaggctgaggaggaggaagaggggttagtcttactgtctcagggttggcagaggcaggagaaaatctacatataagtagactcatgcagtttaaaaccatattgttcaagggtcaactgtgtatttatttgatgcttcagaaaggggaccatgtcaattcctgataaggttctctcctctttccttttcctccatctctctgtgtcgatcctagtgctctcatcggcttttaaccagtagaggtctccaaactgtcttgtggcagcctgggctccctatacacagaaagacctggcttcaaaattctggttaatatgggaagtgcattaggaagtagaaaggaaagaaaagtcaaacaataaggaaaggattaatataaatcataaattaattttgtgggcctaattactattttttaaaacactgtaagttttagtagattttcttactctaagttatagaagtcaaaccctaaaacacgttaaaaaaaatctttttgttatttcttaactattacggttattttatcaaaattaattaatatcaaattaatgataatacaaaggaagtcacattattaattaaacaaagtgacttagccttgcaaataaaacactatcgtgtggattaatagtttgaaggtttaactttacagccttttcaattgactgtaatttagagcatttttaggttcacagaaaaatggagcaaaaagtacagagagtttccatatactccctcacccctccccacgttatacatagtttctcttcttattaacatctttctacgtcatgtttttggtgttacatacttgccacacatagtaccctaataatctcttgggccgtacattctctgggtttggacaaatgtgtaatgacacagatccaccattacagtatcatagagagtggttcccctgccctaaaagtcctctgtctccacctgttcatccctccctcccctctgctccttgcccggtccccaggcaactactgatctttttcctgcctctatagctttgccttttccagaatgtcatataattggaatcatacaatatgtacccttttcagattagcttctttcactttgtaaaatacatctaagtttccttcaggtcatggcttgatagatcatttcttttgattgataaataatatttcagccttatttttgtaaggaaaaaatcaaatcaagaaactaaagtttgaacagccactatagaaaaaaaggcaaaagtcaataaacaaaaacaattgttcagcttcgctcataattgtatacacctcccagctcttggactaggtaacatcagtggccagcaagatgccaccgattgagtgattgtttttatttcatgccatgtgacccattggccctccttttcctgacacatttataatcatcttaatcccaaagcaactgtttttaacaaatatgcatatatcctctgattttctgttgctataacagaatacccaagagtgggtaatttataaagaaaatgactttatttcattcatgcttctggaggctgggaagtccaaggtccaggggccacttctggtgaggactttcttgctgtgtcatggcatggtggagggcatcacatggtgagaaggcaagaccaggtcaactcaggtctctcttcctctttctttctttctttttttctttttttttttttgaattggagtttcactcttgttgcccaggctggagtgcaatggcatgatgttggctcactgcaacctccacctcccgggttcaattgattctcctacttcagcctccggagtagctgggattacaggcacgtgccaccacgcccagctaatttttgtatttttactagagatggggtttcaccatgttggccaggatggtctcaatctcttgacttcgtgatcggcccgccttggccccccaaagtgcggggattacaggcgtgagccaccgcgcccaacctttttttttttcttttcttttttttttttaaagacagtctcacactgtcgcccgggctggagtgcaatggcacaatcttggctcactgcaagctccgcctcccagcttcaagtgattctcctgcctcagcctcccaagtagctgggattacaggcgcccaccaccatgcccagctacttttttgtatttttagtagaggcggggtttcactatgttggccaagctggtctcaaactcctgacttcgtgatctgcccgcctcatcctcccaaagtgctgggattaaaggcatgagccaccgcgccccgcctctcttcctctttctttaaagccaccagccccatcatagggacccaccgcgatgaccttatctaattctaattacctcccaaaggccccacctccaaataccatcaacatatgaatttagagattaagtgtccaacacatgaaatttgggggacacattcaaaccatagcatcttctttaagataatgtaaaactattaaattaaataatagagtagaaatcacactaataatttgtgggtctattcagattatatattacctaataatttttacctattttttgaaaattgttccaatcattccccctgcttccttttcaaaagagtcaaacatagccagttaatttaaggtatctgcaaaacctttccaccaagacttttatggtacagagaagtgactcataagccacaattcaattaaatttagcaaatatttcttggacaacaactacatgcttgaggttggcatggggacctgtttttaaacctcctgttcattctactttgactttttaattacaacagattaaaatatcttattcagcaaaaaaaaaaaaaaaaaaaaaaaaagagagaaaaacccactttgtatattgaatttttgaatacacaagagaagtgcaactcagggtggtgggattcctacctagcaggcctgtctccctttgattaccccaatattccaaaggtgcaggttttgtgcaccaggcactctaataggaccctatcagctcagcgctctcagaaatttcagttgtctcccagcccctagaaagtcacaatagctccagggttgtgcttaacgggccatagtgggaggatttggaaaggagaaggtgaatcttttctgtgaaaagcaggtggaggaaactgaagagtggggagaagagaggtggatgctgacctgaattgtgttttcaggagcaggaagagtgtgctctctgcttaagagatgacctgaatggcaagactacatgtcactcggatggtacacagatactgtcttgatgggagttttcggaacagatttgtcctcccagggtgaaatagcagagagatttgaggcagccctcaactagagtatgaccaataaacaccaacttacttggtttttttcattcctttttccctgtgtccaagaagcaaaatgataatgtaaatgaatacacacacactcacactcacacacacacacacacacaccccatgttggggaggcgggtaaaggaacagaattgctctcagcaaacactggtggcatcaaaatagccaatcatgctgatggctgccacacagctcatggaagccttccacaggccagctctcttgctgttggctggctggacttcccagctcagtccctcacctctttacaggacaaggcacaccagaaaccaaggctgttgggggaggcagcaacagagaccagacgttccctctgcacacacatgatgtcatcaatagaaactctgctgatgatgaacccactttcacacaaaccttttaaagcctgagttattttttgcaatgacaaaaataacaaaccacatttttttaaatagcttccttaataataatggaaattcaggtgacattaatgaaaattgtagcacatgttcaaatcagaatctatgttcagtgttatatgcagaatataaagggatttcttttctcaattgatagaaaagggaagtcatatttaagtagtcacggtatcctagatttttaatatagcaacataattgaataatattttgatgtatctggttttagtatttaaggtgataaaatattaaatttaagcttaaaattaaaaatagaggaaaaagaaaaacaaattgaactgaagtgaaaatgtttcttgttttttaaaaaatcattgtacataacagttttcaccttcacttttagaaatcaaagcacaaccctctatcacatggtaaagagagtcagccatacggaaaaccaagctgattgttctattcctgtgcaaattctaaccctaaaatatttctctataatgctttaagaaagaaagtaaatctggaaaacattttttatcattttgaaagctgcctttgttttgattctcattgtgaaggtcaaggataggagaatttccagagatgggaatttatcttcactttatgctatcatttcagaatgaatagtgatcaggttctaaataatgcattccacaggtgtgagcaaccaccctatcactttctatcttcatgtggctggtgcctacaacactaaatttctgcggcagattcattaaggtagttgttcattccctgtcgtaattagacctcccatttcagccttttatgtcaaatccatcactcaccctggcactcaggctcacctctttacaaagcccttccctggtgctattctggctctaaacacaggtgataaatgtgtcagcatggggcacattcctgtccctgaggaccatcaatcgttaagtacagagagctttttccagcagccttctaagatttatacccatgaggatattatttttgtggctgcatgaaggagaattattacttgaaatgggttttgtgaaaggatggttttggtgttgctttggcaccattttaagcttcttttcacaaaattgaccggcgcaagtcagaatttatacttctatgaatgtagatcttcaccatctgatggtgctgagtcctacagagaagaggatttgagactttccagtttttagagatctctacgatgtgcaagaatctagatattcagaggccgtactgacttcaatcacatggtaaattagtatatgagagttcgcagtaataaaagaagtatgtaagtgatcagcatgtgttttagtcagggttctctagagggacagaactaatggaatatatatataatatatatatatataaaatatggaatttattattaagtaataactcacacgatcacaaggtcccacaatagaccatctgcaggctgaagagcaaggagagacagtccgagttccaaaactgaagaacttggagtccaatgttccagggcaggaagcatccagcacaagagaaagatgtaggctgggaggctaggccaagtctccctcttcacatttttctgcctgcttgtattctagccgtgctggcagctgattagatggtgcccacccagattaagggtaggtctgcctttcccagcccactgactcaaatggtaatctcctttggcaacaccctcacagatacacccaggaccaatactttgcatccttcagtccaatcaagttgacagttagtattaaccctcacagcatgggaggtaatgcgtatgttaaatagtttcatttagccatttcacaaggtatacagattccaaaacgtcatgttgtataccacaaatatatgaaatttctacttgtcaatttttgaaaaaaaatgtttaaaagaagtgtgtaaataacttcttactttagatataaaatcttaagggccaggaaaagggcaccaaaatccagcctttgacatctcagaagaagcgatgattaatttcatttcattctgttggtttccatggagtggtgctgggtggtgaggcaaacacagcagcaggaatgttaacatttcatattttagccctaggagtaaagaaaaaaaacatgtcccagatcagcactagctagaaccaggaaaccccaaaagcaaaggtttttttgttttgttttgttttgttctgttttttgtaaaagacaggttttcacaaaggaagttttccaaattctatgtataagagagttgagaaggaagatttttctctcttcttgcccaggaggacaaagggaagagtaccacattaagccattcaggtaaagtgaagcttattgaacgctgtggattaggataaaactaatagagttttcatttttaagccagttcagatattcagattaattatggacgtaatgtagaaaataccaatttctgcaagttctacatttcatgtgaaatcccaaagaggttaaagctgatgggttttaactgatgaaaacacgtgcctctgattaaaaatgtttgtagtgatgaaaacaaagcatgctagagttacagtgtgtagcatgctgaagccaccagcagagcttaggggacaaaaacaactgtttcctaagagaaaaagaggctgagtatcttaagcctggggaagggaaaagacagtagttagcaagctcaggttagccactggtattactctacctttcatgagactcttcactggggaggttggggagattcggtctcacctaaaggagagatggctcgtgaacccaaggatgctgcagggaccctggccaccacttgcagcccaaacactagaatgaggaccagagaacacaatctagctgcttcccatccatcccctccaccccaacatctggtctcagcaacttcctctgccctacactgggatgccctccttagttgatctgaaccatgcagcagatgaaacatgttggcctgacaagtagcagatggctataattgcctgagccatctacaccggcaaatttttcttctttatttgcatatgagtaaaatttttcccagtgttaaattatggtgtgagtagagattttttgagggagcacagcgcagttgtatagacatcgtgattgacaaaaaataaataaaataaaataaaataaatgaccaaaatctgctaaatgaatttgaattaaattgttctaatgctttctttttctttgtaactcttcaccaccacctcaatacatgcattcctggacattcacgcatacactcacacaaacacaagcatggtattttttgtgtgtgagacactgaaggtagcatgaaatagcaaccaaaaaatctgcagtattaaagttagatatgacttggtttgacttgcaaatcaactgcctcactagtaagatgacttctggtatatggatatgtctctcagttttacaggcttgttttcggattaatggtaatagatgtaaagaattgggcacggtaagtcaatagtcaaagctattcaacaaattgaggacaaacaaggaaatgggttaggaattggtctgtagccagtctcagaaatgttgtattaacctttgggatataatcccccaaaattaaagtatagtgattcatccaaaagtacaaagtgttactagcaagatggatgaggatttccatctaacatttttcatcttcttatccctgacacattattaaaacacctagattttggtaaaagaggagaagtcatgtcttggacaggattgaaggttgtgtcaacattccctatgctttcaagtttcagctttagaatccaaaacccccgggcacagtggctcacatctgtaatcccagcactttgggaggtcgaggcaggcacatcacttgaggtcaggagttcaagacaagcctagccaacatggtgaaacctcatttctactaaaaatatggaaattagccagtcatggtggcgcattactataatcgcagctactcgggaggctgaggcaggagaaccgcttgaacccgggaggcagaggctgcaataagccgagattgcattgcaccactgcattccagcctgggcagcagagcgaggctccatctcaaaaaaaaaaaaaaaaaaaaaaaaaaaagaatctaaaccctttggttcacagatggaaggaaaaagcaggcggtgtttcctattctatgtgtatgccatgcctcgagccctgaacaggctactcatctgtggccaatattatattataacctctccattctcagaaggcacgctggcacccatctctgcaagaaaggcatcaaattgtctgtaagtcacagaaatgttattgtattgtcctttattcattcattcagaatatactctctaagcatctatgtaattaaacattactaagcttacatataattaacctcgaaataataactaagcattgttagttttatgtacggctaacttaagaaataaactcactttctagttatcagttttggaaaacaaaagagctctataacaattttgaattaatcaaaaattggagaattctgtgcaaacctataatccttccctctttagggtgaaggagcaacgctttgtgttacttaaagacacactttgccattgtgattaactataataacttttaaaataatcaaaaaatcagtccactttcttgtctatttgtgtattgatcactaaaattattgtacctagtatgatcaactttgtatattactgtatttcattaaagcagctaacttctcttgtccagacataagagaacactagaagacaaaaaacaaaaaacttttatgaatctcttttccttacgaacactaattttataccattttaacatacttgaggtggcaaaaataaacatatatatattatatcatccaaaagtatttgcatattttattaatctattgccattctaagaattcagggtaagttaaaattgtgttaccaaccagcatttattttgcatctgtttcactcttgaaattgtctaggtttcaaagattattaactaattaacttcaccatttgtctaaggtcttaaagttagttaaggatcgagaaatcacaatttttgcaaacataatgaatcctgacacccagcacttaaaaattttacaaaacttaattcttttaaaaatccattaccttttcatttaattgactataattatatgtatgtatgtgtatacattttaaacaagttataaaatttgtgatgatccacttataaaaacaatgtaggaaatttaggaacttaaatgataagaaatttatcattggtctcgtacaaaccaaagtattattctgatattatttttatatgataaatgaaattgtaaagaccctaagtcgtgctcaaggctcttcttctatcttgaactaaggttttcttcttatcttgtaactatagtaacaagggctacaaaagaagcacagcttaatatttttccttttagacatttttgactactaatatggtacagatattcctaatgtgcactcataatgatagagtgaatattttaatcaattttttttttttttgagacggagtctcgctctgtcgcccaggcgggagtgctgtggcgcagtctcggctcactgcaagctccgcctcccgggttcaccccattctcctgcctcagcctcccgagtagctgggactaccggtgcccgccaccgcgcctggctaattttttgtatttttagtagagacagggtttcaccgtgttagccaggatggtctccatctcctgacctcgtgatccatccgcctcggcctcccaaagtgctgggattccagacatgagccaacgcgcccggcctcaattaatttttaaagcttcccaaaagaggataaaagaggaggaaaggaatagaaaaaaaagcagtgatagggacccaccttcagacacttaagacattatcgctgtaaaaagcaagggtcttccctctgcaagaagaggcactaaatgtttagattcaggaaaacccactgtgacatatatacatgcaaaagataactcttacagctggtataaacaattatttgggccttgaaattcttatcaagtaacatgtttaaaagccagactttattaatcctcaaagaacagaaatgtagaaaacagcatttacaatgagccaaaaactctctctttttagattgcaagacaggtatctcttcatgaagctttctccaatttttgttctcaggcaccactcaaatgaacaatcttgttcatgtcaaaaaggtccccaaaatagccactgcagttcaaaattatcctgtgaaattggctaggcatggtagctcacatctgtaatcctagcactgaggtgggcagattgcctgagatcaggagtttgagaccagcctgggcaacacagtgagaccccccccgcccaccatctctactaaaatacaaaaaattatccaggcatagtggcatacgcctgtagtcccagctactcgggaggctgaggcatgagaattgcttgcacccgggggtggagttcgcagtgagccaagatcacgctgctgcacttcagcctgggaaacagagcaagactctgtctcaaaaaaaaaaaaaaaaaaaaaaattatcccgtgaaattctgccagttaaagacacaagcatgtcagttaaggtgatgtgagaaagcaggtatttgtttcatagaaaatgcccagttttaggatggatcagacactatgagcactgcaatagatcctcccacacgatggtgcccgtgcagcctactttcgtcaggacttggccaaagcccattccagggtcagacaatcccttctgatttcaagaagcctaatctaaacaaagcagctctcaggaaaagaacaagaccgacgaaaaagttcttctaagggttcgaaatcatgacccaagtcaaagtttattcaaagaatgttgattgtaggagaacttctgaactcctaggcccctgagccagctcaagaactgacttacctggcttatgctcattgtctccctagagaccttttgttttagagataaagaacactcaagacactgtacaagcagacagtccataggaacatatatctgtagactggtaaacagtatcaccaaagaacaataaaaatcagatcagataaccaaaaagtcactggtaaccttattcctaggggaagaaaaaaaaagagagggagatagagaaaaggaaggaaggaaggaaggaaggaaggaaggaaggaaggaaaaacacctaaagtggaaggacctcagcagaatatggaagctcagttcagcatgaacttctcctagcacgggcagtgtggttacatcagacagctagagacacaaagggtctcaaataagcacactaaaattggtgagtggagggttcccatccaagactgtagggctcacagatgaatattgatggatcttcaaatgcagagattaattacagccactgaccactaggagcccacctgtagtagaacaaatgtgggattcttcactcattgcatcatgggagattgctcattatggagaaccatagaggcatctcagtaagaggatgctggaaagagggtgctagaaagtgctattcggttttcagtaggtgatttggggagagttaaaaaaagtaggggtttgttctagattggatactgtcaggaagcaggtaattctgtgattgaatatcttaatttttttttatcttgaagacagtagagaaaaacagctgtagttggtaaagaagtagaaatgatgtgtattaggctgagaaggggtatgttggatcattttcgtgttctggccagttttcttttttcagtgctgagacatgtctcatggagtgacctcttctttgcctttccccatgaaggtcacggaatgaccttgtctgatgttgagttctgtgaaatggatcaccccaaacagaagcacacatggcctggctgtgagttcccaaacagctccccacgctcaagagctgcttttctttctcattctcaattaaggattgaaggaggacacaaaaacacgatcaccaaaggaaaatgaaacaaatttaaagtaaataaaactcagcaaaaagaaaaactacaggaaaagaaaagtaactgtaggaaacaataatgacttagccctaaatggcatttacgtggtcttaatcatatgtgaccttaatcctataaaaaccaaattgtgatctaactccaagtccaacctgcctattttagaagggtagttggatggtgctagtggatggtggggaggagagtagaagctaactcatcatcatccgtattggtaagtgaatagataatgcctaaaaacatgtcatgaaattgcaatgtcaccacatcatttggagatacgtttttaagtcagcctaaagggttgaaaatgcttctaggctggggcaacgggagggcagagcatagaagatggtaatgattcctgaccatccttcaagaactatctttctaattttttccatcttctcctccctgctttattctagccacactggcagctgattagatggtgcccacccagattgagggtgggtctgcctctcccagcccactgactcaaatgctaatttcctttggcaacaccctcacagacacacccaggaacaatactttacatccaaccaagttccaaggattggaacaatacaatcaagttgacactgaatattaaccatcacacacagacatatatacatatatatatattttttagacagggtctcactctgtcacccaggctggagtcgagtggtacaatcatggcttactgcagcctgaagcctcaacctcctcagctcaggtgatcctcccacctcagcctcccaagtaactgggactacaggcacacaccactacaccttgctaatttttgtattttttgtaaagatggggtctcactaagttgtctatggctggtctcgaactcctgggctcaagtgatccacccactgtggtctcctaaagtaagtcatggcacctggccaactttttttttttttctttttttttgagatggagtcttgctctgtcgcctaggctggagtgcagtggcacgatctcagctcaccacaatctctgcctcccaggttcacgcctttctcccacctcagcctcctgagtagctgggactacaggcgcccacgaccacgcctggctaatgttttgtatttttagtagagacagggcttcaccgtgttagccagaatggtctcaatctcccgaccttgtgatgtgccctcctcagcctcccaaaatgctggtattacagatgtgagccaccacacccggccccaactttttaaaaatattttttaaagaatgagtagaagtagccaggtgaagaaaagaaaaggaaacagagctgggaaaaggtgtgttgcatcagaaactagaggagggcatttcgcctggaccagagaaagttctgatgagccaggaaggctgggcagagccagctcaggccaggcaggcgcgattctgcacaggacaggatgcacctccaatgaccacgtgtttctaggttgtttccaagggcacacagataacagtcaacgatttttttctgactagccactgtagtgatcgctgctgtgtgaccctccacactttgcttccctcgggcctcagctccgcctcattccactggcctaataattaactcagccttattttcccaacctaattgtttcacagaccaaaagaaatattggatgtaaggtacaatttgaaaagtgtaatgtgctctagaaatgcataaaatgatgattagtctttgcccagtaggctttttagcttaataagctcctgataatacagaaatcactgtgagcaactggcagagaaagatttttccatttctcttaactaagaaaagagatttaaagtcactttggagagctaacactaaataataataactgccaaaggaattgatttgatgctgaatataggcttgtgtaaggaggtaaaaaactgtccactaaagttaatgctcatagtaagaggcctctgtccttgaattcaccttgagagagttgaacagggataacggattttcaaggacacacatctacagagaaagggcgtatggaaatggaaaagggaaagctgctcctagtgtttttgctgaattgttctctttctctaacccagcaggagagatgctaaaggagattttgtcaaagaaaatccttgacattggattcttaaaagccttatggtttcatgataggccctttaccaaggattcttaagggacaaccttatgttagagagaaacaaagtcctgaatcatatttcctcctctctggaatatatgtagaaatacaagtgagaagataaatacatgtgtaaaaagaaaattcatactttcatactcgttatatgttatgattaaatgttgattgcatttggagagcatcagcatatgaactatattacagaaaggatagtcttttgtttcatggcttaaatcttcttttctcaataagattaaggggctagctaagattataatcataacaattttttttttttcactgagtttccaccctgtgaggaacactaggctaagcaggaaaaaaaaaaaaaaaagtcactaaaagaccctaggctatttgtacaccaatgttcatagcagcattattcacaatagcaaaaaggtggaaagaaccaagtgtccatagatggacagataaacaaaatgtggtctatacgtacaacatgggtgaaccttaacattgtgttaagggaaataagccagttacaaaaggacaaatactgtatgattccatttctatgagatacttagaggagttgaaatcatagacacagaaagtcagatggtgactgccaggggctgggaggagggacaatggggagttgttgtttaatgggtatagagtttcaattttgcaagacaaagaatttccagagatgggtggtggtgatggtgcacaacaatgtgaatacacttaatgccactgacttgtacatttaaaagtaggttaaaatgggccaggcatggtggctcacacctgtaatcccagcactttgggaggccgaggtgggtggatcacgaggtcaggagtttgagaccagcctgactaacatggtgaaaccgcgtctgtactaaaaatacaaaaattggctgggcatggtggcatgcgcctgtaatcccagctactcaggaggctgaggcaggagaatcactggaacccgggatgcggaggttgtagttagccaagatcatgccacttcacttcagcctgggtgacaaggcgagactccgtctaaaaaaaaaaaaaaatatatatatatatataggttaaaatgtccattttatgttaggtacattttactgcataaaaaaaaaaaagactatgggcaagccatttccttcctctgtgcctcagtgacattatctgtgaaataaatgtgtagaaacagatggactccaaggatgcattcaactctgcaagtctgtgtgtctaaacatcccctctgtcctcatggggtttagcagcaagttggagagatgaaatgcagtaataaaatgtaaaatacttctagttaatgttttaagtacccaattagtgattttttaaaaaggaatatgtattcccttgagaagggatagagcagaaatctggaggacagctttgtggagatagaactggaccatgcccacttcaagaagtatgtagctcggatgtggatctgtgccagtgggatggccttaacaaaggtgagcaggcttcaccacaccagggggtccgtagaacagcaagaagatgagcctgttggtggtagaaggcttctgcgtcaaagtgaagcattgaggaggacccatgggtgactttgagggactctgaatggaagagagtggatggacgagacacctggcctatccacaaactggccctatagccttgaataatcactgggacctcagttcctgctgtatgacaccaaggctagctcctttacaagacggaagcacagcctagctgatcttgctcttcctgctggaaaactccatgattctctttgccttccaggcaacagacacataagattcctgctgccaggtcactgctggatgctggactccagcagtgacaggccccgaacctgcccttgtgaaggccactttcttagtggtggtggctcatctagcaggctgaggaatgtacaaaggatgtgtaagaaaatctacctagcagtagggtatataatgagttaaagaactgagcttctactggcaatgagaccagccagggtaatgttgcaaaagtttagatgtacattaagacccagaagggctgaacttggttaggggagaggaacatgaaatgaaaagtctaatgcatgaaccctagaaccacatgaatattaaagctcacactgaagtatctgtgcctccttctcccttgccctgccctttttcagcctcccaaagctgcacccattcctcctgtgtccccaatatcccctatgccatgtgatgtggtttgactctgtgtccccacccaaatctcatctcgaactgtaatccccatgtgtcaaggggggacctggtgggagatggttggatcatgagggtggtttgccccgcgctgttctcaggatagtgagtgagttctcacaagatctgatggttttataaggggctcttctcccttagctttcgcttctctcgcctgcctacttccccttccccatgattgtaagtttcatgagacctccccagccatgtggaactgtgaatcaattaaacctctttcctttataaattactcagtctcgattattctttttttttttttttttttttttgagattgagtctctctctgtcacccaggctggagtgcagtggcaggatctcggctcactgcaacctctgcctcccaggttcaagcaattctcctgcctcagcttcctgagtagcttggattacaggcgcctactactgtgtctggctaatttttgtatttttagtagaggcagagtttcacatgttggccatagttgatcctgatctctcaggagatctgcccaccttggcctcccaaagcacttggattacaggcatgagccttgggtatttctttatagcagtgtgaaaatggactaatacaccatggtaactgggtcccatacatcctgaaaatactaatagaacaaatattcccactcctgaaatttaacttgatcctgaagacgaaggatttccttgagctcataaatggaagtggttcatcttccaggtagagaatgcaaggtagattggttttgttcacaggggtcatgcagagctaagcacatagaaggtgctcagtaagcacctgctgaacatactgaagtgacatagccaggcagagacgggtaggtggacagccaacacgccatgagagctggaagggcgcatcctctcttaggagcttgggccctggccagctgactcagcttcaagctctgctagtacataagtccctcggggcctataagcttggccgtgttgcagctgaaatttctgctgaataaggtcatacatactaagctgagaatgcaatagtgagaatggctccttctttttcgcatcccagaccccagaatagaaatatttaccatcacgtctggatgataatatcaataaattatcagacattgcacgtattaagaaaagctcattttctggaaattgtccttattgtcctaattgggaattatcttgaagccgtggatagaaaatgacctttcagattgctgggacaaagcccaagtctaaattggaaacgtgtttaatggctaagacagcccacttccagattaattatggatgcttttccatttcaagattacattaggaaggaaagttgtcactgggtggaatgtgagtctccactgcatccttttaagataaataagttgaagtttgaagaaaatttgagattacttttggttaagtgaataaaatctgtttagcgaactctttgaagttgtggattgcctgggaatctacaaatctgcaacctccctccctctagatacattcagagggtagaagagaagtcatttaaaaccttatgcttgacttcttgcttcctgccttggtttttaaccaaaactaaaaataaaaaagccaaaagagaggaaacttgataggttcaaaacaggaaattagattgtaagcaaagaaattgtccaaacatcgaaaaaaggaacacatcaaagaagggaggtgctttgtttttatactttgttatcgtcctggaaaaaaatgtctgctgcctctgataatacatattaacacttcttttttacttagcttttatttttatcaaagtaataaaatcatcttgtttaaagtgtcaaatagttctatatggcttattaggataaacaaccatccaattttcaagatttttttttcctttggcatttgtctttaattctctaaatatattcacctgctacttgaggggtcagcagacttttcctgtaaagagcaaaacaatgagtattttaggctttgagagccatagagtctctgttgcagttactcacctctgctgttgtagcacaaaagcagctgtgggcaatatgtaaatgagtgggtgtagctgggtgctgaaaaaactttatctacaaacacaggtggctgcacagtgggctgtcctttaccgtctcctaggctactccttgagtttctgtttttagtcagtcactgttaggtgactcctgactatggaagatgaggattaggctctttcacagccaacaactctcctccatggcctcctcccctccatgtttttcctttaccttcacccttccaataggatggtttactggctttggatagatccgtatgcagtgtttacatcatcatgcttttcataactgaaccatataatagagctgtgtttccagccaggcatggtggttcattcctataatcccagtgctttgggaggcacaggtgagggattgcttgaggccaggagttcaagatcaacctgggcaacatagtgtgagatcctgtctctacaaaaaaaaaaaaaaaagacattaacttggtattatggtgcacacctgtagtcccagctacttgggaggctgaagtgggaggatcacttgagcccaggaattggagactgcagcgagctatgatagcaacactgcactccagcctgggtgaaagaccaaggccctgtctcaaaaaaaaaaaaaaaaaaaaaaaaaaaaaagtttcctttcctacacactattttgttttccttaatcattatattgttttcttcatttgcttaattttttgtgaactaattatgaattgaaactcaagctctctctcaattttaaaatcttccctcaacatattgcagccaatataagaggaactcaccatttcattttcttggaaacttctaccccagagcattctggctggataggccttgggcatctgtattagtctgtcttccttctgctataaagaactacatgagactgggtaatttatgaagaaaagaggtttaattgactcgcagttctgcagggttaacaggaagtctggctaagacgcctcaggaaacttataatcacagcagaaggtgaaggggaagtaagcatgtcttacctctgcaaagcaggagaaagcgagtgagctgggatctgccacatacttttaaaccatcagatctcttgagaacccactcacactatcatgagaacagcaagggagaaatccgcccccatgatccaatcatctcccaccaggaccctcccctgacacatgggattacaattcaaggtgagatttgcgggggggacacagagccaagccgtatcaccatccttgcatctctcttctccatcatcatagataacctgggcctccggatggcatgagatccccctcctacccggcttccatgactttctctttgttgatctagtcccttttttaaaaatggagccatccttctgtagcttcctgagaaagaatgaacgggaatcacattttctgaaacattgcaagtctgaaaatgtctttattctccctcatgcttaattgaaatcagactgaatacagaattctcatttagaaattatttcccttcacaagtttgaaggaatttgtctattgtcaatagtattgctctcaagaaattcaatgccattttcattctcaattctttatttgaactcggtgtttttctctctggaagattttaggttcttattcttctttgttttctgaaatctcatgaatattatttgatgtgggtctattttgactctttctgttggaacacacatggggccttttaatctggaaagccgttcttgaactctaggaatagattttgggggacaatttcttctttcatttcctgttctctcttcccagaatttgttattcagctatcagaccccatggactgatctgttattttcttatattttctttcatttgttcaatttctttggctgttgtttcccctattctctgaacaatgttctcaaatttacatttcataaactctcattgagtttttcacttctttttttatgttctgaatttccaagagctctattttttgttctttgaatgttcctttttttaaatcatctgttctcatttcatgaaagcaatatgttatctctcagaaggtattaatgacggttttctcccaagtgtttcttttcctactcagcctctttttccttcaagtagctttctttggttggttggttggtgtgtgtgtgtgtgtgtgtatatgtgtattttcgtttgtttttcttttttcttctcctgtgtttgagacatgtcctcaaatgcctggttcccctttagctgacacccacatttaagattgaggcactacaaatatgactgaaagttctgtgcacacaaatggggcctgtcacccgtgggcttcagtggctgagttgtttcatcgggaagcccctgatgttgcatcactgagatttttgtcttgggctgattgaaagctccagagaagaattttctgccctgttgcctggagggtagacacctggctgtcactgttctcacagctaagaaggaagaggactgcgaggttcaagattcagtgtgtaaatgttgactgaagatccctgttttcagtacagagcccctgccgtcctatgcctagagtcctccaactgagagtctctgtgtccttcccagagaatacatcgttcctcttctgccagagtgaggggaggacagatgcctggggtagggatctggggatataaatgttcttcacgagcttccagtgagttcttctgtttttagcttcacataaacacacatatccagtggaaactcttgccatcaactgcacaaataatgggcggctttgcagtgccaaccgggctacttctcagcactctccacctcagtgcaagcatctgtccttggatatgctgccacttaagatggttctgctgtttttcagctctaaaaaggttgttatcatcccctgcctcatgatttgttcttacaccttcgtatatcttaacacttcattccccttttcacgggctttatgaagaagcagtggtaaatgtaggtgctcaatccaccatctttaatgggaatccttcagcacttctattttagaaaaaatgtgaagaatatacatagagactgggcatggtagcgcatgccggtaatcccagcaatttgggaggcggaggtgggcagatcacctgagttccggagtttgagatcagcctgggcaacatgacaaaacccacccatctctacaaaaaaaacacaaaaattgcccaggcatcgtggcacacacctgtagtcccagctaatggggatgctgaggcaggagaattgcttgagcctgggagatggaggttgcagtgagctgagatcacaccactgcactctaacctgtttgacagagtgagaccctgtctcaaaaaaaagaatatactaaacactcatttcacaatattcttgacttattaaagctggagtcatggcataatttccaatttgcttttcaaaagaattaattgatcagctaagaaatttacaagtaatttttttcaaatagtgaggtcccttagtattaaaatgaatttcatgttttaatactaggtttttcctcccacgcagtgaattttcttcttgctttaagaagaaatgctctggagagaatataaaattatatatagttgtgtatgaattatatgtcataggattacatataattatatgtaaatataattacaattataacattaatacatgttcactgcagaaaacttggaaaaaaacaaagagtttaagagaaacttcataatcaactgtattctcaacaactacagaaagcttaaccaatgatttgtccgtatccatggctaagaacgaatgtacctacacatctgtgccatttttaaattggcattttttaaaaagtagatccaattttagaagtttgaaatctagtttaaaagcctagattttatttttttccattttaacctatttatgtatttatttatttatttatttatttatttatttatttattatactttaagttctggggtacatgtacggaacgtgcagttttgttacataggtatacacgtgccatggtggtttgctgtacccatcaacctgtcatctacattaggtatttctcctaatgctatccctcccctagccctcccaccccccaataggccccggtgtgtgatgtccccctccctatgtccatgtgttctcattgttcagctcccacctgtgagtgagaacatgcagtgtttggttttctgttcttgggttagtttgctgagaatgatggtttccagcttcatccaagtccctgcaaaggacgtgaactcatccttttttatggctgcatagtgttccatggtgtatatgtgccacattttctttatccattctatcattgatgggcatttgggttggttccaactctttgctattgtgaatagtgccgcaataaacatacatgtgcatgtgtctttatagtagaatgacttataatcctttgggtatatagccagtaatgggattgctgggtcaaatggtatttctggttctagattcttgaggaatctccacaaagcctagattttctagaggaattcttctctatacagggaaacattgcagtaatgagtttaagtgcattgattctttaagcacatttgtttgttgaatgataagactattgtatgtagttcacatccagccccctacacaactgtcacacacaatgaccttcacagtgattcatgcctgaacaacattgtttcctttgcctttaggcttgcaattgggaactcattttatttgaaccaaagccttcagtcgagatgaaaattttcactcacgtctgtgtgaagagaccaccaaacaggctttgtgtgagcaacaaggctgtttatttcacctgggtgcaggcgggctgagtccaaaaagagagtcagcaaagggagatggggtggggccattttataagattcgggtaagtaaaggaaaattacagtcaaaggggggttattcgctggtggcaggagtgggggtcacagggtgctcagtaggggagcttttgagccaggatgagccaggagaaggaatttcacacgataatgtcatcagttaaggcatgaacaggccattttcacttcttttgtggtggaatgtcatgagttaaggcaggaaccggccatctggatgtatacgtgcaggtcacaggggatatgatggcttagccttgggctcagaggcctgacattcctgtcttcttatattagtaagaaaaataaaatgaaatagtggtaaagtgttgggacggcaaaaattttggggggtggtatggagagataatgggcgatgtttcttagggctgcttcgagcgggattaggggcggcatgggaacctagagtgggagagattaagctgaaggaagattttgtggtaaggggtgatattgtggggttgttagaagaaacatttgtagtgtagaattattggtgatggcctggatacgattttgtataaattgaaaaactatacggaataagagaaggagaaaaacaggtattaaaagactaagaattgggaggacctaggacatctaactagagagtgtccaagggggttcagcataattacttacttggttggcaagtttttgggctctatccttgagttttttatgttgtcatacaccaggccagattgatttaggtaaaaacaacactcttcatttaagaatatacagagtcctcctttttcagcagtgagtaagtcaaggcctcagcggttttggaggacaactgcagctaaagagtcaacttgggcctggaggactgataaagtttgtgatatgtctgtgatgctagcagagaagtcattagagaggctacggaaggtcgtgacagaggttgaaatgcctgctattccagtaccgagagcaatagtagaggcagaaagtcctaaaccgacaagcaagggaattagtggaataactcttttttgtcgtgtcggtgtcatgaggggaacagggagctcttcggtcctatttgcaaattgaattttgggggtaaggaagactagtgtgcatgtgcctgtccaattagcaggtagacacatgtaggtagaggatccacagacgaagagaccttgtgcgaggcaaaactggagatgcaaagtaaagagaagcagtgctgaaaggggtgtcttgtacccagactcctaggtatccagctagggtggcagccgtcagaggttgtaatggggattgatgaagtaactgcgtagagggggaggttcgatttacatggtgtgtgagaaaacgttgagtatctacgagcaacctttcactgttattttcggggctgggtataagtaaacaagaagagggctttggagatgaagagtaaaggaacatcgagaaggtgaaagattacctaagggaattccagtaggtctttgctgagagatacataaaggagcggccacaggaatagtagtttgtgttgtgagaggtctaaatatggggggagtagagttgatataaggagaaaggtttttcaagtaagtgtggaggagggtggcagcttgctgatgtgaaatgtctggggaggtcttgctggacctgtctagaaagtaaatgagttcttcaggagggtaaaagtgagggctgttaaaggaagtctggaggtgtagggagacaggaggtgttgcctagtctgcatgtaaggtggggacaactgtgtaggccctggaagaaagggaaatgcaaagccagtggttgtttgctaaggagggattagaaacggctaggagagaatgagtaaggttgatagcgtggtggagatagctggggagaggtagagggtggcagaggaatgggaatgagaataaaagtgagtataaaagtaaagaatagaacttcgtcagggtgaaagtactggagggtcccctgccagcaaagatcatctatccactctaagagggagttaagagttgccagtcctgggcgggggcaaatcctcgagcttgatgtgtagggaagggagggggcctgaataatccctgaagagtagcagaatagcagatggaagaagttacttccttgaggatagatttccacgatggaaagaaaatgagaggttctaagaggcaggctagtggcttgtactatagcatagcctgcctttgctggtgtgtggcgattaggcctggtggaactgccatcaataaaccaagtgtgttcagggtgaggaacaggaaagaaggaaatacggggaaatggggtgaatgtcaagtggatcagagagatacagtcataggggtcaggtgtggtatctggaatactgtgtgaggccggattgaagtctgggccaggaacaatggtaattgtgggagattcaacaaagagtgagtacacctgaaggagccggggagcagaaagtatatgcatcaggtgggagaaagaaaatagatcttggaagttatgagaactgtagacagtgagtttaacacagtttgtgattttttgggcctctaaaagtattaaagcagtggcagcagctgcatgcagacatgagggctaggctaaaacagtaaggtcatagttgtttggacagaaaggctacagggtgctgtcccggctcttgtgtaagaattctgaccgcactaaccatgcctaggaaggaaaggaattgttgttttgtagaagggattggggtttgggagattagccagacacgatcagcagggaaagcacgtgtgtttttatgataattatgctgagacaggtaacagatgaggaagaaatttgggcttgactgaagtaatgggagctgtctgtgaagccttgcggcagtacagcccaggtaatttgctgagcctgatgggtgtgagggtcagtccaagtgaaagcaaagagaggctgggatgaagggtgcaaaggaatagtaaagaaagcatgtttgagatccagaacagaataatgggttgtggagggaagtattgaggataggagagtatatgggtttggcaccacagggtggataggcaaaacaatttggttgataaggcgcagatcctgaactaacctgtaagccttgtctggttttaggacaggtaaaatgggggaattgtaaggggagtttataggctttaaaaggccatgctgtaacaggcaagtgataacagactttaatccttttaaagcatgctgtgggatgggatattggcattgagggggtaagggtgattaggttttaatgggatggtaaggggtgcatgatcggtcgctaaggagggagtagtggtgtcctatacttgtgggttaaggtggggagatacaagtgggggggatgtgaaggaggcgttgaactgggggaaaaggtggcaatgaggtgtggctgtagcccaggaatagtcagggaagcagataatttagttaaagtgtctcggcctaataagggaactgggcaggttggggataactaaaaaggagtgcttaaaagagtattgtctaagttggcaccagagttggggagttttaagaggtttagaagcctggccatcaatacccacaacagttacggaggcaagggaaacaggcccttgaaaagaaggtaatgtggagtgggtagcctccatattgattaagaaggggacagacttgctctccactgtgagaattaccagaagatcggcatccgtgatagtctagggggcttccgaggtgatcgggcagcgtccgtcttcagccactaagccaagaagatctgggaaggagtcagagagccttaggccagagttccaggggctctgggagtggctgccaggtgagttgaacagtccgattttcagtggggtcccgcacagatgggacatggcttaggaggaatcctgggctgcgggcattccttggcccagtggccagatttccagcacttgtagcaagctcccgggggagaaggttctggaggaatccctggcagctgcagttcaggcgtttggagttcttgtgtgctggagatatggctggggtttgtctcacagtggaggcaaggaattgcaactcagaaatacattgctacttggctgcctctactctattattgtacaccttgaaggcaaggttaattaagtcctgttgtggggtctgagcaccggaatttaatttttggagtttatttaatgtcgggagcagattgggtaataaaatgtatattgagaataagacggccttttgaccttttagggtctagggctataaagcgtctcagggttgctgccaaacaagccatgaactggactgggtttttatatttgatgaaaaagagcctaaatgctatctgatttgggataaggaaaaggagcattaaccttgactatgcctttagctccagccacctttttaagaggaaattgctgggcaggttggggagagcttgtcactgaacgaaactgtaagccggactgggtgtgaggaggggagatgataaaaggattgtagggtggaggagtggaggctgaggaagaattggaacctagctcgacctggcaaggaggggagaggtcagatgggtctgtagaaaaggaagattagaaagactcagcgacacttggggttgggactaaggggacaggtgggagggaaagaaggaagatttgggacaagttgcattgggaacagagactagggagggaccgatgtgtaaaagagtgcctggatgtcaggcacctcagaccatttgcctattttatgacaagaattatttagatcttgtaggatggaaaaattgaaagtgccattttctggctatttggaaccactgtcaagtttgtactggggtcaagcggcattgcagaagaaaataaggcatttaggttttaggtcaggtgtgagttgaagaggttttaggtttttaagaacacaggctaagggagaagaagggggaatggagggtggaagcttgcccatagtgaaggaggcaagcccagagaaaagagcaagtagagacatggagagaaggggtcggggggttcttgccccctagaaaagcggtacttgccgctgagggtgaaggagaaggagttggggggttcttgccccccagaaaagcagagaaggggtagagacatggagagaaggggttagggggttcttgccctccagaaaagcggtacttgccactaagggtgaaggaccaaggcaggcgtccccgtgtggtcagatgcctctgaaatgtgggtgaataatcaggcaggcgtccccatgtgattaaacaccaagggaagactgtcttccccagtccgtgaccggtgccggagttttgggtccacagataaaacgtgtctccttcgtctctaccagaaaaggaaaggaactgaaattaagagaagggagagattgaagtgtggcaccaagattgaaaggagaaagaggttgagggatagtgagagaggttggagaagagagtaaaaagaggccgcttactggatttaaaattggtgagatgttccttgggctggttggtctgaggaccagaggtcgtaggtggatctttctcacagaccaaagagcaggaggacaggggattgatctcctaaggaagatcccctgattcgagtcacagcaccaaatttcacttgcgtccatgtgaagagaccaccaaacaggctttgtgtgagcaacaaggctgtttatttcacctgggtgcaggcaggctgagtccaaaaagagagtcagcaaagggagataggggtgaggccgttttataagatttgggtaggtaaaggaaaattacagtcaaaggggggttgttctctggcgggcaggagtgggggtcacagggtgctcagtaggggagcttttgagccaggatgagccaggagaaggaatttcacaagataatgtcatcagttaaggcaggaacaggccattttcacttcttttgtagtggaatgtcatgagttaaggcaggaaccggccatctggatgtgtacatgcaggtcacaggaaatgatggcttagcttgggctcagaggcctgacaaaaatgttgttaattgctctggttatagacagaatagtagcaggaataaataatcagaaacatttatggattatatctttgttgatattttaaacctatcagttacctttctagcctaatgagaatgccttgataaagccacattcttggaaattttggttttcataaatgtgcttgggttttataagtcctgctttgcctaccacttgaccaaattccctacagacttttttatataaacacctatggttaagacaaaatgtgttctttcaacaatgtacagcttctgagagtaatgtctaggctggagtatattcatatatattatttatgctttcatttaacaaacacatgctgagatcctactttttgccggacttagtactgattgctctctcctgagcatccttcttaagtcaaagagaatattcattgttagggaaggaaaaaaagatagagggaaaaaaaatagatggcaagaacatggcaggaacccagtcctgaacacccaggggttttcagaataagggagaggttaacaatctacatagagcaactgggattaaaaatgggaagctggcttcatggggggaggaatagcattaggagatatacctaatgtaaatgacaagttaatgggtgcagcacaccaacatagcacatgtatacatatgtaacaaacctgcacgttgtgcacatgtaccttagaacttaaagtataataaaaatatattaaaaaaaaaagaaatgggaagctggctgccaagactgcaggaagactgtgtcagattcagagcatgaccatcagcaaggtaaatccctactgcccacagtcataattggcaccagactctaggaaggaattatatatttacgtggtgcctaatggggatgtgaggatctcagagggagaaaactaggtaggcacaaataatacccgcacaggccttatttacacctattttatgcaaagttctaatagaaatcattaactggtttcctagcccttgcaagatccaacacaaattagtagaatgttctagaaggaatagaagtaaaaatatcaatcacagtaagaacaggcagctagatgcatattggcaagagggcagataaatagaaagatgtgagaagtcaaaaatcctattgcgatctcattttgcagggaaccaaagatcccaaatagctctctctggaggcaccagtgtatatattattaaagactcagcgagaaaagacaattcactttaagacagcaaataaacaaataaacaatgtggagctgccattcccaatccatttatctggaatagttcagcctcatttggcaatctgtattttttctgaagccccacggggtcattaaaaactccataggtcccaaatgtatttgcataatgatagatgccatccccctgcctgacagtaaagaagcagcaatttaaaaagtatgatgccagccaggcacagtggctctcgcctgtaatcccagcactttgggaggccgaggtgggcagatcacctgaggtcaggagtttgagaccatcctgaccaacatggtgaaactctgtctctacaaaaaatacagaattagccaggcgtggtggcacatgccagtaatcccagctactcgggagactgaggcaggagaattacttgaacccaggaggcagagtttgcaatgggctgagatcatgccattgcacttcagcctgggcaacaagaatgaaactccatctcaaaaaaaaaaaattcatggtattattcttttgaggaagcatactagaaatcaagaatcaggccaagtgctgaggctcatgcctgtaatcctaatgctttggaaggctgagatgggagggctacttgaggccaggagttcaagatcagcctgggcaggacagcaagactccagtctccaaaaaaatatttttaattaaaaaaggaccagtcttattaaagtaaactgcagtcctgttactgatcttagtatcaaagcaatgttagagcccacgtgggattcacacctcctagagttcacagcacaagtttgctgtaacagtagataaggtcttggttgccctgagctcatttcttttttttttttagacggagtcttgctctttcgcccaggctgaagtgcagtggtgcgatctcggctcactgcaagctccgcctcccgggttcatgccattgtcctgcctcagcctcctgagtagctggaactacaggcaccacgcccggctaattttttgtatttttagtagagacggggattcaccatggtctcaatctcctgacctcgtgatccgcctaactcggcctcccaaagtgctgggattacaggcgtgagcctccgtgcccggccctgccctgagctcatttctaaatccatcttcctccaaggtggtggcaagcatgcttctttatcccggagagatggccctttcatcaaagtctcattcagacccttctccttttggaatgcttttcttgggaggttggctgggatgcctactactcttgaggatctgcctctgatagagcctagatcttagaatcaggagagtttcttgcaggcccatcagttactgtgaaagatacctgagctagttggctcacaatccacatccatcaaaccgccccctgcagagaagtcacccggctgtcgcctgcttggcttgccctgcctctcgccattctcatttcattagcaatgcgaatgttcacacccttcaatgtgcatatgatgggtgttaatgagcataacacatctgtgaagcgtgtgtgatttttttgcctaataaataggcagtaaacaagaggaagggaagagctactatctgggggcatctgagaaaacaaaaagcaagcaaggtatgagtcagattgattgttcagtgaatcccaaagggccaaaaacttcctaaactggttttggtgtttctcactaggtgtttggacagcttggaacctggatagtcccacctacccaaaagcattcaaattaggcatgcttttaacaaagcaggtggcatggcatgtaaattgtaggaacactgttaacctttgcaaatgagtttcgtggtccgaatggataattacatatttccctccattaggagctacaaactcatcaagattctacaaccaaccggctcttgagtttcaatctccatgtgacaaggggatttattatgagagggcagagagaaaagaggaacaccgctctctttctctgcaatggaatgatggtcagaaaagaacagatcaaaggaataaacctgctctcctattaactcagcttaccaattctggcctacattttcaaagttatcagtaatcaaaacattgggaaaggaattacaacctcttctcctgaaagtttaacaacttccccatgaagcactgcttttgattgcattacaagctattcctgaagaatttatgacctaagatactctttgtcaatgtaggccatttgtccatgagtggagtgactgataaatcagctattaacatagataagaaagcatatcgattgagtcaactttgtgtttaataatatgctagacagtaatgatgcctggaaaatacactctgtaattaagtacttttccctttatatttcatgaagactcttgtatattttattctggcaaaatagattgtgactaacatctcatagaaaagatcatcatattgtgatcctatatctttatcataaaagtgaatttgagggaaatttttataatttttcaatataaaaattattaagatatcaaaactctttgttttttcactactccaaggtttatttcatcatcttaaaaaccttgtgaatacaatcagtctgctaggtcaggggtcaccaacctagggccatggacacctaccgtggcctgttaggaaccaggccacacagcaggaggtgaatggcagacacgcaattgaagcttcatatgtgtttacaactgctccccatggctcgcattaccacctgagctccaccttctgtcagctcggcagcaacactagattctcataggagcacaaacccgattgtgtactgtgcatgcgagggatctaggttgcacactccttatgagaatctaatgcttgatgatctgtcagtatctcccatcacccctgagatgggaccatctagttgcaggataacaagctcagggctccccttgattctgcattatagtaagttgtatagttatttcattatatattacaatgtaataataataatagaaataaagtgcataataaatgcaatgtgcttgaatcatcccaaaaccatcccctactcccctagtccacggaaaagctgtcttctgcaagactggtccctggtgccaaaaagattgcagaccactctgctaggtagaactgcattcttgtgattatgtattttaatgagcgcatttccttttcatatggagaagggaaccacattgccttaattccccaacttctgccccaaagctttctaggccaatatggctgcattcgagttgctgatggctgtgctaccctcccagggctgatgtacagtttcctgcctgggccgtgtcaccaatcactagggtttaggaggctatagtcagatcttgcagaatatgtcagtctcattctctgtagaattttttgtttgcctgtttttttcttctctttggcactggactatgggcagtggcagttagtggtagatccagggtggagagctgagacctaacaaagaatttttttttctttttttttttttttttttttttttgagatggggtctccataggtcacccaggttggagtgcagtggctcaatctccactcatggcaccctccgcctcctgggttcaagtgattctcatgcctcagccacccaagtagctgggattacaagcatgcaccaccatacccggctaatttttgtatttttagtagagatggggtttcatcatgttggccaggctggtctcaaactcctgacctcaggtgatccgcccgcctccgccttccaaagtgctgggattacaggcgtgagccaccacacccagccaacaaagaatttttaggttcccactattccaccccacctgtgctagaccctgtggtgacaacaaaggtgaaacagacatgctgactgtcattaaaacactgacaatctaaactaagaaagatgaaaaaaattaattgaatacccagtggaaagtaagaaggaatagttttaacctccttaaaatgcttttgattgcattataaactattcctgaagacttaatgatccaagatactacttgtcaatgtaggctattcgtcaatgagtggagagactggtaaattggcagttcatgtgatacatacgctttcagagtaaagagaggtttcttctaataatgagaggagcgcctggccagagagacccaggaaacatatgcaaatactagaaatagccccaagtagcaagtgtggctatagatggtacacgtgaaggagagtagtggggttagaccgtgaagccacgaagaaccaggttaaggaatttagacttttatttggtaggcagtggagagatgttgaatttttttttcaaacagtggagtacagtgaggaaggcaggagactttgcagaaggaaatcaggaattccaaccaatgtgttgagtgtaggattctaaatccagcacaaaaaaaccttcaaagcagcagggaaagggtttggctctgattcagcctcagtggttatactgttgccatcagggagctgggcttgggggtggacagaggctggtggcagagggagggatggagggacagagctgagtttttccaaagcagaagaagacggttttgcaacctagcacaccatctgggtcagatttatcaaacaagattatttgttgacagaccatggttatttcccatttaaaggaagcaatacatatattgtatccaaaatggctccccaaaagcagcgttgagctgatgcaaaagatcagtccattctcccagcaaaagagcagtctcttgacatcccaggtaggagggattcatgtatttcacaaaatgtgtccaatgcaatcatcaggcaaataatattttaatgttttcttgacatgctgagagtaaacttgcttcgatgcactgtctccttctaggcacattactctggagtaaaagaagagaggaaagagacagaggaaagaaaaaatatgtaatcacatatgaactgcaaaagaattctagctgaggttcttagaactataaattcttctttttttttttttttctgagacggattctcgctctgtcacccaggctagagtgtggagtgcaatggcgtgatctcagctcactgcaacctccacctcccaggttcaagagattctcatgcctcagcacccgtccccctcccccaccccaactagctgggattacaggcgcacaccactgcgtctggctaattttttgtatttttagtagaaatggaggtttcaccatgtcggccaggctgctctcgaactcctaacctcaggggatccgcccaccttggcctcccaaagtgctagtattataggcgtgagccaccgcacccagccaagaactgtaaattcttaaaatttgggaggaaccatcaagaaagaaagcctaagccttgtaaccatatgccaacctacattggtctactccctctgccacgctaggcatttcacactctcgtacactctgagggaaactcgagaaacaagtgtaataagaaatattcccgctagagcatggcagccataagctaccaaatttttgttataaaatagaaatatacttctagatgtaaacatgtatatgcttatatctaacctctctaggataacttttgtaagtggattttaatataactaaaactggatgctaaagaaatagccctctcttaaagttgtacttgggcacgtctaggatcaaaaagttaatagttttgtctgtgatcaaggagttaattttttgctgcaatatgtttacatctaacattcttttgagctatccacaatctggttatatatcagtttatccaaccttatttctcctttcctacttcaaagacctccattcaagccgttctccaagctcttgcctaaataagtagttttgttttgttttgttttgttgttttttggggttttttttttttttcaaattttttcctcacttctaagtttcattcagggactacctttccccacttcccctcatcattctctttttctaaaatctatccatccttcaaagcccaggttgaaatttgtcctcttcctgaaatcgccccaaaaatgtgccaaatcattcagatctctgccatctctgagtcttataaatcaaattcttagtggcattcatttgactaagaataataaatacatcactattgttataatcaccataatacctggtgctgttgttagatgctttacctatgttacctcttatccagacaatcctgtcctatcacccccattttacgtgagaagaaaccgaggttcataaaggttaaataactagtccaagttcacatagctagcaagtgacagtcataatagtggttcagacccagaaccgactggcttaaaaatccatggtccttcttctgtgccatatggcttcccaattatggatttcttttttttttttttttttttttttttttcagattgtgatttaggtttattcttttttttttatacttaaagttttaggatttcttacattactttttaacaaacgtattttgtgcatgattctaagaggtagtacactttttttttttaattgtttgcctcattttcccaccatgcctacttttcactttgctgaacccgtatagagtgtctggttaatgttagagaaattgaattgaattcctgacatttgggcccttttcttgagttcctcttctttgtccatagatgaatcatcccattacatctaactccgttggacagcttgcttcttcctcaattgtatgtgaatagttttcaatccactttactaaaatctaatagtcaccatctgtgtctgctatataaatgtgaactcttgaaaacactaacatttgtgggtcagaaattagaggacagtaaaataaaccactggaactgtgaagagggaggaggcgtgaagaggcactcccctctctgctgtctgtgggtcaacctttccggcctgcctgtttctcaaactgagtgagacttgtctctgaagccccattttttttttttttttttttttgagacggagtttcactcttgcccaggctggagtgcagtggtacaatctcggctcactgcaacctccacctcctgggttcaagtgattctcctgcctcagcctcccgagtagctgggattataggtgcacaccaccacactccactaattttttgtatttttagtaaagacggggttttgccatgttggccaggctggtctcgaactcctgacctcaggtgatccacccacttcggccccccaaagtgctaggattacagacatgagccaccacacctggcctctgaaaccccatttaattttccaaatgaaggtgatgtgtcccaggcatcatacataggcaagaacccacaaagtggcagaggagcaggagcaaaggggcctgggcaccccctggaaagtcatcatacagctttactcaactgtcaccttctcctggccttccttgaccactgtttttaattgcaaatcccactgcatgatgccctatccctcttccctgacttattcttctccataactcacattttcaaagcattctatgcatttcaccaaattgtttgtggcccttctcctcccaccagaatgtaatttcaagagagtagggatctgaggtcgggcgcagcggctcatgcctgtaatctcaacactttaggaggccaaggcggttgggtcatttgaggtcaggagttcgagaccagcctggccaacatggcaaaaccccatctctattaaaaatacaaaaattagctgggcatggtggcgggtgcctgtaatcccagctacccaggaggctgaggcaggagaatcacttgaacctgggatgtggttgcaatgagccaagatcgtgccactgcactccagcttgggtgacagagtaagactccatctcaaaaaaaaaaaaagagtagggatttgggtctgttttgtactatgctagatacccagcacccataacagtgtcagacacataggacatgtattgaatgaatgaactgatttataagcagaatatttaagactgttgagaagccatacccattctaatcaggcagagcagaaggttaaaaatccacaacgcttacttttgagttgtgttgaaaccattgaaaatatctgtgtcaaactgattaattacctcggtttacagaatcagctttttaacatacatagcaaattctatatgctagccaatggcaagccagatctcaagcaaggccattcttgtaaaataaatggacagatttttgtcttttctattgtataagattctaaagccttgaaagcagtaatatagaatctccttaaatacaaatttaagcatcttttcacgtttatggcctcagtgcctgtttataaaagtagttttgtaagaaaaacagtgtaagaaaaacatctaagagtagatgataaagacctatccttgtgtgaccttcagatggaaaagcatagatttaatctgagattccagaacccacctagtttttaacttcatttgtttgtctaacttaagaacgtgagtcacaactaacaaagaccatctggtgctgttcttccctcctaggagaatgtctccagaagtaaataaaggagaatcttgtccatgcaagctactctcagttccaatagaaaaccatttcagcatctaattcagagagttgcacaggagatggccaaaggcactatctgccatatgtctgcgtctccagcccagccatgaccccaaaccaatagatttatttttaggtagtatcatgtaaacatagaactttttaaactagcaagttggggaaacttcatgattagtcaatctgctagcacatagcagaagctggtgggtgccttcccagcagccagctcctctttctcctacctcatagcaccccagttattttcaggcatctaccctcctccacacagccaagaacttcagggaggctatttccttccccaggcccaaggagcacagcgtggaaggggaaagagagaggttcatggacggctctaccatgatgccatgtgtctgctagtaaacttctactgactgactgagcatgccccaggtgaaataccctccagtacctccttctgtttttggacttacctgttgtctttctccaacctggagactctcaacccttactgcaaattactgccacgtggggagcttttaaaaacctgcagacacccaagtgcacccaagagagcctgtttcaatggacctatgcaaacaggtttttttttttcattaagttctctgggtgattgtaatgtacagccaacaatgagaaatgttatactaattccattactttgaccctgtctttgagatgctttgggagagcttggcgctcaggaccatctttggggatcttttccatcatccagagggaagctggatcttagagtctggcctctcggttatgggtcctgatgttttttcattgtgtatggtttccatgatctgtcctctgcaataaaacagacattgctttctatatgtaattctactcatccttttggggtctctcttcgttaccatctgcccttccatcttgccatctcactcctcactcccatgattctggaccaaactaaccagcattcctaatctagtctcttcttgaaaggatttgaaacggggaagcagctcttcaggaaagaaaataaatagagcaaatgggccgggcatggtggctcacgcctgtaatcccagcactttcggaggccaaggcgggcggatcatgaggtcaggagatcgagaccatcttggccaacacggtgaaaccccgtctctactaaaaatacaaaaattagccgggcatggtggtgggcacctgtagtcccagctactcgggaggctgaggcaggagaatggcgtgaatcagggagatggagcttgcagtgagccgagatcgtgccactgctctccagcctgagcgacagagcgagaccccgtctcaaaaaaaaaaaaaaaatagagcaaatggaatgaagaacctctgtagggctgtgttgatttaaggcagatgtgggccacagttttggtgttcacacccaggtaaacaaggcagcttccttctgctcatacacgtgctcccctctggaagagccaggtttgcaacgggctcgcagtggctttctcatcctggcagcatccagtttcttgtggacgttgctgcatcccaaccacctagcagattacacgaaggagtgaaatacctaccactgaaaagaatgaacccacagagaagggtggcctcactgctcccaggggctgctgcagtggcccgtgggcagctagactggcctgcaggggactgaccctggtggacgcctgagtctatgtgccaccatctaccctgtgataagtgtagctccgacatgatgtacctttgcctgttgatttccaaggacaattattttagcatttcaaaattcagctcaagtgctggacgacttctccctgagttttgctgtttgccagcagcctcctcttggcatgctccctttccaacatcctcactgaacttgttactattaccaccatgtacttagagaatgcaactatcaagtgctattgaacacaccttgttttgtaaaaaccctgttgtaaattgcctccttattcctctgttccatggccagtcaaatcacaccctcatgtaaatagtgacaaagacatattacccaacttcaaattccagacacctgagtcacaggtgttgttaccactaccccaaaccacaaagtgggattatgtgtctcctagaaccgtattataatagacactcactgtcttgcaaattgctcctaacttgggtagaatattttgtatttattacttttgaaaatctatgggtttctattgcctggaaactcaaggattacagcagaattagagaatctggtctctggatcacagatccccccactgccctgcaccgcccccacccctttctcatggagacctaatcatctccacactggatccactcacatggatcttctgaccttgatccagagtttacaggtaaaatgtccacctgaggacactggtttctgttttgacaaaggtagttagggccttggaaagttgtgaaggaatggcatatctcccagaaccctgacttccatcagcatcttattccaggagctctgaggaaacctctaaggcacaagtgtggaaataaagaccacccagatgagaacacgcagaggctatttattcagagcttgctgtagcaagagagtcagccatcgtcacttgtgcctggcagagactctgaggcaagcggggagtgggaaagctttcaggtggagagaggggaaggctggggtgtgccggggctggagcttgttggcccgggaaagctggaggagggctgcctgacacaggaggcatcctgtgtgattggtgaggggattatatttggctccctctggttggcctaaagttggcagcagggacaaaattagggaatctggtatcaattgatcatttggggccagcttcctggaatgtctgctgcagattgtgggtcagcgtgctgttgtcgcatatggccaagctgttgtctgtctgtagattccatctcttggtgttcaataggccttggggccatgaacttgtagggagggttttctcaagacctgggttatggaaccagcattgaggttcacagaactcacatccaccctcaaatcagggctgggtcacagacagtttattcaagtgctccaggcacctgtcccagggtcattctccctagaaagacccaaacaagctgggcgcggtggctcacacctgtaatcccagcactgtgggaggccgaggcgggtggatcacaagttcaggagtttgagaccagcctgaccaacatggtgaaatggtgaaaccccatctctactaaaaatacaaaaattagccgggcatggtggcgcacacctgtaatcccagctactcaggaggttgaggcaggagaattgcttgaatctgggaggcggagcttgcagtgagccgagattgtgccactgtactccagcctaagcgacagagcaagactctgtctggaaaaaaaaaaaaaaaaaaaaaaaaggcccaaaccatcccagggaattcagttcaagccacttctccctcactgtgttctccatgctgctgcctggggctgctggccccctccctgtctgcaacggactctgacccctggaccaggacacccagcaggctccccaggaccacagattctgtctgaccttggggattctctggtgtttctgaaaattgctgaaagcttccagtggccattgctatgttatttgctagtcggctaaaaagttaaactccatttttatatggtctagattagaagagaggaagaaacactccagaggcatcagaggctcaagaaaatgcctagaatgaagttcagaccatcaagaagtccccggtggctcaggcacattcactgtttgttcattcctctgacagtcacggacagccccctgtggacaaggcatggtggcgggctggggacagtcttctactaggaggatggggaagacctgagaacagtgcaggaacagaaggaacaaatgtgcgggctgtgggtcacagtataataggaacacaggacagaggctgaagatggccccaggatttgagttacgaggccagtgctgtgctattagcaaccaaggggacctggaaaggattggaaggggaaggtcttgaggagaggctcctggtaggttttttctgatcaatagtcccaagggtcaaaaatatcaacagtgacagtcagtgctgggatcattctccctcacagatctgaacccttgagtatgttgattttaatgacagggacgttctttatccagccttatgcctgaccaactctgattcatccttcaagtgaggagatatctcttcaccctcgaagctttccctgatgcacaccccccgggccagggcctgccccagagctccccactgccaccatcacttccccagtgcaggcccttacccccgtctggcctgttgggcttattgactgaggcccccaccctccccagccagcagcatgcctgccccacaaagctatccagcaaatacagattgagacacaaatggatgaaagacatggaaggaatgtatggatggaatggagggatggagtggacacatggaatggatggatagatggagtggatggatggagtggatgggtagaatggatggatggagtggatggatggagtggacggatggagtggacagatggaatgggtggatggagtggatggatggaatggatggatggaatggatggatggaatggatcgatggagtggacggatggatgtaatggatcaatggagtggatggatggagcagacagatggagcagatggatagagtgaacagatggaatggatggatggagtggacagatggaatggatggatagatggagtggacggatagagtggagggatggagtggacagatggatggagtggacggatggagcagacgggtggagcagagggatggagtggatggatgaagtggacggatggagtggatggatggatggagtggatggatggagtggatggatggaatggatagatggagtgcacggatggatagagtggatggatggagtggatggatggagtggacggatgaagtggacggatggaatggacacatggagtggacggacggagtggacggatggaatggatggatggatggatggagtagatggagtggatggagtggacggatggagtgggtgaagtggatggagggaatggatggatggatggatggatggagtggacggatggaatggacagatggagttgatggatggaatggatggatggatggatggagtggagtggacagatggaatggacggatagaatggatggatggaatggatggacggatggagtggctggatggaatggatggatggaatggacggatggagtggatggatggaatggacggatggaattggatggagtggatggatagagtggatggatagagtagatggatggaatgaacgcatggaatgaatggatggaatggacagatggatggagtggatggatggaatggacggatgggatggatggagtggatggatggatagatggagtggacggatggaatggacagatggagtcaatggatgggatgggtggatggatggatggagtggacagatggaatggacggatggaatggatggatggaatggatggacggatggagtggatggatggaatggatggatggagtggatggatggaacagatggatggaatggatggatggatggagtggacggatggagtggatggatggagtggatggatggagtggacgcatggaatggacggatggaatggacggatggaatggatggatggagtggagggatggagtggatggagtggacggatggagtggatggatggaatggatggatgggatggatggagtggacgtatggaatggatggatggatggatggatagatggagtggacggatggaatggacagatggagttgatggatggatggatggatggaatggatggacggatggagtggatggatggaatggacggatggagtggatggatggaatggatggatggaatggatggatggaatggacggatggagtcgatggatggagtggatggatggaatggacggatggagtggatggatggagtggatggatggaatggacggatggagtggatggatggagtggacggatggattggatggatggagtggatggatggaacggacggatggattggatggatggaatggacagatggagtggatggatagaatggcctcctctttgtctaaaacccccagtagctacgaattcccccaacaactactacacactgccctgcacatgatcacgttcggtaagttgtgtgagagggcaggagggagaaaatggagctgcctgcctgcctcacgagcacctttcaccattttgatcacatttccagatgcagcaccaccctctgctctcacttctttcctcccagaccagggaagcattggatggtggttcatgaggtgctggaggagctaaagaaattgctgtcatcgttttgtcaaatccagggcctttatgttttaaaatagatatacaaagagatcacattttacctggtaaaatcatgacaaactgagcggacaaaaaaaaaaaaaaaacctataaacatttggcacaacagagcaaaaatcataattcctataattatttttaaactgtgaaactattgtagagcattgaatagatgtatattaaagccatgtatgctttatttgcttatgacatgaaattctggtttctgtgtgttccaccttcctattttattcttaggataataggatatgatgtgatgctttactcatagttagagggagaattgactgtgaatgagcagttcagagagaaaggatcttgggcttggcaagggcaggggcctccagcgttttgagaaaaatgaattgagcctcagcttattttataaaaatcttgacccagagcgtggcccttctgaactcccaccatgtttatgcatggtaatatattaaaaattggacttagctagtagccaaatacagtgctgtgttctggatactaaaacaaactaattctccctgctaagtaagaaaaatttcacacattatcgtcagtcagacatggaaagaggttctccaggggaagagagagaagcaacatcattcatgtgatttaaaattacaccaggccatccatttatctgcctctcaggctgtttgtccttttttgaacgatgcttcagggctccacgctggaaacggggagggtggatgtagaacagcttgtcaatgtaatcattttactataaatctgcaaaaaaagaaacagagcctaaaccaagtataaaataggatcacagaacctcctatgagcaactttgtaagattatcctttctagtgtgagtactaccacaataaacatgatgacatatcctttatcactatgttgcccaaagattttttttcagatttcagtggactcctcccctgccactcttaacagccctgctcctccaaacatagctgtatggagagagatgtccatcacagggatgtttatacaaaaacatcaaaacactcattttttcaggctggaaacggtggctcacccccgtaatcccaacactttgggaggacaaggtaggtggatcacctgaggtcaggagttcgagaccagcctggccgacatggcaaaaccccgtctctactaaaaatacaaaaattagccaggcatggtggcacacgcctgtaatcccagctactcgggaggctgaggtgggagaatcacttgaacctgggaggcagaggttgcggtgagccgagattgcgcgactgtgctccatcctgggtgacagatcagattccatctcaggaaaggaaaaaaaaaacactcattttttaggtgaagttaattgactgggaggactttatggaacattttggttcttttcctactgctgaaatttgaatagaaaggcatgaggtaacctcatgccatcactacgaaaggctaccagaaatgatagaaaacctcacacagtatcagctacattggtggagtccacctgaatcccagaaattcagttcaacaatgtcactgagttcaccagactactgggaaagggattcatgtagagacagttgtaaaaatattgaccctaacagagaaagattcactgcagtcagaagagatgccacgaagtcaggtctcaactcctggagaggctctttctgtgctgtgcaaaaatgtatgtttatccgacttcccaggccttgaggtacagcaaggaatgccagtgttggatgttctacaagtgaggacactggagcctcaagaaataatctgacttgcacaactcctgtcactgattagtggctaaggacatcctgatttctgctccagaactttccccatgacatcagtcttcccatccttgaagagttttcagttattcttagcgtgacaagtgattgctagagtttgtgtaattttcatcataatgggactaatgacccacaacagcagttctagtgacttccagaagatgttgtacatccccatcctaatgaatggcagcagcatgacttacgttcttttatcagagagtctagtttgatctgagttgtgtctgacctggaattcaggcatgtctggggctaggaaggttttgggttcgaggaggctgttttcatgagggatcccagggtctcttgggaaggaattcactcaagggaggacagaggcaagagaagcacagttcactctcggggctgaaggcagcatgggttttaggtgcagcctggtgacagtcaatcgggtggcctaccatgtagtgattaagactttggaaaagcaggctataagcaaaaatctaaatttgctacacaataacttggcaagacaatggagcagtggctggcaccatggaccttggtaagaaacactagaaaagttaggaaaaggggtttttccaggtcagagagagccagtgcatgctggtggacccacagttctgtagctatgagaaatagccccatctggttgtgcaggaaccacaggctgcactagctgctttagttgtgaccgcagaaagcaccctgccccagcatggagcaccagggcctgcacacctttgccaggccccagaagcactgccactgccatgatacccaagaagagagagattagcaagtgctttgtaccagaggggagggctgcccatgcaaaggcctgcctgggggaactccagcaatcattgggggagactttgggagagtggagagaaggggcctcctgaaaagacacagccaggggaaacctactttcatgatatcaagactctaattttagagggcagtgtttgcagatcctaccaatgactctttgtccttgagtctgtgtttgaggtggaaccactcaaagacggggaagatgaggcacctggagccaggcgcctggtctttgtgtctgcacttagccaaattccctctcagctgtattgtgtctggaggaaatagaagcatgactaagctgatttgtattctgccaaccaagggaaaatataattaacacggcagcaagactcagcaaaccccatgggaaagtccaagaaggaaagagctcccgtggctcaagatgatgtcagaggcaaagagaggccaacccactctaatcccacagcaggtctcctctctaatacctcaactcataaagggaaaagacaatgaaatccaggcctgccatgcctttgaaaagaacacacagcctctaggagtgattgcagggattgagcagactgtgatgggggttttctcatgatgggagtctcctgctgttgctgagtgctgccaatcactgcccacacctccagcagggaggtgacttcctcaggctctgctactccacatcaactgattaacgcagctgtgatagcacacctagcagagacaagagactcccagacactaggcaggagtgagaccaactgctgtatcagatatacacctagcttataattacgtgtcaagagaaggaagattaggcagacatcagtaaccgcaagaactgaaatgtgatggctggtatccatcttcagcctgctccccagctaatcatcccctaaaagaaatgcgggagaaagctgcctcctaatacatttcattggcccttcatctccgtctgctgactcacatttgaatttagagacaatttgctaaactttctagatttttatttacttaacattgccttagcctttttgatatattcaactatagtattctccaggtttaaatattgtacgttttttttcacaactttaacaaattagtgctcagttctcctggcttgaaattcccatatctttcatgaagctgttgaaactaaaaggcttaggaggaaggtcacccacctccctcattctccttcccttcttgcccagaggaatttatgtctgtcttcctgccccaatatctacatatccagccatgactacattgtttggtttaagtaactgcctctcattacagaactagattcatttattcattcattctacaaaaacttgaagaacatttatgctggatttgaatccagtgtcagaattgtctttgattggttctatcttatttcatagatttggggtttgaatttaatagctaagcatataaatataattttatgcaagatagcaccttaattctagtccttatttaatacaaatagtgatataatgaaatgatatagttttatctagtttcatctagagaaatatggaaggaaaaatacaaatagttaaaaaaaggaggaaggctgaaaatatatagcagttgatatgcttctcagagtcatcttttactaatcagtagcagtggtgatggtcttttaaaaaaaaaaagtttcggttgcttttaaaaagagatttccagtgggaagcctgtgagtactgactggctcctgtctaacctacacttcctgtttggttgatgaaaaagaaaaaaaaaaaagccaaaactaaaaggtacattccagaacaagtagtcattttaacaactggcggagccaagaaaatgcgatctagtttccctctgtcccccagtctagagccattattaaataatttaatgccatagaacttatatcaaaaatagacacattccttaggaaacatttgaaacttactggttttgaccttaaaatgtaatcattcatgaagagatcaatctttcatatgttttcaaatatgaaacactcaagtccattgtcagaatcccaatagtgtggaaagaaacctaccagggcaggcttatctctgctcattctttgctaaaatatccattgcatttgctaactgtgaaacgatgggtaggttacttcacttctctgagcattgaagatgccctgtctacaaaggataacagtctctctcccaggggtagctgtaattgtgaaattaggcaacatatataggaaggtgcctaatggagtggcaatcatttattcattcattcccgaaatatttatcgattggccacaatgcccaggcacagagcaaggtgctagtgatatcaacacgggggacacttcacatttccccccattcctccctaacggtgcagcagacaccccactaaagctgaggaggcccctgctgctccccctccctctctgctccctgagtctgtgagaggcatcgctccagcctcccaagaaagccctccccctgcacatccaagcagctccctcttatcctgatgccctgacccgcctgcccacaaggagcctcctccctgagccgggaggactttccttctctcctatgacaagccctggccctaggcagctgaaaacaatcacccaggaagctccttcaccgtcagattccctgacagccctggatctagcgagaatcaggtgatttcgatgtgaaacgaggtttgggaaccactgctttcagtcacattctttttgtttgatcttctcagaatcagcaggcatttccctctgctactttgtccaagatccaacccttctcatctgcgtcttgccagtctctccactttagagctttgttaccagctacttctaacctcttgcacagaaatctctactcaccactgtggagagtgaaaaaggaatgggtttttatgtatttctagccagctcttggccctgcgccatgcagagtatatgctgtacattggactttcgggacacttctctgttaaattctaagccttatgtctgtggtgtctccacagtgagtaagctcttaatcacattccctattgtaccttcttagatgaaagagcaatgggtcagggggactttttaaatgtccttaaacttgattagtttaatctttattatggctacagaatgtttcttaaatttacatacgataaaatccactattttatattaagtagagttatgagttttgacaaacaaatatattcaggtagccaccaccataatcaacacacaaagcaatccattacccccagatttcccttacatcctttgttgtccccctcatcctgtacttccagcccctgagagccacttatctgatttctgtcccgacagtttgccttttccacaatgtcatgttatataaatggagacatacaatatgctgatgtgagcatttagaaagatcatgtatttaaacaattattagagtaagggctggctatggtgacttaattttttggtttctgacacctataatctgatttgaagtgtgtcattctgtgcatcatgatcctttttgcagaacctgtgtctattagaaaatccagatgaagcaggctcttcctgttgtccttcatttggaaaagacagaagaacagagcgctttacgaaagtcaagttacagcttcctaattttctctcccatggacaaactcttccctccccccaccccgacctagcctcttacccactatcctttgcaaattcctatctcttatattgcccagtaattggggcgtgggggggtgaggggggggtgagttactgctgatgaaccaggaggcagagcaaggtttattttgctaaaggcttcagctgctactgcctggacctcaataagcattttctgctctttcctatcactactgtcttccctttctttgagaagcaacataaagataaaaagaaaaatacttgattttgtagcatgccagaatattaagatgctcctgaaaagtgtgggatttaaggcttctcaaaaaagagcagaggagggagtgagagaagaagacggagaaggaggagaaggggaagagaaaggggaggtggaagaagaaaaaaccaccatcagaaactgagtattacacaggacgtaacctgtgctctgagagtgaaggaggccacacagcagtagaaccccgacaggaaaatcagaaaacattatattttttcccagatcccagagtatcagatgttccattcagaaataatccctattgacccagtctctgtgtctctctctctgccaatagcatcaagcacagtaaccctttccatgctaatcccgttattaatgccatccacaacaagcgtagtgtaagtaagacacgaagtgtaaaaaaactttcttccccgcagtccgggctctcagagccctccttgtaggtcaacagtatcaaaggtgcttaacgcagatacaccaggaggctcaaagcccaaacatcgaaaaaaaaaaaaagacccactcttgtgctgtgtgtattgcccacgggtgggaggatgcaagtacaattacgttttttaaaactccagtccagatattggcttttccttggatacttttgtgtggctctcccagtacagtcagatccgccgccgcagcctagcgctccaccccgggttttgcgtcctcccctcacctgcctttcagtggtgcggggtttgatcccgagagcggtggactcaaagctgcccgccgggactcgggctgccggccgacaaaggacggtcctcgggggttctgaagtctgacccggccagtgggaaagccacctgcatcacaaagcgaggggcacacctgaaccggggctggcgggaagaggcaagtattgcgcgcgggctggctcccacatggagctgcctcccggtgcaagtgttgcaagggtgcgctgctccagcccggggagcgcgggaggcggcggagagagcgtccgggtgatgagcggggcactgtaactggattttaacacctctgcaagcagcgcttttggtcaaaaaatttccgattcttgatcttctctctgcaaggtcgggggttctttggggagtaaatcacagcgtttgggtttgcattcgaagcactaccaagtctactccacagggtcactgcacggggagcaagtaaaggaaaacgaggagaatctgagagtgctccttcgtgcagtgtgtgtgtgtgtgtgtgtgtgtgtgtgtgtgtgtaggcaaagctgagatttacatggtgtgaactgttaaatgttaacagttaaatcccacacttttcaggagcatcttaatattctggcatgctataaaatttttgagacttgtttaaagaaggggacttcctttttaatttagaacaaattagtagttgttataacattatagatactaatcagtaacaatactagtaggtaatgctttctgtaagtagacacaccccaaaagtatctgaaaagtatcaccaaaacggagcgtgctttcacactcctgcaaaacaaattagcccttaaacagaataattaacatcccgagggaagataaagcatataggttccttgaatcattacgttacatttaaagtcggtcctgttcagtttgcctttgtccctaaggagtaaaaatagcatcaaattgcttgtttggttttccccttttgaaactcagcatagtgtttggttatccatgaaggtggctttaatatttcaccctcatatttggcagacagttctggacttgctcctctccccgtagggactgagtcccactggcagtgtgtggagaatagaattgattctcgctttttctttgcataatacctaatcatcaccattagcacttcagacgttcacagctttctgaataggtgtcatttcttccacataccctattgatttgcatcattaacaattgaaaggaagctcttcttttgattaagaagccaaacaattaggaaagcgtggattctttcatagtatttattgagaggcgtctccacctgatctaggctgtgtttaatgggatgagagagactaagagagaacagaaagtgtaattaccgcctctccaggcccgtctttactttttccagaaacagagaattatgaaattatttgtaatgttacaaggacccttggagctcttctagtgcaagtcaagtttatttcacaaacgggaggtctagacagcctttgtttcttctgaacgggtctgcaaggccaagatctggattctgacccacagcgactgctgatccaggaattccatgcacatatgctatgcacttagcgctgattgtgaagaaacaccaaggtggcccgtcaagacctgaactaccacaggtctaacttgggaaagcctcattcctcacgttctttccgcttctactgtaatggtactgtgcctcttgccagcccacacttattcatttgaaatgtgcactttggaagttcactgcatttaatcgattcagaggatttcttttttttttaattttttttttaatcagtagctgagctatactacctagttctaatccgtaatagtgtgttaaaagactgttttctgtgtagttgctggctgttatttaaatcccaaggctgctgaaagttggtaatagaaccaataatagcaaccattactcaaaagtctattgcttactattaactataataattaactattaagtattgatattgtccccatcaatttttaggcgttacctaacattatccccattttacagatcagaaaacggaggcttcagaaaggtgaagttactagcccaatgtcactcaccttctaaggtggggagcagaagccaggttggtctgacccctaagctcatggtctttctatactaccttagtagtatagaaatgttctaactttcacattcccggatgtctgagctcaagacaaattttaaataaattagcgtggctttgatgttctctcactagtgaaagggtctataacactttaggcaaaatgcattgaaattatgttaaaccttcatacactgccaataagcaatgacttcccagaaaccatactccacatttgacccagtctctaatttagtgagaaggtgagatgcatggaaagaaggcaaaggagagtgactagtgacccccagaaaagggaatctcttcccgaggtttgtgttgtgccctgtggagctgagaggagagtagggaattgatggagcagaggcttagccaacgcatctgaaagagaagagtgttttatgtctttaatttcttcttgtcagaatcaaccaagcccagagctatttacgtgttgagaagggtctcccatggagaggccttcccagtggcccttctactctctgctgcggtggtttatcatgtcttcaaaacagactcgccaccaggcttccaacaggataatacaaatgtgaaatttttgtcctcaataaagagtcagaaatgatgaccattctgccactttcatcattttaaaatctgtattcctgaaaactggcctcgaatttatttctgtatagtccaaggtattgatttgaaagtgagaggctagcatgaaagccaacacttctcaactttaaaaaaaaatgccttaatatttagtattttctcattctaatgtatcctgtaagtgttctttctgtacttcttgttaaggcatggctgtgtaaacttcagagggttttgggaacagcctccattgtcatccacttttcattctaaaatcttggtatatctgtgcatacatgcacaaggcctcccatgattgcactgcttttacgaataatcatagtcaaaattcattttttaatactgctagctcaatttttatttcttattcctttgaaattgatcatcatttggacagggactgcattaaagctcaacactgaccttcattgtggccacaggaagaaaagatctgctaaatgaacaaatactgtgatcgatattgtgcaatggcttgagggaaaaaggaggttttaaccacttaaagtaagcccttttagaaacaaaaactatttcagtgaaaatgctaatcctacacctctccaaagtaaatgtgcttagaggacaccagccagagtttctttacaatgggaagttgccttccaacaagaaagggttttcaaagtgcagaagaaaactttatctggaaaaggtgagaagcagagagcctccaggctccagccccacacactctcatcttcaattaatactccacaaagggaaagttccattgtgggccacagcactccctgcttgagaacctgtagggacttaaccgctgggtttatccaatgaagtgtctgaggtccccgctgtttagcttggccctccactctctgttcccaatttcgtaaccactacctcagccagtctccccagcagagcacttttatcttatagccatgaggcatctgtgacatgtcccacaacacatcacaaactctatttgtcctccaatgctcagtgaccttattttcccaggcaaaagtggctcccgtcccggtgcccactaagccttgataccagcccacagtacagtgcttctcagactaggtcgtctcagcatttgtcaatgtattttatttatgtttcgacgtccagtctgttcatcttcagtacaggactgggtcatactcatctttccatcctttcccttgtccaccttcctttcttcgatttgaatattttctgtagttgctccattaatcagtaattaattaattgcagaaatgtatttcccaagatgtagataagtcacacctcagaatgctacaaacatttgtagatgtgactgatcagtaattgtcaggagactttgtcaatctggagaggtgctgaaaaacagagacaagaaaatgtcaactttcaaaaatactcatttaaaaaagtagtttccaagaaaagcgtagactggcaaaaggatgattgacaaaattctggactagattactaaataggtgatatgtgagaatttagaggagaatcgtgtgatttgcataatccaacatgagttccccggaatcaagccatcccatgtgaaccatatatctcttttatatataggttctgaaactggtgaaatggggaccacttgaggttagagattcgtaattcagtgttgcctctgatcagcctggaattgtagtttatatgccagcaactgcatgtagcctgagggctcccatgactgggctacagccaattgatcacaatctaatgatacccctaggagtgccttgggtgagagcgttgtccggggcaaaccttatgaaactttgtcagatggtcttcacacagcatttcttgattttagcagagcctttgactcagtctctcctagcagattttttcacttactccacagatatttatttaggtgtttattcagtgtcaagcattgtattaggtgttcagtgtttgtggctcagaagcaaattctgacttagttgataatatggagagcaaaaccgagtcaaaaattgattgcctgaaattatctttggaactgcaggaagtcaatcgattgatgaattcatgtgtgtccgggtctctggggtacactgtgtgctcccccattcactccagtccctgctcagagtccttctccaatcacctcctctataaaagcaccttgccccatcatttcctattccctcatgctgttttatttttcatctttgcacattttattctctgcaatgatcttattcacacaagcagtcctgtagttgcctgctctctgcccccttgcttggaatgtggtatgaatctagggaggcatttcacagggctgggtcttttgttccttgccgtccattcaatatgtctatcagtgacaattgttgtcattcctgctaatctaatttgcagatgatagaaagtgaggaggcagagctggcatggtaaataaggggatcaaaatgtacatcagcagcatatgtgaaagcactttgataattgaagaattataattaaatgcaagttatcattttttaagtgcgtataaatctaagccaaaaccaataaaatgaaagtatcaaggttaaatataagctcatgcatttaggttcaaaaaatcaattacacaaattcaaaataaaggagacctaagagggcagcacagtccatgccgcgatttagccatgagctgggcgactctagggctgcaacacagtccccgagtggtggagccatggctggaaattcttcgaatgttatcagttaggagggccacatggtgaggtggacattaccaagcccgagtgtggccagtggagggtcactcagaacagcagcaggaattgggacgtttagcctgaaggagaggggacttagggaggtggggacccatctttaactctctgcggggttcacatggaggagacgggcatgtgtgtgctgagtgctaagttagaacctctgggtcctggggggcagactttcattcaaggtacggagaatgatgggagcccagggccagaagcctataacccacagcatctggacgaatactgagcgctgtcactagattctatttttatttgtttgtttgtttgtttgtttattttttgagacagagccttgctctgtcacccaggctggagtacagtgacgcaatctcagctcactgcaacctctgcctcccaggttcaagcaattctcctgcctcagcctcctgagtagctgggactacaggcacccgccaccatgcccgactcattttttgtatttttactattttactctactattttagaagagatggggtttcgctatgttggccaggctggtctcgaacccctgacctcgtgattcgcccatctcggcctcccaaagtgctgggattacaggcgtgagccaccgtgcccggccgtcactagatatttaaagagaaactggacaactgtggggcagaggccagctcttaagagggatcctggctttgggttggatcttcaattgtctttgttctttgtctttccaagtctaacattcttatctgttctaaacttccgtatttttatttgttctgactgatttttttttcttggtgtgacatttgatgtaaatagtacttagcaggcttagcaactcctatatgaaagtgctttgaaatttgctgggctttggaatctctgttgtttttgcccattaagtaattccctcccatccctcttcaatgttcccctttccctatcaaccagccctttctgcaggttggagtttgatagacttggcacttggcacaccccctgagcgccagtgtcaccctctgcgttgtgaatttatagatggagaccccttcatccttttacagtcgtgctctgatcctggggtccctgaggtccagagcagaacctgaactctgagtatcaggcaagcgcatcttacttcaaaaaatgggaagaacaatttaaaaatgcaacttggatatgtttttataagatattcccgctttctgttttctacacttatttagcattttaacattttcagaatacgtgaaaattagatttagtttcttttttaaatgtgaaatataagaaaattatgattacccgtaacacatttgtgattaaaagtacattttttaggaaaaaagtattgtttccagggaacaattttctattaagttggtgcagtaatgattgcgatttttgccattgaaagtaatgcttaggccgggtgcggtggctcatgcctttaatcccagcactttgggaggccaaggcaggcggatcacctgaggtcaggagttcgagaccagcccggccaacatggtgaaaccccatctctactaaaaatacaaaaattagccaggtgtggtggcaggcacctataatcccagctacctgggaggctgaggcaggagaattgcttgaacctgggaggcggaggttgcagttagccaagaccgagccattgcactccagcctgggcaacaagagtgaaactccatctttaaaaaaaaaaaaaaaaaaaaaaaaattaatggttaaaaccacaattacttttgcaccaacctaatacttagaaagatgcaataatactagatggttacctttaacttacaggtttcgggtttcacagaaacaacagcaaacccaatagtgcttcactcagtttccctcccaaagacagcaaagagagaaaattaactacctggccaggcgcagtggctcacgcctgtaatcccagcactttgggaggccgaggctggaggatcacctgaggtcaggagtttgagaccagcctggccaacatggtgaaaccccgtctctactaaaaatacaaaaattagccaggcatggtggtgggtgcctgtaatcccagctacttgggaggctgaggcaggagaatcgcctgaacccgggaagtggagattacagtgagctgagattgcaccactacacttcagcctgggtgacagagtgagactccgtctcaaaaaaaaaaaaaagagaaaacaaaaaaccaactatctaaggcagaatggtaataaactgcccagtaatgctttcagggataattaaatgagtgatgagggcacaattacaaataagctaacccgagttacttggaaagcagatggaagcacccaagaccatacaacaagaatgaaaccccagaacagtaaacacacggtattcctaccatatatgccccccatcggtgtcacctaaaccaacatctctttgaccttttttttactcatgtgaccagttatttgattgtttggctgtcaaagtcacaccaagataataaattaggcctttcagagccaaaattatattatctagggtattacagtgaatatagagttaaataattttagtgtcctgaaaacattacaaaacacatatcagaaataagagccattctatgtagtgaatcgggggagaaatgagagaagctcagagaccaacatagagaaaagcaggagaaagcagaaagcactggaaacaaacatgtctgcttgttggtggtgggcgatggatacaaagatacccagccagaatccccctggaacaagccaggcattaaatctttacagctggagttgcattaaatctttacagctctaagctgcttgctgcaaacatcctgtagttctcgtcaattcaaactcatccccaactttctttttttttctaccttactcagtgcgtctgtgtctgggtgaacttcagaaatctctctcttacgttttcttgcaagactctttggctagttttatctgaaagtttgtttgtttttccagctagtagttcttccccctcttccctaagctcttgaagtctaacactgtttctctggtcagagggatcagacaaagagagctctgctcccggccacccatccgtctcattgattcaagccactgggtctgagtgggccccatcagagggtgtgatgggttccagacaacctggacgtgcttttagaaagcagtcaagagtaaatccataaagccttatctttgtgttggaggggaccacattataagcaaatcgtacattttcttccaatacaaagtaagatagtttcctgcattattagtggatatttttgcaaggacatatttaaaaatatatattgcccaataacccatcattcagtttaattccacatccctgctgggtgccttccagtctaccttgggcaacttaacataaatatggaaaatatagtttgtgtttatggagctcatcgccctatgagagaggccaggccctcacggaggacgaggtgacagcgtgggcacagccagctcttgaagaatatcataggtgatgaatgctctagagatcccaaggccaaagcggctcaggcacacgtcattcatttgtttgtaagcaccgtcaaggcaaagagaccaggcatctgtctttcataccccagccacaccccctgaagcagagtagataatagatgcttacaagacagcgagtgatttcatctcagtatgtatgaacagcttcaatcacacagattttgggcagattcactacctaatcggatgcgagacttttcatttcttctgacctatattagtaaacagcaatataatcttttctaattacagacacataaaatgattgataaaatccaacaattgtatgacccctccacaaagcattttttacattcaagcctcacaccagcccctggaaatagatattatttttaatcttaattcatccagcattgtgctgggtgctggggatagataggccagggaagaaagattcgaagcccctgcttttatggagctgacttgctggtgagaaaaaaataaataaataaaacagcaaacaagaacaaacaaatacatcaataatttaagtcattgttaaatacgatgaaaaaaatggtagtatgatagagagtgatcaagggaggaagtgagatctctagagtggatttgaaggaaccagatctaaagacagggggttccagttaaaggtataataggagtgtccaacctttcggctttcctgggccacattggaagaagaattgttttgggccacacgtaaaacacactaacactaacggtagctaatgagctttaaaaattgcaaaaaaaatctctcttttttttttttgagacagagtctcactctgtcgcccgggctggagtgcagtggcgctatctcggctcactgcaagctttgcctcccaggttcacgccattctcctgcctcagtctcccgagtagctgggactacaggcacccgtcaccatgcccggctaattttttgtatttttagtagagatggggtttcactgcgttagacaggatggtctcgatctcctgacctcgtgatccgcccgtctcagcctcccaaagtgctgggattacaggcgtgagccaccgcgccaggccaaaatctcatgatgttttaagaaagtttacaaatttttgtttacaaagccatcctggaccgcataaagcctgcaggccatgggttgaacaagtttggtatagcaggaccaaagaccctgaggtcagacaaggccggcatttacctgaacagaaggaaaccttgataaatagaatgaatggggaggagaaaagtagaagctgaggtcatagaggaggcagtggccaatttagcgagagggcctcacaggccaagggcaaggggtttgaagtttattatgagttgatgggaggtcagtggagggctttgatgtatcattttggcctctgtggatgatggatggtggggagaccatgagtggaggcagggaggctagcagggaggccactgctggagtttagtggagagatatggtggctttaatgagaacataattgaaggtacaaaaatgggcagattgaagatgtatttgggaggcacagctaagactatctgcggatgtattcggtgtggggaatgtggaagagagaggctcaaattcccaatttatggttgaaactgacactcaaagggattaaggaatttctgtctacagccgcaaatacagggcaggcaaggactccaggctggttctctaattcccaaatgacagctcttctcattcttgcatgaggatatgaggtttgcagaaagaagggattcatgagtagtaagtcctcttaatcctcctagtatggatctaatgattttttgaggtcatgcgtagtaaacaatgtgtaatatccattcaactagtcagctgatttgtggttacttgcaataagtcattattttcaatggggtcgataatactgtctctgacactaggtgtttgtaaccacaaagtgcacttcagttgaattcctttccgaggttgttttatgttcagaaccaacctttcgtagttatatcattagttattagagggataccaggcaacagatcgagtttatttcttgtaagcgttcttgttgcagtcatatatttcgtggtttcattaaatcggccttggtagacaagctgttctttcaaatccctctgtgagcagcaaatgctgtggattgagatctgtattctccagatgatttgctaagtcatctcagaagagtcctctgaactgtgaggtgtccccagcccttttgtcccagatccaagaaccaaaaaaagaacttgaaatggggatcctgctgattgtgcctacacttgttcattcatttcataaatacttactgggccctccagtgcacaccaggcactgttccaggtgctggagagatacaagcgagcgagagaggtcaggctgctgccttcagggggcttcttattcgtgggcaaaacaagcatgacaaatgggcaaacaagattatcacagtttaatacgtgataagttggtcaggtaaggcctgataaggcaacttatcacgtatcaaggttttggcctctgtggatgatggatggtgggaagaccatgagtggaggtagggaggctagtggggaggccactgctagagttcagtggagagatatgaccaacttggttaagttggtcaggtaaggcctcctcaaggacacggcacttaagcaggaggctggaagtataacaaagcagctatgagaggagctggggaaatgcatcccagggagtgggaacagcgaggacagagccctaaggaaagtgtggtgcattgtttagtaccctgttggctgctataatagagaaacccaggccaggcacagtggctcatccctgtaatcccagtactttgggaggccgaggtgggcagatcacgaggtcaggagttcaagaccagcctgaccaacatggtgaaaccccatctctactaaaaatacaaaaattagctgggcgtggtggtgtgtgcctgcaatcccacctactcaggaggctatggcaggagaatcacttgaacccaggagccggaggttgcagtgagccgagatcacgcctctgcactccagcctgggcaacagagtgagactctgtctcacaaaaaaaaaaaaaaaatagaaaccgagactcacaggggtttaagcaagatggatatttatttttctgtcacttaatagcatgggtggacagttcaggactgatgagatagctctgcaatattttgggacccagactctgctgtgctacaatctggcattctcaatatgtgacccctacctcatggtccaagaaggcttctccactcctgccatcacacctacttcccggccattcagaaggggagaggggaagagacggcctcttccctatgtagaggcataatatccagaatttgtgcgtatcttctccaaaggagatggaatcagataagtgtgtggtaggcaggtcattcgggaccatgtagatcatgataggatattgcgttttattccaagagcagctggatgccgctgaagggttttaagtagtgaagtgacatggtctgatttatgtttttacaagaacactctggctgctgagtggaggatggatgagtggaggatggatgacagaagggcaaaagtggaaatggaagatcatttaggaagctgtgatcttaaggagcaaggcaaggtggactcagacactgagacatcatataattgtagctttagagtattaactgtttaaagagacaatgagtaaagactgaatgttcatgcacctctttctaaaatacagggacagcctttgcgtggacaacttactggatgagcaggtttaaggaattgtatcctataaaagatagacgtgaaaccagccaatgtgaatgtgccgccaaattggacctggttatatttgtggggacccttaacttaggaatatagaaagcacatgaaagtgcctgtcaagctagagccctgggcaggggcaggctcagtctcccaggaggttagagctggaggccctctgagctcatggattcaacccttgtgctgcaggtggagaaactgatggtaggagtatggggggctgtggcttgcccaagttcaactttggacagttgcagaatcaaggcaggaagccaggactggaagccgccactctcaccatgcaccgtgagggggtatccttgatgggatgctttctcctgaatcacacatttaccttttggcctcctttgccagcacctcccttagaacaagttcccttctttacctttccccaaagtcccctggcctgtacctcaagtgattccatcagttaccttgtcttccaaacaggactggccagatgacgatggtaaagtgattttgagagattataactcacgtttgctgaaatgttttgaagtttcaagacagtagtatgcactgtgaatgccagtgttgctcaagatcctagagacagccctgggtcctggagccccggcagcctgctccaaggtcaacaggcggggccccggcaattgtttggggaccattttcacaaccttaaggtaatttgtggttcctctgagaatgcccactgaagtgttccccctcagaatgctgtggatgggagatagaaggaaacaaaagaggaggaagcagtgaggattttactggatactgcagatgcacttccacatcggcatgggttcatactggattatgcaaaagtatggattctggaatgattcattccccccaaaacctggaactcgagggcagcatgctgcctcgttgtccataaaacactcccttttgtctctgcagggatcttaaaaaaacaaagcaagctttactgtggcaaaacctcctctacatattatcattgtctgattggattttaagcacaatgctatcttggtctacacattttcttatacaagtgacagtaatactaaaaatctcagaattattatcaagagccttttggtagggtgaaagtttcttttaagtattttcattttcaggagtgagttttcacacacacacacacgcacacacaagtatcaggaaacaaaaaggaaatgtgtgcaaacttccaatttaaatgttctacatcttagttgagatggctatgatacagatacatgtatttggcaaaactcatcaaactaggcatttaaaataagtacatttttggggtacaaattatacctcaatgaagttgattcaaaaagtcaaaagtaaaccaaaaattccaattttatattccattaataagtttttggtgtctgcttctggttttattaccgaggattctcatttgagtacactcagaatggaacagagctattatcatcgaacgtttcctatactgggactaaagtctggccaggaaattaacttttaaccctaactttgtgctattttgagataaaagaaatgcacacctcagaacagcaaggtgttacagcacataactgcctgtacaatttaaaaactcgataaacccaaagctttggtagcaagtcttagcaggtgctgagaaatacgaaacgattaatttttttttttttttttttttttttttgtaaaccagaaaacaagtctggtgttaagcctgttgtgcaaatactagcattaaatattttgtagcatatcttagttccaagtatttcttttctgtcacatttttctggttcctcctgataatcaaggcaatattctttgaactgtttccttagaaaagttgttgaaatgaccaaatttctaattccattgggatttggacacatttctgaaatggcccagaaatcattttggggagcccttaggctgctgttccaatccagcacataggtgtgacagcggagacccactcggacttcagggactgcctgcctcctccctccacacccatctcctgtctccccaggacctgtcctcaggagctcaaaagaagaggggtcttggtcctgagagggtgagggggcgaccgggaggaagcacttcctctctgtttcttaagacatctcccttccctgggacaacttccctaaaaggctttctttttttttttttaaccacttttccaaagtcagaaatgaatacattctgaaaataacccaactttctttttatgtttctttctttccacccccacctcaagcccctagaatggccagcccacctggctagcaagaacttaccttcctgagcatgcctggggacagaccctagcacacaccccaccctgggctcgtggcgggactctggctctggccaacatggagatcccagccacacactgatttggaggcctgagtgtcaatgacaaaagcaatccaaacccaaaactctcaaaattgattaaacaatggaaagcttggctttacatgagatgtgtggaaagcatcctgcatccaggtactcactggaaggcagaaatttagcagatgttgctattattatccttagggttaatcatagtgattcctgacttacagaatccaaataaaggaaatccacttcatgcatcagccgccagctgctttttttttttttttttttttttttttttttttgagacggagtcttgctctgtcgcccaggctggagtgcagtggtgcgatctcggctcactacaagctccgcctcccaggttcacgccattctcctgcctcagcctccggagtaagcccccagctgctctttgtggacactcattgcccagacccccactatggtcgatcagtattaattgcattaacagatttaattataaaattatttcaactgcctgtttttttctgtcttccattctgtgttataatagtttgccaggttagctccaaacacttaatgtctgttacttactcaatataatcccacccagtacatcacctttactgggaaagaagcttgttaatctctgtttaccagtctgctcccagttattcaaggactctctgaacctaaaatgtataatatgacctaggtcagaatggcgttcccataagtgagcaccaacagtacgcagcggctgacacgtgtgaatccatctcttgttcccttgaactgtgaatcaacatggatgtagccatagtcatatctatcaccttttgtgagaaaaattttactttgaaaacaaagtaatagactgtacagttaaaggacagcagaatccagcaaaggtctgtctgtatcacaaaggaaagccacatcatgtgctttattcccatcatcagtcaacatccattttttgtagctctgggaacctaggtgtctgagagccagcgctgcgtattggtagcactggttctgccatctctaagccccaggacaagtatcctaacagaactaagccctggcttcctcatctgtaataaaataagtaccttctagtattcttattttattgtgaaaagacaattctgtgcacatatggttacacacacatagactataatgacacttgcattttattggtattcacaacttttaaaaattttcctatttaagacacagcttaaaataattaaaaagaaatcatcacatagttattactgaagatttgcttctatgttccataaaacatggttttaaaatataaaaaaaagacacagcattgatttccttcaatctgcactttttttcccattttgctcagcacacaaccttttaactcactcttaaaaaaaatccaccataaaggactggaaattaagagaagggtgttatataaaaaatgccatgtgtgctctgacttacaaagtcttcttcagtccatgaactcacagacagtgtcagccactgagagtgtcgtcgtcaaaacgaataatagatgtggaaagccgtggctcctgctcctgagagctggacgcctcttggctgacctcctgcttgagccagatccaagaggtgaaggctgaagcaagagagctcccttgagaaagctccagagtttgtagcctactaaaccagcagtgtcctatattacattaattctcctgatgtattttcctgacatttgtcagcatttccttctatttgccaaacatggacaaagagaaaaccaggttttagaagtatgctcatttataaagtctctcctgagtcctcacctttccatcccttctgccatcacctcagtcagacccttaccccatcactcaagacagctgtaagtctcctggcttgacacttcgcttcaatctcactcatctctgattaaaattgtcccatgatcgaaaattttatgttgttttcgtcaccattaaaaaaacaaaaaaacaaaaaaaaaaacccttcctcttccaagatgctccagtgcttaacaaatcaagtgtaaactgatttgaagcgtgaggccctgcgtgatatatactgtaggagacctttccagctttatccaatatccatccctagtactttgctgttaccccatgatatggtttgactgtgtccccacccaaatctcatcttgaattgtagctcccataattcccacatgtcatgggagggacccagtgggacgtaattgaatcatgggggtgggtctttcctgtgctgttgtgatagtaaatgagtctcatgagatctgatggttttataaaggggagttcccctgcatgagctctcttgcctgccaccatgtaagatgtgattttgttcctcctttgcctttgcctatgattgtgaggcctccccagccatgtggaactgtgagtccattaaacctctttcctttataaattacccagtcttggttatgtctttattagcagcatgagaacagactaatacaccacacatgctcattgatttcttggttttgtgaaaggcccatctccctctcccatcagccttctctttgcaaattgtagcccccgttcaatgatcagttcagttggcactgacacccacaggcttcccttgatcctgtgccccaatctagatccatagctctctcctctggatgtccttcatgtgactgtgcatcatagccttctgtattttgcctcggtcagtgtttattcttgactatgagatcctgcagggtattgtagtataactgtttctctgtgcctcacagtgccaagcacagggccttttgtatagagcatactaataaaatttctgattccaactaaattcttgtatgcacacataggaagtgtgacttaatatatgcatatggaatcaaaatgattactttatagttagcatgtgtatgtttgtatgcagaaaattcaaaacaagtattcaaacaagcacaaagttgtgtaactaggaaaaacacatgctcatttactcctgacctgtggggcccaggttccaggccctacactatgtgatgaagacacaagacaagaaaatatggcaccttctttgagaagcttccatctagtcagggagaaaaacctgtgatcatataactgtagcaggccctattactcctgactacactggagaggccaaaaggagcgtgcctggttcagcctaggggtgttcaaggtggtcgtatcactggctgagggagtgtctgagggaacacacagccagggggctgggagaagcagggtgggtcagagcacaaagagacttgttcatcatttcgaggcgcctgtgctttctactagagatagtcactgaagcagaatgagaggatcctacgcagtttcagaaacatccccctgagggccaggtggaggatgaaatggggggaagaaggcaagatggcgggcagccatgagaccatggcaagaactctcagactggaaatgaggctggcttgagggaaatgggagacgggagcatttgagaatgtggagattgcatgagaagggatggcttttgggtgagtgaggatggctggcctgcctgttcacccgctgggagcctggtgaggtctcatccacttaccatgttgtctgggctagagagaggtagcacctgtagaaaccgcaattaggggtcctatgcttttgtttaactttctggaaatagaacaggcctcccttttaatacatctgttattcagcctttagatattctgctttcaagcgcgtaatcaggaatgcattagaataaagcagttaggagcagagtaacagaagggttaaagtatttaacttctccaggcctgtttcctctgtaaaatgagaaagaagataataatagcacctatttcacagaggagctacaaaaattaaagaagttaatgaatgtaaattgctcagcctagggccctgcataaaatgtgcacttaagacatcagttacttttttttcctgtgtgattggtgaggaaggttgagaaaagcatgaggactccttagctcttccgaaatacagtcatgtgctgtgtaaggacgattcagtcaaccacagactgtgtgtacagtggtggtcctatgagattataatatggttacttttactgtaccttttctgtttaactacctgtagatacacaaatactaccattgcgttacaattgcctacagtattgagtacaataacatgctctacagatttgtaacctaggaaccatagaccttaccatatagcctaagtgggtggtaggctctgccatctaggtttgtggaagtgcattctgtgacgttcccacaataacaaagttgcctaacaagactcatttcacagagtgtatccccatcactaagcaacacataactagtacttgctacagttgcaatataggcaaagcctcccttcttaaatataaataagcacacttttcaattcggagatgtattttgtatactaaatttgaagacattgttttgcctttttgtagggagagctggagattctgctcttatatccagagtggcatccgtgtgacatagtcattctttgtatgtgtgcctttagcctatgggtcattgtcagaatttagaaattcaaggtgcagccagttacattgctagagagatggaatatttcagagtctctgcaagcttcctttaagaaaaatgtcttcttttggaaagccattcagaaaacatactcagtaggacagtttcaacttattaaactttcaggaaatttttttaattgtctcacactgtctcttttgctgtataaattttaacagcagggtaaagagagaagcgttcttgaatttcactagctgcggagaaaatatttctcactgccctgggatacataggaaatcacagtcgttagtttcagatgtttagtttgggatattcaggtgcattcacaataccttttgattcattattactttaaaccatttgtggtttgatcctacaaattgaggacttttctccagatgtgaaaaatacaataaaattttctaacagaggggatctcgagaagaagttatctttatttctgcagtttctacaagagtccataaacccctttagaacatggcaaaaactgcagattggcagccatgggttggctggactgaaagggaagggggctcacatttaatttagagcataagaataagctaaacagcaaggcagtgacaaatgatacaacaagcaacaactcctagctgactgctccgaaataaacacatggattccaggcctcacctagaccaagaacatattctgcaactaaaattaaaccttcgggacatgcaaactctttagggaaaggagtggaagaaggagaagaagaaggaactcagaggttaccaagcaattgagtggtgaagagaacaggcatgaagaaaagagaacaggtgtgaagcaacgaaggaaattgcttctccaaatgaaaagttttgaaacacagccctcaccaacctcagaaaaatgctaactctgaaataggaaatggagacggaattggaaatggaacgtgaggaatatcagtaaacccttgtaactgtgcgatcaacttctttgtaagatttttaaactcaaaagtaaacacttttaaaaacttaaaagtgtaagattttaaagtggtataaagatcttaattaggcatttaggtagtgcatgctgtggagccccaaacttacagaagtgacaccagaaaaagccagaatgatccctttctgtgttccagtacttgtgggaaaaaattatttttattaatttgtaaagggctaaaatatttatggactaaattcagatgagtaaaaagatgaaggtgttagagtcgcttttctttcttttttttctttttcttttttttttttgagacagtttctctcttgttgcccaggctggagtgcagtggcgtgatcttggctcactgcaacctctgccccccagattcaagtgatctcctgcctcagcctcccaggtagctgggattacaggcacccaccaccatacccagctaatttttgtatttttagtagagacggggtttcaccatgttgaccaggctggtcttgaactcctaacctcaggtgatcacccacctcaacctctcaaaatgctgggattacaggcatgagccaccatgcccagcctagagttgttttaattttctatatcgggtctcatcttgttctgaggcatccatttctatgttcttggtttgggttgaggggagattgaagcttgcacttaaagtcaactaagtctctcatttaaaaagtgtttcttttaggtgaattcagtctctctgaggcaaatactcaatctctctgccttcatatctcctttccagagtgtcaaggggcccgggattacacgcagtcttcagggtctgtcttcatctcctaggctgtcataacaaagtaccacaaactgggtggcttacagcaatacagatttatcctctcacagttccggagcccagagctctgaaatcagggtgtcagtaggggtgggtcctcttggggactcagagggggaactgttcttctcttccagcttctgatcgttactggaagaccttggtttttctgggcttgtagaagcataattttactctctgcctgtgtctccacctgcctttctccctgtgtgtgtgtctgcgtcttctctttttataaggacaacagtcactgggttagggcttaccttaactaaagatgacctcatcttaactcgaccattgtattagtccgttctcacgctgctatgaagaaatgcccaagactgggtaatttgtaaagaaaagaggtttaattgactcacagttctgcatggctggggagtcctcaggaaacatacaatcatggcagaaggcaactcttcacagggcggcaggagagagagaatgagtgccagcaggggaaatgccagacgcttataaaaccatcagatcggccgggcacggtggctcacgcctgtaatcccagcacgcctgtaatcccagcactttgggaggccaaggcgagcagatcatgaagttaggggttcgagaccagcctagccaatacagtgaaacctgtctctactaaaaatacaaaaaaactagctgggcatggtagtgcgtgcctgtagtctcagctacttgggaggctgaggtaggagaatcacttgaacctaggaggcagaggttgcagtgagctaagattgactctagcctgggcaatagagggagactccatctaaaaaaaaaaacaaaaaacaaaacccatcagatctcatgagaactcactatcacgagaacagcatgggggaaaccacccccatgattcaattacgtccccccaggtccctcccttgacatgtggggattacagttcaaggtgagatttgggtggggacacagagccaaacagtatcaaccacatctgcaaaaactgtctttccataaaaaggtcacactcacaggtaatttgacatagctttttggggcacacaactcaacctgtaataggatccttacaggtctttgctgtggtggctatgctggtctggtggccacccttgtggcgctgaggtgctgaggttgggggatgttctgccgtggcttattaaagggcatagtgctagccatctcccattcttcctgcatctgtactgcgtgcaggctgcaggggagcacagcactacctaagccccatccaacagacaagtgtggctctcttaacagggggacttactactcgtgtgccaaattcaatgctgctaataggaagcttgaaagcaaacagtctatgctttggcaaggaggatccactctcactccagccccatgtttcaacgtttaaagggaagccagaatacatacacagatggtctccaacttatgatggtgcaacttacaacatttttactttaccatggtgcaaaagcaatacccattcagtagaaaccgtcctttgagtacccatacaaccactcttttcattttccctacagtattcaatagattgcatcagatattcaacatgctattttttttttaaacggagtttcgctttttgttgcccaggctggagtgcagtggtgtgatctcagctcactgcaacctccacctcctgggttcaagcgattctcctgcctcagcctcccgagtagctgggatcacaggcatgtgccaccacacctggctaattttgtatttttttagtagagacggggtttctccatgttggcctggctggtctcaaactcccaacctcatgtgatccgcctgcctcggcctccctaagtgccgggattacaggcgtgagccaccacgcacggcctcaacattctattataaaataggttttgcattagatgattttgcccaattgtaggctaatgtaagtgttctgagcacatttaaggtagggtgtgtttggtaagttgagtgtattaaatgcacttttattctgacaatatacaagacagtaatattattttttgactgaattagtggctgaattaataagtgaaagacaaaaggactgcttttgcagggtgagctcaaaaacgtacgatgggtttactgggatgtagccccttcatgctggaggaacctctgtacgtgtgtttccttagggctttgcaatcactgttccttctatctggaatgcttttttccttgggttccttttgagaggtgacagcgtgctggcagtcctcagagccctcgcttgctctcggcacctcccctgcctgggctctcactttggtggcatttgaggagcccttcagtcccccactgcactgtgggagcccctttctgggctggccaaggctggagcccactccctcagcttgcagggaggtgtggagggagaggcacgagcgggaactggggctgcgtgcgggccagctggagttccgggtgggcgtgggcttggtgggccccacactctgagcagccagccagccctgctggccccgggcaatgggggacttagcacccgggccagtggctgcggagggtgtactgggtcccccagcagtgccggcccaccggcgctgcgctcgatttctcgccgggccttggctgccttcccatggggcagggctcgggacctgcagcccgccatgcctgagcctcccacccactccatgggctcctgtgcggcccgagcctccccgacgagcgccaccccctgctccacagcgcccagtcccatcgaccacccaagggctgaggaatgtgagcgcacggtgcaggactggcgggcagctccacctgcagccccagtgcgggatccactaggtgaagccagctgggctcctgagtctggtggggacatggagagtctttatatctagctcagggattgtaaatacaccaatcgggactctatatctagctcaaggtttgtaaatacatcaatcagcaccctgtgtttagctcaaggtttgtgagtgcaccaatcgacactctgtatctagctgctctggtgaggacgtggagaacttttatgtatagctcaaggattgtaaatacaccaatcggcactctgtatctagctcaaggtttgtaaatacaccaatcagcaccctgtgtttagctcaaggtttgtgaatgcaccaatcgacactctgtatctagctgctctggtggggccttggagaacctgtgtgtggaaactctgtatctaactaatctgatggggatgtggagaacctttgtatctagctcagggattgtaaacgcaccaatcagtgccctgacaaaacaggccacagggctctaccaatcagcaggatgtgggtggggccagataagagaataaaagcaggctgcccgagccagcattggcaacccgctcgggtcctcttccacactttggaagctttgttctttcactctttgcaataaatcttgctactgctcgccctttgggtccacgctgcttttatgagctgtaacactcaccgcgaaggtctgcagcttcactcctcagccagcaagaccacgaacccaccagaaggaagaaactccgaacacatctgaacatcagaagggactgactccagacgcgccaccttaagagctgtaacagtcaccgcgagggtccgcggcttcattcttgaagtcagtgagaccaagaacccaccagttccggacacactttcacctggctcagagctcaaatgtaatctcctcagagtggccttccctgctcctgctacctagagtagcatctccccgtctcactctctcccttctcctgctttattttcttggtaaaatatcatttcagagcacgaggctttctttaagcaaaggacagacattttgcttattgctcaactagtttttgagctcatcctgaaaaaagtagcttttttgtctttcacttattaattcagtcaaaaaataatattactgtctagcaggctgggcgtggtggctcatgcctgtaatcccagcactttgggagaccaaggtgggcagactccctgaggtcagcagttcgagaccagcttggccaacatgatgaaaccgcgtctctactaaaaatacaaaaattagccaggcatggtagaatgtgcctgtaatcccagctacttaggaggctgcaacaggagaatcacttgaacctgggaggcagaggttgcagtgaaccaagatcgcaccattgtactccagcctgggcaaaagagtgagactccatctcatatatacttgagatgtatatatatgtatatatgtatacttttatatatatgtatacgtgtatatatgtatgtgtatacatgtatacatgtatgtgtatacgtgtatacatgtatgtgtatgcatgtatacatgcatgtgtatgcatgtatacatgcatgtgtatgcatgtatacatgcatgtgtatgcatgtatacatgtatgtgtatgcatgtatacatgtatgtgtatgcatgtatacatgcgtgtatgcatgtatacatgcgtgtatgcatgtatacatgcgtgtatgcatgtatacatgtgtgtatgcatgtatacatgtgtgtatgcatgtatgcatgtgtgtatgcatgtatgcatgtgtgtgtatgcatgtatgcatgtgtgtgtatgcatgtatgcatgtatgtgtgtgcatgtatacatgtatgtgtatgcatgtatgcatgtatgtgtatgcatgtatgcatgtatgtgtatgcatgtatgcatgtatgtgtgtgcatgtatacatgtatgtgtatgcatgtatataggtgtacatgtgtatgcatgtatataggtgtatatgtgtatgcatgtatatatgtgtgtatatgtgtacatgtatatatgtatgtgtacatgtatatatgtatgtatgtatacattatgtatacatatctgtcaagcataatgtcagaattagcaatattgattaaattatgtagtccttgaaggtagaaactctttttcactattgaatcctcaccacctggcatacaatagatactcaataattccttgtgtgggtgataaatgaatgggattccataacaaagttgatctgtgtaagacttttatttcactctttctataaaattaagtccacaatttttccatggatccttgcccaagaccacatgttgaaaagaacttatacgaatggcagatagcatcacggctaaagaaatagaatcttttgaagacaataactattttacttttaaaattgctcacaaattaaagaatgctggtagagataacaaagatgatttccaggagtaagaggccatcatgcagtttgtgatttccagatacttttgcagaaaggcaaccatgctgtagagtcagtagcagagttttcaccacctgtctaagacagaggaaaatgaccccaaaaaaaaaaggcaacttcaggcccttcttcaaaaatgcaaatccagggctacttccagctgtctccatagcatggcaaaacaatattcccagccaagcttcaagccattaagaaaaaccatcacagctgtgcgcggtggctcacgcctgtagtcccaacactttgggaggcccaggaaggcggatcacgaggtgaagagattgagaccactctggccaacatggtgaagccctgtctctactaaaaatacaaaaattagctgggcgcggtggtgcatgcctgtagtcccagctactcaggaggctgaggcaggagaatcgattgaacctgggaagcagagattgcagtgagccaagatgaagccactgcactccagcctggtgacagaacaagactctgtctcaaaaaaaaaataaaagaaaagaaaaaccatcacatatgtttggcaggggccaacatatccatggggttcagtaggcccacagtacttccagggacccacaaaagtgttctaataacatttaaaatcagaagaaaaaaatgaactgttaagtcaaaggaaaaatgttctaatatataatatgttaatacataatatcattatattcatctttataccaacacagtcctaaaatattacttttgatttttttttaatggaggaagaaaaccttgaaagcaaaagtgcctagggcctgtgaaagtcatcacatgaccctgatttggcgtctgctttgccttaaaaaagcattctagacagatattcagctggaaatactgaaatgggctcatgccaaaagaactagatctcttgttatccagaaaaccatattttctaggcagattcatttcccccaagatgcctaagagtcatgataacatattttagaggcgagattaatgcgatcgccccataaaatattttaagctctcatctgttctgaaacaaagtacgcaacatgtcaccaagagaaaatgactgctcataccgagaaaatgtattttcttcgaggtgccacagccactgtaatttgcacctcctgaagtgtagatggaagtcccctcaacatgtacagacagttaaaagagtcacggtaatgataggactagagaatgtgcccagctgagaaaataagcacacagcgagcattgtcagagctgaaaattaagatcccccaagcaaacatttcagatagagcccctcatcttttgttaaaagtaaaatgaaaatcaacagccctctacaccacatctgagccatggaagtcactccctttaggtgtctaagagacgactgcagcttcagtgcctggctcagattagctttgttcttccttgtctcttatcctttgaatagctctgacagtgccacaaggagtaattaccaattcgcagggggacacatcttcagttaaagtggattatctgcaagttgaggggtgggggttgctggcggctacaactgagttaggtattaagtataatctgcaaatgcagggagagttctgcagagccccaggcagttcttaactttctagaagtagctcccagctgaggcctcccctggtctccaggcatctggataatgtcttaactggtagagtgatggttaagagcatgagttttgggggcaaatttcctggttttatgcactggcacttcctagctcatgtgattctgggcaagttacttcactacagtgagcgacaatcagaatgggtccaaaattgtaccagccatagcaaggtgctgcagatgtagcaggacgaattgcagacaaaactcagacaccaagttaaagaaggaagaggtttattcagccgggagcatcggcaagactcctgtctcaagagccaagctacccgagtgagcaattcctgtcccttttaagggctcacaactctaagggggttccgtgtgagagggtcgtgatctattgagcaagcagggggtatgtgacaggggctgcatgcaccggtggtcagactgagacagaacagaccaggaagtttcacagtgtctttctatacaatgtctggagtctatagataacatcagttgctaggtcaggggtcgaattttaactaccaggcttaggtcaggcgggcccaggcctggtttcgggtctggttcctaggcactgggctacctgcctttagtttcgcttctctttccttttctgattatagaacaatataaaacaatatgagagggtctgtctctcttctctcacaaacattaataagacattgtgtttcaaatgctaagcatacatctaatacatggtaataaccccaagaatctttagctgttaccattatatttttatattttttttaattaaaattgaatcccttttttttttttttttttttttttttttttgtcttttgtgacagagtgcctctattgcccaggctggaacgcagtgctgtgatcttggctcactgcaacctccgcctcccaggttcaagccattctcatgccccaacctcccaagtagctggaattacaggggtgtgccactacacctggctaatttgtgccactacacccggctaatttgtgccactacacctggctaatttttgcattgttagtagagacagggtttcgccatgttggccaggatggtctcgaactcctggcctcaagtgatccaaagtgctgggattaccaacataagacatggcacccagcctctgttatcattattaagcattcatttaagccaagatctaaggggaaccaaggcccagtagcaaatctgctaatactcaggaaatgggtttgtgagaaatgttgctgttctttatcattattattattattattattattattattattattactattactgctacattcactatgagaaaacattcacgtctcagaaataacagtaataaggggtaagcattgccaggaggaggcagaaggcacatactggccaagtccggctctacgccctgtgtgtacagatatgtcttccaactttcgaaaagtctttgtaaaggttttcgctgatttgagctgttttcagctaagtcaccagaacatccagaatctaattttaaatgaaggttattataatgtccctcagtttcgtagcctcttattcaagagagattagaattctgtgaaggaaaagctttgttttaagttccaagggatgtaaagatttgctaggctgtctttaaatcccatttgggaactcaccatttatataaaaatggatgacatataatgtgtctttgggaacagtgaactctgaagagaaagatatggtcaaatggcccggcctcctcccacctcggaggatacactgcaccctcttcctacccctgatttggccctttcacaaatctcagctctagactgaggcagaaggacataaagatgcccatttccaaagctctccggctccccagtgcctctggttctatccatctttgtgacctgacgtctcagtggctgggtcccagatagggagctctggtctccggttcctggaggctgagcctgaatccctccacgcagaaagagagtcagggacagcaccgggggctgaatccctgccccaccttctagcagagtgacctcagtcaggtgactttactcctcaggctgtttcttttctggataacaaaaggtcattcaaccccatcttgtggattttctgtggagatttagttagataaaggactggcacacagggtgaagtgaggcagccttcccctcttccgcacagtgccacacagaacaggggtctgaggacttgccttctcccctgcatggctggtccccccctacccctgcccttccctggtgtttccaccgcaccccaccagctggaatgacatccaggattgaactcaatagccccttggcttacagggccactttctccacacctaccctggcagacttgatctcatatttgctttcagtataagatccagttgagcatccttccattaatgccccacagaacaagtctcagccttctccctggtgccggcctttccaacacctgaaggcagtgacggtgtgcttctagagtcttctcttccccacattcagcatccacagttccttccagtctgcttcacatgacaccgtctcaagcatggtgccatcctcaaaacacaccccggtttattattgctttcctgctcaagatgctctgtccagaactgatcacctctctggggtatgctgaccaccccaggggatggtctcagaaaccactttctaaattggaatatagactccatccttttcatgactcagtcaggtctcactcttaattcctaaatcccaaataattaacaaaaataccagagtcctgaggggttgctggaaaacaaaactggaaaaaaaaatccagttttcttctatcagccccattgtcccaacaaaggagggggagaggaggctacgtgcagttaccaggtgtgtcctatacaatttggtattgaaggtgattggggtgggggaaggcacgatggcatttccaaatatagaaattggttattcgtttctgctaaactgtatttagttatatctagggaaatcatttcagcctctcggagtccctttggctcacgataatgtcctcttgagtggagccatccctttttactaaatgccatatggcacattcatcaatgtgccattgatgtctttatccaagttaataaaatgattaaatgtaggcttggaatcaccactaaaattctccttgaagccaatttctacctatttatcaaattccaccactgttcatctcatgattaatctacctttaaaatactctcatgcatcactgaacgacagggatacgttctgagaagagtgtcattaagcaatttcatcattatgcgaataccacagagtgcacttacacaaacccagaaggtgcagccttctacacacccaggctctgtgctacagcccattgctcccaggctgcagacatgtgcagcacgccactgcactcaatactgtaggcaacggtaacacaacggtatttgttcactaaacatagacaaagtatggtaaaaatatgatataaaagataaaaattggctgggcgtggtggctcatgcctgtaatcccggcactttgggaggccgaggcaggcggatcacaaggtcaggagatcgagaccagcctggccagcatggtgaaaccccgtctctagtaaaaatacaaaaaaaattagctgggtgtggtggtgtgtgcctgtagtcccagctactcgggaggctgaggcaggagcatcgcgtgaacctgggagttggaggttgcagtgagtcaatatcacaccactgcactccagcctggggacagaacaagactccgtctcaaaaaaaataaataaaaaataaaagtaaaaattggtacccctatataggacacctaacaggaatgaagcttggcaggactggaagttgctctggatgagtgagtgggtggtaagtgaatatgaaggcctaggacattatactactgtagattttataagcactggacactttggccacattaaatttaccttttacaattttctttctttaataataaattaaccagctgggtgcagtggttcatgtctgtaatcccagcactttgggaggcagaggagggtagaccacttgaggtcaggagttaaaaaccagcctgatcaacatggtgaaaccccgtctctactaaaaatacaaaaattagcctggtgtggtggcatatgcctgtaatcccagctactcgggaggctgaggcaggagaattgcttgaacccaggaggcagaggttaccgtgagccgagattgtgccactgcatgcactccatcctggtcagcagaggaagactccatctcaaaataaataaataaataaaataaattaaccttagcatactgtaccttttctaactttatagacttcttaatgttttcaaactttttcactttttcatatttttgtctaacacttagattaaaacacaaacacattatacagctgtaaaaaatatttctttttatatgcgtattctataagattttgctatttaaaaatttgtttttaacttttaagacttttttattgaaaactaggacacaaatgcacacatttgctttggcctccacagggtgaggatcatcaataccactgtcttccacctgcacaccttgtcacactgggaggtcttcaggggcagtgacacacatggagctgtcatctcctgtgataacaatgccttcttctggaatagctcctgaaggacctgcctgaggctgttgtacaattaccctttttaaaaataaaaaataaaaaaaaagtaggccaggtgcagtggctcacacctgtaatcccaggactttgggaggctgaggcaagcagatcatgaggtcaggagttcgagaccagcctggccaacgtggtgaaaccccgtctctactaaaaatacaaaaattagccaggtgtggtggcgggtgcctataatcccagctacttgggaggctgaggcacaagaatcgcttgaacccagtaggtggaagttgtggtagctcagattgtgccactgcactccagcctggacgacagagcgagactcagtctcaaaaaacaacaacaacaaaaaagaagtatactctaaaataatgataaaaagcacattatgataaatgccaggcaatagaaaaatttcagctccattataatctcctgggaccaccctcctacatgtggttcatccttgaccaaagcatcattatgtggtgcctgactgtactactcaaacatattacaatgagaccatatctatttgtcttgaccacaaaaatgtcatgagaaacttactaaaatgctttgctgaaatttagatggcctctctcagtgctctcccacctaggaggctattaccccaatctgaaaataaaggaactggctttaggggttcagcagtgagaataggtgttgacaggaagaagtatccaaaggcctcccagtgggtctccggactgtgtcccttggtggcatccagggtggttgcgatcgtatggtttaaattttgtgatgatccactggagcttcaagttcagcctcaaagcattaggctctgttttctgaacatcattttatatggcaaggtcccgagattctaattttttcttgtgttaattatgtgacatggagcgtcagttaagggaaccatccaatacactttccagaaacagttctccctctcagtttcttcgtgtgcttgactggctcatggccctggggaaaccatcgctttcaatccctacctcaggtccatttcgtgatgtttatgcattcatgcgatcttagtcctcaaaggatttttttttcttctcttgggtaagatagctttagaggccttctgggataggaattataatacaactgagaacaaaggaagaaaaataaaaagtgaactactttctgttttactgaatcattcaacttgacattatctggaaatacaaaaatttgctaacacacttttcctagcctacactttgttatgctgcttgtgaaatgtatgaggtcaacacctttctacccttttttccccattgtcgcaaattctcctgctgtccagagttagtttcaaatgaccctctgctagtcttggccggcatacctaccagtggcttggagaggaattaaggaaaagcttgaaaactgaagctcatttttttgtatggtgttggctagagtttaacgtggttctccaaagccaaaaaaacattttagcagaagcggagcacacacagagataaattatttttctgtactacatttcagttggtaatttcgtacacaggattctatttctgctgctatcaagataaaatgcaaaagtggaaacattccaatgagtaagaagcaggtctgttcattcccagctcatgagaaactcaggacgcacattagtgttctgtttcccagcagcaaatagccaggacatatagcttcaatttactgggattcgaagaagtcaaatcagacctgatttcccatgaagtaaatcatagcacccagctctgtggtttgagtgacaggtacatccattattctgaaaggtcttgttactttcagcagagcttgttattcttagccctaaaaaatcatgccatgtgacagggcacctgaggctgaggaatggggcaccagcaccttccaggctttctatcttacatctgacaacttgaaacatccaggaaagaagtggaaaatccacatatcagatgtgtgctcctacccattccaaatgtctggtgtttgggaaacatttaagggatcataaattctcttttgtgtcaatgtttttggtactgtgtaattacaactatatatgtatagttatgtatatatgtatgttatactatatataaaactatatatagttacatatatgtatatatacaactatataaatatataaactataaatataaaatataaatatatatatttttatatatatatagtatattatatatatacaattttttttgagacagagtcttgccctgtttcccaggcttgagcgcaatgccgtgatctcggctcactgcaacctctgcctcccaggttcaagtgattctcttgcctcagcctcccgagtagctgggattacaggcgtccaccaccacgcccagctaattttttgtatctttagtagagatggggtttcaccatgttggccaggctggtctcaaactcctgacctcgtgatccacctgcctcggcctcccaaagtgctgggattacaggcgtaagccaccatgcccggccattacaactatattctaagattaactagcaatcataagttttttgttttcagtctagattttagaaatgcgaatgacaccaggcccaacactttgggaggccgaggcaggtggatcacgaggtcaggagttcaagaccaacctggccaagatggtgaaaccccctctctactaaaaatacaaaaaaaaaaaaattagccagacatggtggcgggcgcctgtaatctcagctattcgggaggctgatgcagagaattgcttgaacctgggaggtggaggttgcagtgagccgagattgcgccactgcactccagcctgggtaacagagcaagactccatctcaaaaaaaaaaagaaaaaaagaaacgtgagtgacaatttcaacctatttagtatccccaaaagctcaggagctgtgataaattgatacaaataaaaatgtaatacttcatctttttgcaaaatagtgcagtgggctctatgaagacatttctttttattgttgactctggaaagaaaaaatccagttttgtgttatcagtccttagaaaaagatttatgagttaaaatgcagcagaggccaggtgcagtggctcccatctataacgccagcactttgggaggctgagggggataggattgcttgaagccaggagttcgagaccagcctgggcaacataatgagaccctgtatctacagaaaatttttaaaaacaagccagtcatggtggtgtgcgcctgtagtcccaggtacttaggaggctaaggtgaaaggatcacttgagcccaggggttcaagggtacagcgaggcctatgatcacaccgctgcattcctgcctggctgacagtgagaccctgtctctaaaaataattaaaattcaaaatgtggtagagacactagaaggaaaaatgattctgcttctcccagcattctgcctctgcataattgagttagtgcatttcataggtcaagaactatttaaattacacctgcatattttagtcctgcatatttcttcataagagagaaaagcatctaataaatacaatgaaatttcattcatgtctttatttaagggatgaataaaatgtcacagtacctaatcgtatacatcaattatggatccagatttaattctggctgtgcctctttggaaaggcagctgatgagcaagacatcactgatcaaaaactgcattctgttagagcaggagctgacagggaacctagatgccagcatttccatgccctgcctgatgtttaccatttgatcacgttcgaactgaggaatgaggcttatcggattttatgttgctttttttagatgaatgctcttggctttttgttgttgttatggttacttcccattgatttattccactaaccatttagactcccgttcattcacctacggccaaatgggactagaatggaaaaacggaatcctacccgatcaatgcaaattctatttctctctctccaagaggcccagatgaccagccctgacactgggagccactgggagcttcaggtgctggcccagcagtgcctggccatgttttcaagtgtacatcaggtgaccactcacctgttgtacttcagtctgattttccaaggagtatttaaaaccacccaggcagtgatttcaaaccgactttctacttattccacaaggtaccgtcgaaccactgttctacgtgtgaggcctgtggagggtttatacagcaatgagtgttcagtgttaagtcctgccttccttcatagaagagaaatttatcagttcctctgggtgtcagttttagagcaatacaacaacgttttgaaagacaaatccatttttaatgagacggacagattttcaggtaatagtactgctagaaataacatataatgatctactggttctgaatacactgctgaattcctgaatacgctgaagacctccccctcctctttcctggttatgttctgcacctgtttacactatgaagctgaaaaacaaactttgactatagctaactatgattgttctaatttccatagtacttgatcccctcccacacaccaaactatgaatgacagactgctgaatagatggtttcagtcatagaccgtccctgacttatggttccacttagaagttttcaactttaccatggttcaaaagtgatatgcgttcagtagaaaccgtactttgaatacccatacaaccattctgttttccactttcaacactttattataaaataggtgtgttagatgactttactgaactgtagactaatgtaagtgttctgagtatgtttaaggtaggctgggctatgctatgatgttcagtaggttacgtgtatttaatgcatttttgatttacaatattcccaccttacgatgggtgtatggggaggtaaccccattatacgttgaaaagcatctgtatattcattcctacagtcactggtgattactttgtccaaggcattattttgggggaacacaaagagaagtgacatttagtcccagctgtcaagaaaactttaattctaggaaaggcacagttgcgggcctctggcccatccgaagagagcaggaacacacctggtccagttaggtagagccgggagcagaatccaggaggaagccccactcagcgggggtctctggtgttctaaagtgatggatagtgactggtactaagtgtgaggggagagggtggattacacctgaatagtacagaggctctaaggcagaacatccagggacttagagagacgtcaaactcctccacaacaatgttccccaaacaagagtcatttgaggaccaatgtcacgatttttgccatttctgatgacatttttaccatttctagtggcctcctttactgttgtttacttaacattttcctttaaatggactcactatttttacttaaataaatttatgttaaaaagtttatgttaaagagaaattttgcaatactaccatgaaatgaaatgccagtaccgcttgctgtcacgatacggtggtgctaaaaatacgtaatataaaaatataatgaaactcagcactgttgcccaccgaagcatccaggtctgaggtctgacctctctttgttaaaaagggaaaatagcaagtattggcaccataataaagatagtccagccccacactgagccggcctgagactctgagaaattgaaagggaatcggggaaggaataagactggatgttatttagctcccagtctgtgaattacctaaagacccccagtgccaccagtgcgacatacttcaccccagaacagagggaaggaacagaatggtaggcagtgctttggggccagttgtactacagtctctgcagagcaaccatatgctgtgtcagggctggaaccaggtttggccatctgtgttgaccccacagattctatgaagggtgacttccacaatccctagcacactggggagcacacagtacatacttatcaaaagtcttaaattaagtctcactgatgccctaaaatcttctgcctgtttcataaaaagtagaaaatgaagttgacagtgattctttgtatctcataatatcacatcgccctccccaaaaaggaacattgatagaaaactataagatataaaacctaacaaaaatcatctggtgaatagatcccatggaatacacaagaagaagatataggtgcatttaaataatctcaaaggaaaagaagaaatctcctttgagaagtcacatctaaatgcttatccaggctgggcacagtggctcatgcctataatcccagcactctgggaggccgaggtgggtggatcgcttgagcctagttgtttgggaccaacctgggtaacataacaaaaccccgcctctacaaaaaaatactaaaaaaaaaaattagtcgggcatggtagcacacgagtgtggttccagctactcaaagaggctgaggtgggaggattgcttgagcccgggaggttgaggctgcagtgagctgagattgtgccttgcactccagcctggatgacagagtaagaccctgtctcataaataataaataaataaatccctgtccaaataaataaatgcttatccaatcgctgaaaaggagctcaagcatgtacacgaggccccaagcacagctctgtcctccgtggagctggctttattctcccagtgtttcctgctcaggtgcccttttctctttcatttctcacaacactcccgcctctcacttggcattcagtaactgaacaaggagcgggaaagcatgctaatgcatcgcaaatggagttgctgcatttccttaaaaggactgtcatgagcatttcattttaacgtattacccggaattgtgtcagtgttttaagtgaactattttctgtaatccatatcgttatgaatataagacattaacgtactgattgccacttgagaatctcattttaaagtgattgtactgcatttctaaaatttgcatttttaaagcaagtttcccccacaaataacaccttacccaagacacctccaggcagaacgttgtttcttacagtaaatgatattttaatatttggtttcagtagagaccagtctaatcaattatagagtaacatactttacttgtaataaattcaaaaaagtgatagctatactgtcatttgtagatgttcttaagaaatatggaatcttattccagacaggcatttctataactttgtggtgctatcaatgatgctaatgaagatttgacatcagttcaccacatttttgaaaatcaaattgttggctcagccgctaatgaaacacaatctcaaagcagttttaacaaccatttacattttttctgaaaacctcactctaccgtttctatggggtccctgactagaaatatcaaaagtctacatgaatataaaacaatatagtctatttttcaaagagaaattgagactgatgcaaaatatttgacttcttttttttttatatgaaacataaatgtttattcattggcaaagccttaacttctctaagcctcgtttccctcatctgtcacttggcgggtaatcctatttagctcagagggttaccaggagacttaatgggatactgcataataagtactaagcacagtgccccccatcatgtactgcccttggtctgtgctctaatattgaagcaggatgcttccctgaccgctttgtgggacttgcaacaggggtgccctcaattacccagcccacagctttcaactcctcatgggaggaagcacgcatgtgaatgaggcaggaactggagtgcatgaatgctgaaaccagccagccacttaggtactgccaggagcaaacgccactcacttggacccactgtgctccaccccttgcaggggtaagcacgcgggtgagtgggtgcaggagccagggtgagcgcttttgagcgccaacaggagtgaactctgtgcaggctccgtggcagcatctaggggtggtgcctgcaacccctgaagccccagagggcatgttacagtgcttttagttctgctgtccccagacagcctaagtatcaacagctcagtggcttttcacgtaagctggctgccttctgccagtgagtacaaagggcaagtgtgacagccttttgtagccacactagcagcatccgagctcttgtcccacatccaggagaaatgacatcacacaaattgaaggatgacaaatgtaggggatttttattgccgatgaaagtggctctcagcaggaagggaagttgaaaaggggatggagagggaaggtaatcttctcctgaagtccagccatctctggccagattcttctctgatgttacgtgtcaagctgtccctctgaagtgaagctgcttctctccaatgtctaaccatagtcaccaacgtccagctgcttctcttctctctgccagctgagtatggggtttttataggcacaggatgtcagggggcaggcccatgggtggttttggaaaaggcaacatttgagctggaaaacagggatgtaagttctcactttgggctgcagtttctggcttgagggtgagggtttgacagggacccgcccctttctgcctagattttctctgccacctttctctaccattgtatcaatattattatcacatggccctgagttggaaccatcaggtcctgcaaactccagagcatctacttactgcacattggcccccccccaggggaattggtcccagccaagggtctctaggaaagaggcacatcaactagatgtggaacacactccggttttggaagtactggttctgttctccagggcatcagaatcctcctttttgtgaccctgctgccttacaggaaagaaacaacagttgaaacactgggaattttccccaatagggagaaggcacagaaaggagaaagctaaagaagagagtgaaagaggcccaaagagaatggaaaagtgagagcaggccatttgccagggctcattcctgccatccagccccagcttctggctgctcagtggacgcttctgccaatgctcacagccccacaggcctgggcccgggagcctctgctgccacccgtggtttctctccctgttccaccatcggaaccccgtgccccaggctctctcccttgaggccacctcagaaggagataccaaggggaagacagctctttaagaagtgtagactccatgttaaattgagaccccgcagacagatacggctttgaaacaattgattttctgtggtgtcatagggaaacctgccctcctcaaagttgcgaaaactgtcagggaccctatgaaatggagcgggagtcacaagttttctacccagctctaaaagaggagacaaaactaacactggttcacaatagataacagaacggcttcagcaaagggcaagcaagcgtagagagatgctggagaagaacaaggcactttatccatgtcccccacagcaccctgcctcagcgccggggcaaaagaatctttgtgtgagcccagggagtcggcagggacatgaggggttgatgcggcacttgctcagagcaatcgcagtgctgccgctggaattatctttctcacacagttcccagtagtggttaaaaggctctgaggtcagtccgcctggcccactagctaagggctcttaagcatttaaggactctttcaacatttgtttctgttagtttctaaaacttggaacagagggccattgatttaactggtataacaacgtgtgggtacattgcacttgttaccttggaaatgcctctactcagtctcacctctgagctgagttagtttgggaagatgttgagcctacaggtagtggggagatggtgagattcaccaaggcatgtgttgtttgtgattgattgggttgggaaagtttcctgactgccaaaacctccatcagacactagccggggattctgtaaatctcagaattccaaggggattggattttgaagaaaggagatgttcacgtacaggctactagaattcttgttctttttttttttttttttttaaagaattctgaagaagaaaataagtaagagatctaaaacagaaccatattttgccaggagggcagagcagggctgctttgttcaatttgttaagagggtcagggaagcatcagaaaagataaggagaaaaatcaatcagaaccaagtcactgttgtgagtttcggcagcgtctgaagtagccagaaggtactgagaaatgtattttatcacatatagtcttattttcaccctaccgtattttctgttaacacaaggttcctttaaagtcaagtatgcagccctaaatcttatcgacccattaatatttcatccaaaacaatgtaacatcttaaactgaaacctaaatgtaagctttggacacaagcattcaaagacaggtatgttgtacagctggactatggtgagtcaagtaacattttcatttctttttttcttttagaaacagggaaaattgaccaagagattcacaaatacaacaccccaggattcactggttgcctctccagagtccagttcaaccagatcgcccctctcaaggccgccttgaggcagacaaacgcctcggctcacgtccacatccagggcgagctggtggagtccaactgcggggcctcgccgctgaccctctcccccatgtcgtccgccaccgacccctggcacctggatcacctggattcaggtaaagtcttcagcaacctcaggcaggttgcttcatttctttaaacctcagtctcttgggactatggaatggatttaataacagaacctcactggtaatgtcattggaggattaagaaagggcaaaggaacgttgtgagtacggagttctcagggcagcacttagcacatctgaaatactcagggccagaaataaataagttgaaggtaaagaatgtaggaagtattaactcttcaattaggttaaatgatgacttgcctaaactgatgtctgcgccatgactgtgggtgatttgatcaattcactgtctcacttttgcctcttatgactcttaatgacttgctgtaacataatctgtgttttaatttaagaagagatttacctaaagcaatatagagatccgtctcctggctctgtatttatatgaataatactggtggcttccagatctttaagaggtgcctttaagcttgcaaaactctgtggatttagtcccacttctttgagtgggaagacatgtaatttgaaagcacagggctcaaatgaaaggatgtagctgttggctgaaaaattaattggatgaaaagagtatacacataaccctgggtgggagacagcctattaagctgtatctcaggagacttaggtcgtactcctagctccacctaaattggccttgggcaactcaagtgacctgcccaagcctctgctttttcacccataaggtgaagaaggggaggggagtgtaacctctaagtgacctccgaatccaacattcagtgggtctccaggcaacatgtgatgttgctgaagctaaaaagaggaagaagatgaggcaggaagcaacagctaggaggcctggattccagcaccatcactgcctctcaccagcagattaaccttaggcagttttcataacctcattcctcagtttccccacttcctaaatggagataagacctaacccttggaattctatttaaagtgatgtgtttaaatctgacgtgttttatcacaagcgttaaagtttagctacaataatattaataatctaatattattatattagacacaatttgctataatgcttgaaccttgagtaaagacttccaaatcctctccccctgcaaacttgtaatttgtaacagttcattctctaaacctcgtgcatttgattgctttaatcatgttccggccctgcacatggagtgtgtggcttcagtgcagccattgtcattgtgattccttgccagggctgtgctgcaaagctttgtgaagcttagagagaagccaaaattgccctgttgtcagaataacccatttacagacgaaacaatcctctttgttcctcacacatggattcctagaacttgacgcggggcgctgtgagctaagggcacgtatgaagaattcccttttatgaatgttgttaagattacacagtgggctggcttgaacaaaggaaagcattcctaatgctgaaagaagaaaagtaagagtgaaaatacaagaggagaaaagacatgtcagggccacagaggaacagagatctctcagataaattcctccaaatgcccgagtagacaaataccgtgaatgatctttgcaaggcaggagtccttccgctgtcaaagggacccactgcctgaggctgtgagcacctgtggtctgagtcagggccaatagactagtttctaaaacatctagatcctaccttgggccaatatgagttttatgtattattacttaattaggaacttgtttgttaagatctgtgagatatgactgtagggaccaaagagtttttgttcctttactttaaaaaaatcatgctttgagtgtgacaggttttttttttttttttttttttttggagacagacagagtctcactcagttgcccatgctggagtacaatggcaccattgcaacctctgcctcctgggtttaagcgattctcctgcctcagcctcctgagtagctgggattacaggcacccgccatcatgcccacttaatttttgtagagacaggatttcaccatgttggccaaactggtcttggactcctaacctcaggtgatccacccgcctaggcctcccaaagtgctaggattacagagtgctaggattacaggattcttttgattgatttatgaaaatgtatatagggaacatatctgtatttgatgttcaaatccaaattctgtaattctgatattatggtaggcctgtgctatgtaacatgagatccatttgcagaaaaatttccacttacacttggagagttcttacccagtgtccagcagatgaagtattaatgcaattgtcattataccaattacaaggacagaaaacagttgaccgggctcggtggctcacatctgtaatcccagcattttgggaggctgaggtgggtggatcatgaggtcaggagttcgagaccagcctgaccaacacggtgaaagcccgtctctactaaaaatacaaaaattagctgggcgtggtggcgcacgcctgtaatcccagctcctcaggaggctgaggcaggagaatcgcttgaacttgggaggcagaggttgcactgagctgagatggtgccactgcaagactctgtctcaaaacaaaacaaaaaaacaacagaaaacagtttacaaactataaggcagaggtttattgaaataatatgattttcctcttttaggtgaataggaacatgagagacaatgtgggttgaggggctggaaggggcagaggacagacgtagaaatgagggaaggttacttaacagcagcctctggttgctcagtgtcagggaggaaaaacttttcctctgtcctcttaagttcagtacctgggggcctgcaaattaagctgataaaagacagattaacaggtgggcagggggaccttatttatatgcatataggagcttgaaaaagaagaaactcagtaagtagttaaagctagaaacttatatgcccagcttagtagggaaaagaggcagtgggggaaaaggcctctataggaggaacagatggatttctagaagaacaaatgagagataaagagtttgtgatagtgcttgttcatgcaggcctgagtgatctctgtatctcattcatggccataaaacttccctggagagaggacttacggtaggtttcttgatcatcttcctgggagtaaaagccacccgtaagagggaggtatggcagcctcatttttccagaagtctctgctttttgtcagataaaggaagcaccaagaaggcttctttctgcacctattgaatccccagtggcttcagtttaaaatgagttccataccaactcgggttctaagtgcatccctcacatcagcaattgcactctggtttcgtgagcctaaggtcatcattctgaatttggactttacggttttgcacttttctggtaatatttcatgtttgactagaataagattccttgctatcagatatttaaaaacaaaacagtatatacacaaaaatgcctttctacctgtaaataacgtgaggtacttgagtctgtgtagggttaggatggaaagaaaataacatgagagctcgtgagtcctggcttgactagaggacatttggaagtagattatctcatctggtgccttggaagtttattcctcaacaagcagcaatgggtctcctggaagcttttttagaaatgcagaatctcaggcccctccccatactgactaaatcagcattcgtgttttttagcatggttcccaggtgacttaccactgcaatttaaaagctctaatcttgtatagtgcttctcaatctgggaagcactttaaaactacctggggagctttttaaaacccaaaactacctggggagctttttaaaaccctgatgtcaagactatacttctgtcagaggtgtctgaaccagagcaactccatctcgaataggggctgggtaaaataaagctgagacctactgaaaactggttgcagtaaagaagccagctaaaaccatcaaaaccaagatggcaatgagattgacttctggtcatcctcactgctacactcccatcagcaccatgacagcttataaatgccatagcaatgtcaggaagttaccctatagggcctaaaaaaaggggaggcatgaatgatccaccccttgtttagcatataatcaagaaataaccataaaaatgggcaaccagcagcccttggggctgctctgtctgtggtgtagctattcttttattcctttttgttttattattatactttaagttttagggtacatgtgcacattgtgcaggttagttacatatgtatacatgtgccatgctggtacgctgcacccactaactcatcatctagcattaggtatatctcccagtgctatccctcccccctccccccaccccacaatagtccccagagtgtgatgttccccttcctgtgtccatgtgttctcattgttcaattcccacctatgagtgagaacatgcggtgtttggttttttgtccttgcgatagtttactgagaatgatgatttccaatttcatccatgtccctagaaaggacatgaactcatcattttttatggctgcacagtagtccatggtgtatatgtgccacattttcttaatccagtctatcattgttggacatttgggttggttccaagtctttgcaattgtgaatagtggaggaggagaggtgctctgctttttagagtttccagtttttctgctctgttttttccctatctttgtggttttatctacttttggtctttgatgatggtgatgtacagatgggtttttggtgtggttgtcctttctgtttgttagttttccttctaacagacaggaccctcagctgcaggtctgttggagtttgctagaggtccactccagaccctgtttgcctgggtatctgcagcggtgtttgcagaacagcggtttttcgtgaactgcgaatgctgccatctgatcgttcctctggaagttttgtctcagaggagtacccggccatgtgaagtgtcagtctgcccctactggggggtgcctcccagttaggctgctcaggggtcaggggtcagagacccacttgaggaggcagtctgcccattctcagatctccagctgcgtgctgggagaaccactgctcttttcaaagctcagatggaaatgcagaaatcacccatcttctgcgtcgctcatgctgggagctgtagactggagctgttcctattcagccatcttggctcctcctattcttttattcctttactttcccaattgatacagtttgactatgtccccacccaaatctcatcttgaattcccatgtgttgtgggagggacctggtgggaggtaattgaatcatgggggcaggtctttccatgctgttgtcgtgacagtgaataagtctcacaagatctgatggttttataaaggggagtttccctgcacaagctctctctttgcctgctgccatccatgtaagacatgacttgctcctccttgccttccaccatgattgtgaggcctcgccagccgtgtggaactgggagtccattaaacctctttcctgtataaattacccagtctcaggtatgtgtttattagcagcatgaaaacaaactaatacactaataaacttgctttcactttactctatggatgcaccctaaattcttggatcttgcgtgagatccaagaaccctctcttggggtttggatcaggaaccctttctagtaacacttccatgcaccatttctatagtttcttaccagagaagtttctctgaacatgtggagcaccggaaaccacgaggaggcggctcagcattcactcctgagcatgaagctggctcttggtggtgcttctctgcaattgccttttgctgctgatgatcactcttctcttcctttgggagagtgaaagggaaaggaagccatctgaagggtcttcatggttattttttaaaaagaaaaatcccaatatctagtactaaacccctgacggaccaaatcagaccctcggggggataggagggacacaggtgtgtgtgatgtaaacccccctccccaggagtgtccagtgtgtgaccaaggtcaagaatcactcaccaaatgaaagaagggtccctttggtaagtgcatcaaaataaggttaccaaaagaaaaaactgaatacccaaatactgcccaaaacatggtttatgaaaaacaataaagccgttaggtggttaaatcacaaatagtaaaggctgtaccatcaagcttgcaaagagaccaggctctccggccattttataaggaagctcactcagaggagatgtttttacctaaacttgaggagaactgatctgcctgtttgcaactggaaagcagacttgaaacaaacaaatgaacaataaatttgcagtgtggggcaggactcggtggctccagtgaaagcacctcattatgaggaagatgtgaaattattactgtgttttgaattggctgctaacctactctgaaagatagaaaaagatgctgctttaaaatgagggctgtgcttttctgaaaatacagcaggtgccttgctgtgaagagtaaggaatcatatggccttatggttaaagggatcttggcaaaccagggctactcaatccatacctataccaggatgtttgcatacctataccaggatgtttgttttgcaggaacttggtgttagaatggaaattagaattgaagacatctacccataggtctggtgatctttctgctcccatacctgtctttctactgtctgagatcatagtaaatgataaaaacagaaaataggttctaaggtatgctggctttagtaataagattctttttctcatctgtaacactactgttacacttctataacaaacactatttgttacctctccaatgtcctttgggctctatcagtgttttctaaaatgagggacatttatgttggtcaggttgtgcactgcacaactataacagatgtcatttgtagtgcagtctctggcttctggagcagtgcagcatgtagcctagatagggggtcgccattatgggaagcaaatagacatggcctcgtgtaacatacaaagcaagtcatttcctgttcatttgtctttcagtccttctgattttataaagagaaagtctctatttggttctggcacgcttttaacacctctcccatgattgtattttaccttataataaagagagaacaggcttctggttagtgcctcacaggcaatagaattactcagtagggatgtaaagttttatcaatagatttatataaataagaaatttaaccaattttgtgaaaataagtaaataaataatacttggattttacagtatatgtcaagaaaaatatgaaggtgattttcacatgattggagtttgggaaacactgggcagtagagaaagatcaccccaagcgctagggcctagcatggggctttaagaacacatttttatagggggatgaggtaaacaaaagacttacacattatgatttaagttgacttgatttaaaacaattctgctctattggaaacatccaatctttttttcttctagttatttccctctttgataataagtacagcctgtttctaaaccattatatggtccttaggaatatttttagaacagtagttacaaggtagaaaaagtaacccccagccctgagttaaggtttattttaaggtcacagaatgccaggcaattgccgtgatttacctctcagaattatggactctgttgtgtttcttcctttttgtctaatttagggaatcttatttgcttggaatgaaaaggatttgccagcaggaagacagccacagatggcagtgcacattctgtaaaatacaaaaacaaaacaaacaccagaaaaaataaatccaagagtctgatcccataaatttctgcactaaggagcaactccaaactgcacaccaagctgctttaaaaggcgtttgtgttaagccttagagtgttttatcacattcgtgatatttgatacagaatacgtcagaccaaaagccacatcctaggatcttctttaaaatatcattaaaatagatgaagcattttaagatgtaaagtttcatttcctaagggatcctctagttgtaaagattgcagctagttgttgttgttattattatttgagatggagtctcgctctgtcactaggctggagtgtagaggcgtgatctcggctcactgcaacctccacctccggggtacaagcaattctactgcctcggcctcctgagtagctgggactacaggcacgcaccaccacacccagctaatttttgtgtttttagtagagacggggtttcaccatgttggccaggatggtctcgatctcttgacctcgtgatccgcccgcctcagcctcccaaagtgctgggattacaggcatgagccactgcgcctggccacagctagttattttaaaggacttctagtaggtccaggctagattctcagcaaagtttgcatggtatgtgatgtgtggtgcatctcaccccagaaaggacctgggagtccttctgtaaattgctagcaggtgaattcacagcatccactgtaaccttaagttatctggttctctgccctaacgctaacctgcatctgacactgggaggtccttgaccaggaattctcacagctcctccaacagggaagtgggtaggagatggaaaattcagaagcaggagtggagggaagggagttaacacccaattctccacctcccccagaaccaaggccaggattgtcaagaatccagggttgagaatcccctgccaagctggtccagtggattcactcaggttggcagagtggctgaaaaccagccctcttaggcacgtgggtcttctcccagatatattaggaactagatggaacttggcacttgggatcactcagtgtaacaaccccatacccccattagacttgagtatacccagcactgagctaggaactcactcaggcttcccgtcaccacatcggacactttaccactggccacagattggtttctgaagacctcttacctccatcgttatgacttctaagttgatttctgtctatattccaagtttcctttctatcatctggccataaaatatttttatatcttcatgtgcaaagagttatggatataaagaactttttaaaattacatatatcatctattctgttttctacctaactacaagctgatcattggttttctttaccacctgcaagcacttaaaagtaatcattcctgctcttataattacatctgaattatttctgaacagatcccttttctctccttatgctaagactgcatgattaatgcatttttatctctcacactcagtctttttattatgttatttgtctttttccctcttcagtcaccaacacagttcacacttaatcgtgtgaagaaaaactatcatcccttgcttgctaatgtgcattttcctgcaaagatccaaattccacttttcctgcaaaaacaccaagcgcatttatgtatctcaaatcaactatggtattagtcttacctatttttgcctggtcattttagttgtatcccaccttttgtttctacagtgttttcatagaaaatcagtttctacagtgttttcatagaaaatcacattgtatccatgattttgttgagtcaaaggatatgtgtgtttttaattttgatactactacaaaccatcctctaatgatataatccgattgacagtccagcaatctatgaataccttttccccacatcctcaccaaaacagtgcatcatattattcttttaaatgtggctgttctatatgaaaaataaaattttcttgttatagtttgtatttcattaattatgagttgggttaagtatctttgcatatgtttatatatcatttatatttatttttccataaactccctctttatattctttgctccaataattatttatatctttatattctttcctattgatttataagtattcttaatatattaagtaaattagtatttttaatgttttccttgtttcatctcaatttttttgaatttatgggatttttttttccatgtaaaagttactaaattttacatggtgaaatgtaaagtgttttatggcttttgggttttgtgacataccttctccatttagaacttattttttaaattattccatgttttttataataattttgtgttttatttgtaagttctacgtattttcttccctggaaatttatttgggtggaaggtggaaggtaaaaatctcactttattttttcccaaatggcccactgttccagccccattggttgaggctccatcctctccacctttaccatcttctaaattcccttcatttctgagtccctactggactctctggtctattacattgatatgatgccttgtgacatgggagcaaactgcagtacttatcattgagcttttattatcacatttagtggctcatagagctaatttccctttttttctgagttttttttcccagaattttcctgttcatccttgcacatttgcttttcccatgtggatttgagaattttaatcattttattggaattgtttaaaatttttactgggattaaggtttatgtataagttcattacctggtgatgcccagttacaccatgcgtgtcttctccatctctctccaagttgcgaaatgattcagataagtgtcatccagattttaatgtgcttagaatcacctgggggaaattagcaaatgcagattcagctggtcaaacatgggattagagattctgcatttccaacaagctcccaggtgctgctgatgcagcgggtccctggaacacactgggagtggcaaggagataagcagccttgaggcactgcctctggtagatttcataggtttcccctggaaaaccacttgagcccactgcttcttgtgggagcagatctttgacaactctctcaagttattttatgataatctgtctaattagattttctttctcatctaggataatacccgttattttatctttttctagaaattcgtgcatttaacctaggttttcaaactcattactgtggagttgaacagaaacttgttaataatttaatttccattccctttttcgtgttttttatattgaatgtttctgttgaccccccccccttattgattagattatgtggctttttttttttcttttctcaaagaaccagctcttagatttatttgtcaattctttgttttctttctactgtcgtgtcttctttaaatttatatttgctggcctctaactttctaatttgaatgtttggctctctctcttattttccttcttggtggggtgtgtgtatcatggtcttataagaatgtgaaccgaagtcaacaaatcttaaactccagccatgctctcttctgaccacacctctgctgccccagccccgcctccaggactgcaccctccagatgtaattgacaccaatggcttgcactagactttttgctaagggacctgaaaagaacttagaggctggcgtaagttgccaaagccttcccacatcactgagagaatagacttggcaggcttgtgttttgaaaagcagttgggggtgcgctctgtcaaggctcagccatgatgaagaaataatcaaagagcaaaacgtcacttaagtggctaaacatgactggcagcagggttggattccccttcagcatcgaacacctcacaggccatcctctgtgtagacgggctgctttctagtggctccacaggcctggccgtgtcaggggctgcctttattcaaagacttctgttctgtcttaaccaggatcacttaactctctgaaactccagtgataaaaaagcaaaaccggcacaaacatacagctttggaactatctccaaggtcattgttttttcccctgccgcgaatttctttcattcctaattttcctctacctttctttcccttcatcccctacgatagattttgaaccccagggaggttaggactctgtcccgttcttctccctgggctgtccaccctccgacccccaccccacctggcatggcactcaaaggtgcattttcctggggtctgtgcatggaaatcattgcagctgtcagcctgtgtcacgtggggctggctaagtgcggggcaacgcggttgtacatgttgccatggtgacttctctgttgatggcagaaccactgactccagcaagtcacagtattcatttttgcgtcatgctcgtgctacaggaatgctatgagtagcccatgaaaagggaggcgagttgagctcagtgttatcccttgacttgtgtgtctttccttacccccagcgatcccccattcagatgcttcctactgtaccgcatttttgagtattcttcagtatcatgcttctgttacagcaccatatcactcagctatggaagcactcagaggagcacaacaccctctaaattatccgccatcacttcttttacggcctcatttaaaaagacaattgtcagaattcccaggtgtgaattctcacaggggaatctctgtcagtcaccacctggaaatgttagttccacctctgctggccaatcagcacctcatgtccttgctatgatctctacagttgcagaagcattatcctgatgaggtttttaacacatcaccacatgcttttcagagaaaagtccttttataaataccaataactaaacatgataaattgcttcactcctttgagatctttgtctgattccacgtgctctgcatagactattcagaaattctaaagacggatgcagattcctaattctgctgttgagtttgttcctgagagcaacgctgaaagacttttaaaaaattaaaatcagctttatgttgaaatgtaattgtacataaatagccatatgaatgtggggtacagttattttaaacatagaaaataagatgaattgttttggaaattcccctttaaacatgctaaaatgattttcaatcattgacgggaattttaacttttagaaaactggaaaggatacagacaaaagtagtgataacttaaatttgtaaactattttatttgttgaaatgctttaatgcatgattttgttttatcctggaatggccacatgtggtaggcaaagtggacattatcagccacattttaaagataaggaaaatgcagctcagagaaaataaatgtattcattccctcagcaaacactgactgggtggccacagaagtgcggtgcacaaccctggctgcacatcagtcacctggggagcttttcacaaatcccaatgcctgttccccatcccagaggattcctggtgtgcatcaggattgtgaagcaatggggactgagtttatagcaccttactctaaagtatgcagagactagcattatgaagtggaaaatgcatatatttcagattcagttatttttttcccactattccttcctctcaatgaaaattttggagtaaaacatataattccagttctttattctgaactgtcttactattttctatcaccctttaaatataatgcagaagtctggaaggatatgtaatttgcatacctgttggtgaaatccctgctactaaatacactttgctttttcttgttccacattccccttttcgacagggaataaatcatccccaaggctgctagagccaattaaatattttttcacactccgttgacatgaatgagaagaactgtgacagagccacacggctcatgccaggactttatcacgctatctttataatgatgtgagccaggcaccagggaggaatggtgtggggaaccatcaggaagctttaataaccaaggataatttgtttcatcagtttctccttgatggccatttgccatttcacctgtcaggaagcaaaactagttgtcttgtgagatctcaggttaactcaagaagagaacagctcagacaacaatggaagcatatttagcatggagcttttatactcagttctctgaagtcagccttcttggaagaaaatacattgtcttgggattggaattataaatttcccttgtgctaatgcaaccgaaaagagtatttcaaaaccaagagccgaactgggcattcataaaagacttaaaatatgtgtagaattaatttttaaaagcactttaggtttgcccatgccccccttctaaccgcacagtggagacagaatctggtcagctgtctgtggtctgggtgactccaccatgttctcagcaacgctcctcatctatgtattatactagtttctgaaaacttaagaataaaaaggatcaacctcacattttgatgaaatagcagttacaacacaaacatcccatgcctattggcagaactggtccacagagcacagaagcacattcatcgtgtaaagctgaaaacagcgtcttctgcaagttgagataccgaggttccagcagaagataaaaagcatttaaaaatatttaattattcactgaactcctttgaaagacacaggatgacaaagcagatcaataatattcagccatttccaaagggtccatccacagccaaagtatggcctttgaatttactagaaatttccacagagggagagtaaaaggaatcccttcatccttgcttgagtcctaaaataacatgcgcctaagtattctcacaaatgatgaagcgcatctcttgagtagacttaaggtgataaaatgttattttcactgagctcccaagccatacatcatggaagtccaaagcccttactgataattgcataatgcccaggggatgtgtttctctgcagaagtctgaagacaatagatccagggtctcctgaagactttcatcttatgaattgtgcgaatccctgaccactgcctaagaggaaaggtgaaatacatcagagaatgtccttaaaaatatccctttttgacttactataattggttgctttcctcttttaactatcataattttctcagccaccctctccctagaaactggggctatttctatgactcagcaaacaaccaattcttgctaatactgctttgctaataaggaaaccacaagttctcttagctgagactcctgtatagcaggtgtgttcacaaaacttggtgagcacccatatctgagacacagcattccataaagccagaggcagtcaccgaggctgtctgacataccataatatgcccgtatggcttcaggctttccaccctgatctggctgtatcccgcattgcacccatgcagcagcagaaccagcagtaagaatgttttgtcaaaaaacaaatccataaacttcaaaaaaatccacggtacagtatttttaaaaatacgtctagccaggcgcagtggcacgtgcctatagtcccagctacatgagtccaggagttcaagatcagcctgagcaacatagcaagaccctgtctctaaaaagaaaattttaaaatgcatctgttctctctcatatatgcctttaaacgcatccatagcatcaagaacctaaatgccaacatcccaatatttttcctccctgataaacttgctttagagattcaacttgtatttttgctttgaaccaggaaaggtatccaaggtcatactaagataaccatttattaaactctttggctgttttttcctaaactgtaataaactccccctctccaacattcaaaataatagtaaataattctctctgaaattaacacagtgttcctattattgctttcacaacactaaaaagaaatagaactaacggagtcgaactgtggggcattctggcaggcaaatcattaaattcacacaaatgattcggccaagggaaaaaggacaaggttctcagaaggaattatttcagctccctctcagacactgctttaaattaaaacacacacacacacgagcagctgaagacctgagtcaccaatggtctacattaaatttctgcaactgaaagtcaggcaggtattcaagcactctgggagcctgttagaaatacagatgcccaggtcccccacccgagaccaactcaggcagaagcagcatttttaccaaagctcagggcatccgtatgccccttaatgtttgaaaggtctgaatcagagtgctctcccccaaaggcatctcagactgagatagaaattgaagaaaaagcctaaggaggttcagcaactttttcaaggccgaagaacccaccagttacacaagtgcagagccctttgtccctgacattcagagccctgcatgcataggaagtgacagccccttccggggcaccctgctgccgccacgcgcattctggaaactgtgcagcaggagaaacagcgttttccttcagaccggggtttaaatggcacttcccgaatttatattcccctagatttggggcttcttccttcttgcactcctgttaacatcagcatgaattcataaactccctgcagcggaaaggaaaagaagccgcgacaaacctcaacgaagagccgtacggcactgttaaccaagtgctccagtcctgccccagtgtttacaggaaattggttccaggacccccaaagacacccaaatccacagatcctcaagtttctgatagcaaatagtgtggtaaatacctacatataacctacacacaccctcccatatactttaaattgtctcttgtagattacttgtaatacctaatacaacataaatgctatgtaaagagttgttggccaggcacagtggctcacgcctgtaatccaagcactttgggaggctgaggcaagcagatcacgaggtcaggagttcgagaccagcctaaccaacatggtgaaacccaatctctactaaaaatacaaaaattagccgggcatggtggcgcatgcctgtaatttcagctactcaggaggctgaggcaggagaatcacttgaacccaggaagcagaggttgcagtgagctgagattgtgccactacactccagcctgggcgacagagtgagactccgcctcaaaaaaaaaaaaaagatttgttatgctggattgtttagggaacaatgacaagaaaaaaatatctgtacgtgttcagtacagctgaaactttttttcccgaatatttttgatctgagtttggttgaatccacagttggggaacccgtggatgtggagggccagctggatagctgctcctggcagtgaggctctctgatccagactttcaaggttcaccctgagaactacagtaagatacatgagagagtcctgaatgaggagtcgaaagacctcgtcctcgtagcagcgactctggcacccaccaaccatgtggctttcacctaattatcatccattctgcatttttgcctccttaactgtagagaggttgtggaactacagaatctataaaggccagctgtcacaatcaatactttacaagtgcccacaatattttacaataactttgaccattgatttataaacaattataaccaaacattaggactggaacaatttgcccacctgagaaataacaagacatttatctcacatgaaaatggacaccaaataccttaccttcgtgtttattttatgaaatacaaaatctgagcatatattaataatgagctatttttttcttttttcttttttttttgagatggagtcttgctcttttgcccaggctggagtgcagtggcacaatctcggctcactgcaatctccgcttcccgggttcatgctattctcctgcctcagcctcccgagtagctaggactacaggcacccaccaccacacccagctacttttttgtatttttagtagagacggggtttcaccgtgttaaccaggatggtctcgatctcccgacctcatgatctgtctgcctcagcctcccaaagtgctaggattacaggcgtgagccactgtgcccggcctaatgagctattttcaattaaaatacctctttatcgttaatcagacaaaagagtacaatgtcagcctactctgagagcattaagaaatctttttcctgaaaggcaattgagacaattcagaagttaactaagtaactgatggaaagagggagtacaatggaatcaattgcccactcagtcctttcatataaaagttggtttaaacaatcataacatatagccgatgacgacaaatttgtttattctgtttctcttcactcgacctcttttggtcactggatcttggacaatcatgaaagcagctgccactttctcattcctttaagaagctggaaatgtaaagcttgtttaacttttcaagtcaggagccaaaaagtcacaatcaccttcccctgtttgaaattggaaatgctggctggctactttttttttagaaactaggaagtgaagggtagagagagaaatgtgaaactcaggatcatgtcagtacatgccacataatgctctgcctacggaaaaacctgctgacttagagaaatcgctccctcccaaaaatgtgattagcagggatcctctcttaaaataaaacaatgtcccttatatcttcagcatcttagtcgataaccatttgttttcatatctgtttcagaaatatcaatagtgaatggctaaaaacattatttaagaaaaacaatcattttctgctatataactcagatttgaaaacagaataaaatgtaataaaacaaagaagctaagaacaaaggcagagatacctcatctcgcccggacccactgtaaaaataatgttgcaatttaaattaaattataattaatagcagcagttttgttgaagtgtctcaaattattactttagatgctgaaactccagtggtttccatggagatattttctctaggagatgtcagatatgatctaatttttttgtctctgatatatgacaacctgaagcttccagagcctttcattttggggggttttatgttagatatttcaatttatttttatatgcacttcaatatgttttgtttgcaattggtttctgagcctaaatattttgaaacttagtaaataagaaccacaaccaccaaatttatcttctgtagttaaaaaaaaaaaaaaactttactctctccttattcactaggacagacaaacatacttctccttgggtgaggagcatagtagtgcatatgtgtgtgggcgctaaagccttagccaggatgtttactaagtacgttcctgggagaagactctcccatcatcaattcctccagcaatatgtcctgcctggcctgtgcttggtggaggaggggaggagagctaatctctgagtggtgcaatggaaacatggtctacaaatataggaacacggatgactacacacaagggcacgtgcaagggaaatatgcagaaatatgtgggcttttataagactctaaatcagactggaatggcaccatgctttggtggttaacatggagtgtcatttggggatccgcaagagaagtatgttgaatagagtctgtgcttatttgatgaaagactggtcttgagaatgttatagctagtctgttttaaattaacacgccaaatttggacctactcactgtttcccaaagtataggttccttgatactccaacaccactaaaattgttcagctctcccagcaagctgggtgaggggaacgtggatgttagcagtagaataggtgagctttattatccatgtctcagtcatgtttcttggtctccgtttttctctgtgcgcatttccaagaggatgtttgttcccaggggaaaggtcagtggcaataaaatgtatctatcaaaatagcaattgtgttgatcgccagaataaaatggctttgcctcaagggggtaagcactcacatgcattaggacaaccaggcttacagcataaataaatccaggaaaataggagtgctcacactaaacaaacaaaagattttgcccttgaaatgtataaggattcctgacctgaggattttctacaagttattttctaacaataaccaaagtccagcggactaggagtcactaatatattttctatattcaatatgtccatctcctttgttaggaagaataagaaacctgcctcactgtaaggatttagttgagactaggcatctgactttcaaaattctacctgcatagaaggttttgttatcagaagaagctaccgatgtttacatacctcttaatcaactgattttaattatgccagccaatgaacatccatttagcccttgctactgcattgttagtcactggaactgcaaacatgattaagattggtctctgacttgaagaggatgactgtcatgtaagaagtcacaagaattaagattattcccattgagaaaagggacacacagtctgaggtcgctgaggatactttcaggaaagtggtaagatctgatggacaaagaaaaggatagtaaaccagatgtccagacagagtgccatatggcagagaaaaggtgtgtcaactggaggcatcaggaactcctatgagacgggagagttccctagaccccttcactggacttgcaacagggtacagctcactcaaaccttttgcgggacggcgagcacacaggcaagtgggtgccaccgctggggtgaacgcttttggtctccagccccacagcagcatctaggggtatgttacaattaatgctgttttaacagttactgtctggggatggctaagtgttaaccagctcattggagacagggtgacagacttttaccccctgccctcttggtacccaggtccttgtctggcatccaggaagaatcaggtcacacagttttattgagtgatggaggtggctctcagtgggatggggagctggaaagggatgaaatgggaagataattctcttcagtcatcctcagcgaaactgctttccaactgtccagttacctcttcaacattcagatgctgcttctcctcttgatgttcagccgcttgttctcttctctcctctgccacactgctctgctcctctgccagtggagcttggggtttttatggttacaggactggggggcatggcaggccaggctggttttggaaaaagcagcatttgggtgggaaaacagggctgtgaatttctcatttagggctgtgggctcaggtttgtgtgtggaacccttgccagggactccaccctcttctacccagtatttccctgcctcctgtccatatcacctatacctagaatgttgagttggaaaagtgaccccaggaaggaaggggcaggagagaaatccagctcaagggagtctttcttccctatgccaaggagttcagatttacacccaaaacaatcgtggaatatttttaaatgttcctccctagctcttgtcattctccttgcgtcatctcaggtaactccttccactatctccgtatgttctgctactgtttttatccgtaacctcaagggaaccagattaccattgtaattttttttttttttttttttttttttgagacggagtctcgctctgtcgccagggtggagtgcagtggtgcaatctcggctcgctacaacctccgcctcccaggttcaagcggttcaagcaattctcctgcttcagcctcctgagtagctgggactacaggcacgtgccaccatgcacagctaatttttttttttttttttttttttttttttttttgagacagtctcgctctgtcaccaggctggagtgcagtggcacgatctcagctcactgcaacctctgcctcccaggttcaagtgattctcctgcctcagcctcccgagtagctgggactacaggcgcacgccatcatgcccagctaatttttgtatttttagtagagacggggtttcaccatgttggccaggatggtctcgatctcttgacctcatgatccacttgccttggactcaccgtgcctggcctaccattgtaattttttatcactatatttaatatatttcgaaggtacatattatttaaagaaggtcggccgggcgcggtggctcacgcctgtaatcccagcactttaagaggccaagaccggcagatcacgaggtcaggagatcgagaccatcttggataacacggtgaaaccccgtttctactaaaaatacaaaaaattagccgggcatgttggcgggcgcctgtagtcccagctactcgggaggctgaggcaggagaatggcgtgaacccaggaggcagagcttgcagtgagctgagatcgcgccactgcactccaacctgggggacacagcgagactccatctcaaaaaataaagaaagaaagaaggtcatgacggggcaggggataagggaagacaaagaaaaaggaggtcaggaaatttctgcgtttatcaaaaggagacaggaaatatcactcactcacaaagtatccaaatatctagtaaatatctccacctgggtgccccattagcacctccaactcaatatgtccaatacaaaactaattaattcctcatcacctaaaagggctcctcctcccatagtcccaacccaagccaaactgtctgcaagctgggacttcctcaacccttcaactccttgtccctttctagccttcaaaaggcagggtagagaagattgttgactttggaacgaaccctacacctgggttctaattttaactagactattcacaagcttggtgactttctagaaggatatggactaaatagtgtccagagaagagtaattataatgtcaaaaggtctggaaaagatgggcagtaacggtgcaagttttcattcctgaaaaatagcttttggtctttgaagggtggcttatgccagggaattgtatacattcataaccaaatcttcctgtgcttatggtttatgggtagcatgacttatcaggcaatttactgtaaatggacaagttcataactgaaaccacatccatgcttcagtatataatctaaagactatataaaccaaactcttcaaggatgcgtagaataaacagaccatgtcggaccaagaagttctcattagctaaagaactttattctttgtctattttattgttcactgtatatcctcagcacttggaaagaagtctgacatatagtaggcattctataaagatttagtgaataagtaaatgaataaatttgaagagaagattcaggtttaaaaaagaaagccaaggtttttattcaaggtttttattatatgtttttatataaaccagttttattcccacgggataattttaggactaatcttatatctgatgataagcctaataaatgaaagatctttgcattcttgggctgacatttgggattgggaatattaatccacactacctaccccagaaaatcctgaagggaaatgggaaagtgagctgatgagaaagtagctgactacactgtactacatgttggctctccccatttccctgcctagctaactggatttaggattggaccaattggccgggcatggtggctcacacctgtaatcccagcactttgaaaggccaaggtgggaggatcgtttgagcccaggaattcaagaccagcttgggcaacatagggaaaccccatctctacaaaaaataaaaaaatttgccaggtgtgatagtgcatggctgtggtcccagctactcaggagtctgaggcaggaggaacacttgagcctgggaggtccaggctgcagtgagccatgattgtgccactgcactccagcctggtcaacacagcaagaccaaatcttaaaaaaaaaaaaaaaaaaaaaaggattgagccagttaaaacaagcaaaaaccatcagtggtctcttttgcatcccccagttaaagacttggggaatatgaaatccttgaatacccaagagttaagttcactttcatttgtagcttgcttagtgtctgtgcttttactcagtcaactgatagttgagataatttggaatatatatacgtatctatctaaaaagtataattttcctggtcctaaacaagaatatcaagtctggccaggtgcagtggctcatgcctgtaattgcagcattttgggaggccagggtgagtggataacttgagatcaggagtttgagaccaggctggctaacatggtgaaaccctgtctctactaaaaatacaaaaattagccaggcatggtggcaggtgcctgtaatcccagctacttgggaggctgaggcaggagaaacacctgagcctgcaaggcagcagttgcagcaagccaagatcacaccactgcactcactccagcctggacaacagagtgagaccctttccccacactgcccccgccccacacacacacaaaaaaagaatatcaagtctaaaagagaaaggattaaatcacatgtgttgaaagaatctggaatctccctttttggttgccatatttccaagagaagaggaggaaaaagggctctacctgcttttcatcattatcccggataatcttggaagtccatagcccaggaataaattagtgttagaaaacggagtatgtagcaatgttctccctgaatcataacataaacctgtttgcctggtgtgtacacatttcattgtaccaaataagtacttctaaattctttttacatttaactggtgccatccagtagccagagcttgctttagactaaggtgacctgcttctgttggaagatttaccttaacttctccaacagaagaccaacaaatgtgaattgtttctgaagttggattaggtcctatggatgacagaagatagtctgccgacttgcagatggacttcgggatctatttgcctttaccgggcttaaaatttgttttatcttagagaaatacctaaatttaacacaactgattcttacgtttataatagggaaagaaatagaaaattcactaggcagttaatattcttaactgttttgaattattacccccttacaaattcctaaagtgtgccagtgtcttattacagccatgaaaaatacaagtttaaaggaatgattcctttttaaactttttaatactgtagctgtaaaaagctcatctacaaatacattgaatgccaccagttgtgcatggggttaaaagtggatgggaagcagatttcaaccaaatgtaagaaacatattcaaatgcataaactcgtctgtctgtggaactagagcaggccagctcaggtagctctaggattctctaatattgctccaagtgggaagtcgtgtttacctaggccttgtgcaaagagaaacagcaggaacagggatggaggctgttgtgattcttgtgggagacaatggcaagacgggtccatctgaaatggagatttcatttgggaaaacaggaagtgttgaagagttgcatgaagaaataggtatcaaattatttgggatcaatagtatacttgactctgacacttgactctttctttctctacagccagtgcggattttccatataatccaggacaaggccaagctataagaaatggagtcaacagaaactcggctatcattggaggtaggtgatgtctagaggaggcttatatggggctactcaactatggaaagtaatagttgtcaataacatagtagtctaggaaaaaaagttttctaggtttttacattattcattttgctgtttaaagattatgacatatgatgtgaagaaatatagtaaatatagccgggcacagtggctcacctctgttatcctagcactttgggaggccgaggtgggcagatcacctgaggtcaggaattcgagaccagcctagccaacatggcaaaaccccatatctactaaaaatacaaaaattagctgggcgcggtggctcacgcctgtaatcccagcactttgggaggccgaggcgggcggatcacaaggtcaggagatcgagaccatcttggctaacacggtgaaaccccgtctctactaaaaatacaaaaaattagccgggcgcagtggcgggcgcctgtagtcccagctactcaggaggctgaggcaggagaatggcgtgaacctgggaggcggagcttgcagtgagccaagattgtgccactgcaatccggcctgggctaaagagcgggactccgtctcaaaaaaaaaaaaaaaaaagaaagaaagaaagaatatagtaaatgtaacctggctactttttaatgctggcttgtaaaaaacaaatagcagtggaaagctggacagactcagaataattaagtaggtagtagtgaccatagccaggacatttctttatccccctcggatatttttcagtcttatcctttcgcatccaaaatggtccaggatagcgtactataaaaaaatgaaaaggaatgctgggtgcagtgacttacgcctgtaatcccagcacttcgggaggccgaggcaggtggatcatttgaggtcaggagttcaagaccagcctggccaacatggtgaaaccccatctctaaaaatacaaaagttagccaggcgtggtggcgcattcctgtaatcccagctactcgggagcctgagacaagagaattgcttgagcctgggaggtagaggttgcagtgagctgagatcacaccactgtactccagtctaggtgacagattgagacctttctcaaaaaaaaaaaaaaaaaaaaaatacgaaaagggaaatgccagtctgatttcagttatcataataaaaattatcagaaaatcactggaggtcattattttaagtgaaataagctaggcacaaaaagacaaatattgcatattctcactgatacacaggagctaaaagatttacacacatggaggtagaaagaaaaacacgtaacagagattgggaaagttgagcaggaggaggaaggagaatgaagagaagtgggttacagggtgcaaacatacagtaagaaagataaaaggaacaagttccgggtttgctagcagggtaggatgactatatctaacaaaaatgtactgtacttggttgatgaacccctaaatactatgacttgaccactattccttatatacgtgtaacaaattttctcatgtaccccgtaaatttgcacaatgaaaataataaaaactaaaaatgtatcagaagatttaacaagctgtagcatctaaaatattccagtgttttcttctcaccatggacagctacataataatttgactctcctcggatagccactgagcctcatgcgtagatcgatattgacatccctgttaccattaagatcccaatcctcactgtcttttgcttttttaaatgaacttaattgaagtataatacgcatctataagtgtaacaagtccgtaacttttatttattattattttttgagacagagtctcactttctgttgcccaggctggagtgcagtggcgtgatctcagttcactgcaatctctgcctcccgggttcaagcgattctcctgcttcagcctcctgagtagctggaactacaggcacgcatcaccatgcctggctaatttttgtatttttagtagagacaggattgtaccatgttggccaggctggtctccaactcctgacctcaagtgatccactcgcctcagcctcccaaagtgctgggattataggtgtgagccaccgtgcccggccccaatcttttttatagtttgtggttggtttgtcctatctaaaaagtctgcctacccaaaggttttgaagattttcagctttcttctagaagttgtatcactttatcatttgccatcaggtctttaatcacttcgagttaatgtttataaatggtgtgagagaagagtcaacgtcagtattttccaaatgaatatctagtcattccaagaccatttgttgaaaaaaaaaaaactatacttttcctcaattgaattttcttggcacttttgttaaagcaactgacatatgtgtgtgtgtgtgtgtgtgtctattttctgggctttttgttttgttggtctatatatatctttccttagccaatatcatgcttgctttattgttgtatctttttttgttgagatgggagtcttgctttgttgccaggctggagtacagtggcgcgatctcggctcatgcaacctccgactccctggctcaagcgattctcctgcctcaacctcccgagtagctgggattacaggcacgcaccaccatgtccagctaatttttgtattttagtagagacagggtttcaccatgttggccaggatggtctcaatctcctgaccttgtgatccacccacctcggcctgcaaaactggtaggattacaggtgtgagccatcgctcccggcctgttgtatctttatactaagtcttgaaataaacaatgtaagttctctaatcctggccaggcgcggtggcgcacgcctgtaatcccagcactttgagaggccaagacaggttcattagaacatcttaacgatatttagtatttctatctttacatggtgtatctatacgtttatttgtctcatcagtttctctcagcaacgtattgtggttttcaatgcgaagtcttgaacagcttactatttcattaatttcattttctaagtgtctctctctggcatataaaagtataattgatcttttatatcagccttgccttctgtgaccttgctaaatttgctgttagttctaataactttttttgtatattcctcagaattgtctacctagacaagcattttatctgagaataatgagatttttttacttgtttctttccagtctatatccttttgttgtttcattgcaccgggtaggattttcagtacaaaagtgaataaatattgagatttgacaattttgcattgttccctatgttaggggaatgtgtttgatctttcactatgaaataggatattggccgtaggtttccaacagatgtcctttatcagattgagaaagtttcttctactcatagtttactgaaagctgtttgatgaatgggtattggaagttttccaaatgctttttccacatctatttagatgatcatattgttttactccttatttgcttaatgtggtaaatcacattgctttattttttaatgttaaaccaaacttgcattcctaggattaacattatcataatacatgatcttttttacatattgctgggtttgatttgctaaaattctatttaaaagaatattgtggccaggcgtagcagctcacgcctataatcccagcactttgggaggccgaggcaggtggattacctgaggtcaggagttcaggaccagcctagccaacacagtgaaaccccgtctctactaaaaatataaaaatcagctgggcgtactggtgggcgcctgtaagcccagctactcgggaggctgagacaggagaattgcttgaacctgggaggctgaggttacagtaagcccagatcgtgccattgcactccagcctgggcaacaagagtgaaactccgtctcaaaaaaaaaatatatatatatatatatatatatatatatatatatatatatatattgctccatagttttcttgtaacatttttctggttttagtgtcaggataatgctggtctcataaaatgaattgagtagtgttttctcctcctatattttaagaaagatgtgtaggattggtctaatatcattaggtaatgcttgttagtagtattgttcgagtcttttaaatttttgctgattttctgttcaattgttctatcagttactgacagaacagtgttaaaaaatctccaactataattgcaaattggtctaattgtcctaccagttctgcccgtttttgcttcatttattttgtacttaggttagatttatacacattaggaacattatgtcttcctgatgaattcacccttttgtcattatgaaatgttcttcatttctactaacaaccttgtcctttgtctcatattaacgtagctattccagcttatgattattgtttgcatatcttttcccacccttttactgttgacctgtatttaaagttcatgtcttgtagatatcatatagtaggcatcttttttatccactgtctctactttttaattggagtgtttagatcagttatatttacttctgttttatctaatctgtattatttcatccagtatttttttctttttccattttttttttttagacagagtcccccccccccccctcacacaagctggagtgcagtggcacgatcttggctcactgcagcctccgcctcccaggttcaagcgattctcacgcctcagcatcttggctagctgggatcacaggagcgtgccaccatgcctggctgatttttgtacttttagtataaaagaccgggtttcaccatgttgcccaggctggtcttaaactcctgacctcaagtaatccgcccgcctcagcctcccaaagtgctgggattacaggcgcgagccactgctcatttcagacattgtgtgtttcacctctacaagttccacgttgtctcattttttttcccctcattttgatcatgttttcctttaaacccctgtgcaggtttctaatagctattgtactgtcctcatctgctcattccatgctctgtcctttctgtttctaatagctattgtactgtcctcatctgctcattccatgctctgtcctttctggctctccttctaattgactgatgtttcttctggtcaagtgacattttgctacattttttttctctgaattatttttctctgcagcttgacgttatttagatgtgttttaaagctttttcaggacagagctagagtagtctttattctaggcctattttagcaaacaccttcagcatgaccattctatcaactgtattaaatgctctgattgttcaatgaggtctcttcagtgtggttgttggactataaacatctcccagccctccgtgagctctggttttttgcctggcctgtggacttttattctgtacatgcacatgttagtattattcggccacaaattcagagagacttatgtgcagattattagggttctttctatacatagctctctcgcgcgcccactctatctcccctctccattcagggaaaccactgtgctttcttgtgctgcccctccctacactgctgtccaaaaatcgctgccagccagaaaactaggaaaaatgtaggattcctcctttttgtttctctgttctcagacatcatggttcctttctgcctgttttctaatgtctgtagactgtcatttcatagactgtgtccagtattttagttacttttggctggaagacaagttactcctgtttttcctgttactccttcatggacaaaaacagacatcttacttcatttttgttatctttgttgttttggaggttgtgttttatatgggagagggctgtgtctgacggagctgtagtgaagtggggacagtgttggagggactcccaagccctgtctaacctctcgtgcttctcctttctccgtcaggcgtcattgctgtggtgattttcaccatcctgtgcaccctggtcttcctgatccggtacatgttccgccacaagggcacctaccataccaacgaagcaaagggggcggagtcggcagagagcgcggacgccgccatcatgaacaacgaccccaacttcacagagaccattgatgaaagcaaaaaggaatggctcatttgaggggtggctacttggctatgggatagggaggagggaattactagggaggagagaaagggacaaaagcaccctgcttcatactcttgagcacatccttaaaatatcagcacaagttgggggaggcaggcaatggaatataatggaatattcttgagactgatcacaaaaaaaaaaacctttttaatatttctttatagctgagttttcccttctgtatcaaaacaaaataatacaaaaaatgcttttagagtttaagcaatggttgaaatttgtaggtactatctgtcttattttgtgtgtgtttagaggtgttctaaagacccgtggtaacagggcaagttttctacgtttttaagagcccttagaacgtgggtattttttttcttgagaaaagctaatgcacctacagatggcccccaacattctcttccttttgcttctagtcaaccttaatgggctgttacagaaactagttcgtgtttatatactatttcctttgatgtcctataagtcggaaaagaaaggggcaaagagaacctattatttgccagtttttaagcagagctcaatctatgccagctctctggcatctggggttcctgactgataccagcagttgaaggaagagagtgcatggcacctggtgtgtaacgacacaatcagcacaactggagagaggcattaaagaaccagggaaggtagtttgatttttcattgaattctacaagctaatattgttccacgtatgtagtcttagaccaatagctgtaactatcagctgcaataccatggtgaccagctgttacaaaagattttttcctgttttatctgaaacatactggatttatatatgtataagcgcctcaatggggaattagagccagatgttatgatttgtttgctctttttcttttatagtttagttatagcaaaaatatggataatttctagtgaatgcataaattaggttgcgtttcttattttgctttaaatctctggtagtttttccacccctgtgacacaatcctaatagacagtgtcctgtaaatggacacaacacaataaagtcaagttattattgctgttactctggatgatatggaaaacactgccatattttaaatcaactactccacgtgtttttccatccaatcacactgctgtgattcagggatctttcttctaagacggacacatttgaacctcaggttcatcacaaacctggtacctgttgcttcccagaggatggagaagtgtagttaatcacacctcttagtttaatctgaaatcttgacccagttatttaacaaataaatacctcattgattatatttaaaagtaatacacttcctgtaaacaaatggggacaatgcatccaaaaaatctttttaaacagattacacaaaaattatttccagaaaggctaccatttatcatcattatatttcaagcctcttatacttaataagcactttctaaaaagtcttgagatcccaccattctgaggaattcaatatgatcactttttccttctttgcctgggagaggttaagaggaggtttcgaaggtatagatgctattgttctgatggcccggctgaataaaatggaaattctagtttgttagaattatgcattctttttcaagattctcagtgtgcctaacttattggagcacatcagtttcttgggtaatggaaaacattacctagagttgccagtggcacattacaccagtacagagcacattccaaaggagacattggaccagttaattcccatacaagtcaaggtaacagaacaaaagggaatcctgatgcccttttaccattgctggttgagctcaggcactgtcatggacacccttaattttaaaaggttttaatcattcttctataaaatacatttaaaatggaaaaatacttaatatcactaaatatcagaacaatgtaacatttacaaatgacatattgaaagcaaaggctgttttatttagccaagatgattaccattaggagttactttatgtattgttgaaagcaaattttaaacatgatgttttagaagtgtttctgatttttaaacctggtttacaggtattacttctgcacttaccaaataatgccagatggaaatttattatttcttgcaattcccatgatagctctgttctttatgcattgtctcaacactttcccttttttcccaaaatgagtagagaattaaagccacccaaaacagcttctgctactaaaatgttctcatcctttctcctccctctccttttcctgccacaaaaggtgaaaaatgagatccaatcctctcaccaaaatttcaaacctaggacactggaatgactgcagggatcagtggttctcccatatcaccatcaattaagacatataggacactgtcttccttcaagagggttacaatgtggccatcagacaggaaaccaaacggtggataaagtattaagtaactaagtgccaaataaatgctggaaatcttgacctctccttgggattatgggtgtaacaaaaatccctacatctgtttatgaaggccatattcagtacattttaaatggtaaataatctgtttatgtgaagaaaaagaattaagtctttcttccaactctctccttggatagcctagcacagtgcagcctccataaccatgacattcccgcccaagctctcagtgcctaatcctgctttgtcattcacatctcacaaaatcttgacatcttacattccaatacattatcaagcaagcacaagtatgctggtagtagcctctttaaataatatgtatagacaacaacaacgacaaaaaatagactgttttaaagtttcagggaaagttggtggctgatttaaagttgtgcaggaaacatcttctgtgtatgaagcaaatgtcgatgttttgaaaaaagctaggagatgactttgaatgaatgcaaggttagtgagatcctaagctctcaaaatagcatattccctagagctcaagaaagctggtccaggaggttgaaaaagctattttgttgttaaattattttctggcccttcttaatatttaaaaatgtatttccccttgtggctttcaaccacctgctcaaaaaaagagacttgttacatgaaagttttcattaaagagctgaaaacaagaatttagagagccattcctagaaaatgtcctactgccctgcatttgacaaacaagcatcctttactaacaagagcaggaattcagaggcacaagaaaaagcattggcatgagccaaagagtctgtcttaatgttacttttgaaaatctgctgagcggccaccatatgcaggctgagagctgggcacaggcgaagccattggaagcacttcaggaacaagcacacagctgtgggacttgaacatgcaagtgttcaggttgtgtcaagaagcttttctttccttctatgatggaatctgttcttttctatcctacttttttctctcttcctctcctcaccacattataccctgctcttacgcagtaaacgttttaatggcccgtttatgtctcatgcctccaaacaacactgaatttgaaaccccccattttttcttttcaccaccctgttgagcaattttcccaaaaaaagggcagcaattattaaattgaattcaagtaagccagccaaagataggtcctaaattgctagtcccagtagaaccacctgatcctaaaccagtgcgaaacaaacagtaacaatgtccccagctgacttcagctaagaaccaatggctcctacccccgccccgcttttttttgttgttttttgttttgttttgagacggagtcttgctctgtcccccaggctggagtgcactggcgcaatctcgggctcactgcaacctcctcctcctcccacattgaggcgattctcctgcctcagcctcccaagtagctgggattacaggcacccgccatcacacccagctaatttttttttttttttgtattattagtagaagccaggtttcaccatgttggccagggtggtctcgaactcctgacctcaagtgatccgtccacctcggccttgcaaattgctgggattacaggtgtgagccaccgtgccgagccagccccattttttaaatgatgttttggttaagagtggaccatgagaattagctgacagcatcccctttctctctccctgccttggtgggaccctccctgtgtgaccttggtcaagtcctcgaacttttgtcccgtatttaagatggagctgttttacctacttcataagacagttgcgaggtgccattgattcttgactgcaaaataccttgaaacccttatataaagactgaagtcaacggagcctagtgaaagacttactttgtggcttgtggttgaaagtcacatcaaaagacaaatgtggccacgttcaggaattggagacttactggcatggctctacagctgctcagttattaatcatgcagactaacctgtcaacactgggagatgcaacatagcaaaaggacagagaaattagaattttttgtgcagaaagccctaaattcccacctgaatgtaacttacagctcccttacctactctcacacatgccctcaaacatgctagattggcttatacataggccaacacaaaatacaaacgtgacgtgttcatgtagcctagtggctatatgcctattctccatgtaccctgcatggtagtgctgcaaactttaaagtacatttctttcacagcagtattttttttcataagtggcatataaatgtcattcaatgaaatggggaaatcacgttgagaagttggtctgtcatctcccattgagcaaagactggcaggagataataaaaataaatatgggcacacatgtattaatatacagcacgcatttacaagtttattttccagataaaattgtgctataagaacagctctaccaagacagtctgcaccatttccaagtctcagttaatttacagcaactgctgctttcggagatggctgtgaaaatatggaagttcctctcaagtaggccaagaaacagttctagattttactaagttttattttgtcaggttttttaaattttttcagtgagcgtggtgactgcagaggttagtgctgtgaaaagctgggctaaatattctttctgtaaagtcaaacaggattccatcccctgtgaaataacacaaaatttcactctctaaaagcaacagcatgtaaactagaatgaaagaaggaaattatgtacgtatgcctaatattctttgtgaatgtctttcatttaactaaaattatattagaaaccagattgataaataaaaaattcaaagtagttttaattatcctaa

SEQ ID NO: 385 - DNA, 417244 bp, Homo sapiens
ctggtttttgcaaatagtatactagaattcatcctgtaagtattaaattttataaatatccaaaatgcctgtattttgccaaaaagtaaagccaccctatttcaaattttttaatctcagtacctacttttaggtaagcccattgtaaccacaaagaaaatacatacagagcagtgttccccagcctttttagcaccaagggacagttttatggaagacaatttttctatggaccagggttggtgggggatggtttggggacaaaactgttccacctcagatcatcaggcattagttagagtctcataaggagcacacaacctagatcccttgcacacgcagttcacaatggggctcaagcttccatgagaatctaatgccgtcactgatctgacaagaggcggagctcaggcgggaatgctcactcgcccgcctcacctcctgctgcatggcctggttcctaacaggccacagactggtaccggtccatagcctgggagttgggaacccctgtatagagcacatacaaaagaaaaacagaaagaaaaaaaaacaggaaaggagaaatgggacaaaataaatacaagacaaacaaacaaacaaaaaaggttaacaaaatggcaatagtaagtcaataattaccttaaatgaaaatagactagactccccaatcaaaagacagagtgactgaatggatttgaaaacaacaacgacaaaagatccaattaaatactgtctacaggagactcactttaagtttaaagacacacataggctgaatgtgataggatgaacaaatgataatctatgcaaatggcaaccaaaagagagcaggagtggctatacttagaatagattttaagtcaaaaactgtcataagagacaaaaaaggacactatataataataatatcagcagaaggaaggctaattcaccaagatgtaacaattttatatgcacccagcatcagtacctctaaatatatgaagcaaacactgatggaactgaagaaagaaatacaatattagaagacttgcatatcccactaaatagcagatagacattcagacagacaaatcaataagaaactatagaccaagtggacctaacggacatacacagaacatcccacccaacagtgacagaattcacatccttctcaaacacacacagaacattctccaggatagatctcatgttacgtcacaaaacaagtttcaataaacctaagattaaaatcataccaggtatcttttctgatcacaatggaatgaaatcaaaaataaataacagaaagaaaactgaaacatttacaaatgtatgaaaattaaatgaaatactcttgaacaatgaataggtcaaataaataaatcaaaagggaaattagaaaatgtctcacgacaaataaaaatgaaaacacaacataccaaaatgaatgcaatacagcaaaagcaattttgaaagagaaatgtatagtaataaacagctgcataagaaaagaagaacgcaaatcaacaacctaacatacctcaagaaactagaaaaaggaaaacaaacttagcccaaagttagcagaaggaagaaataatgtagattagagcagaaataaacagagtaaaaaaaaaatagaaaaacttgaagaaatattttctaaaaagataaacaaaattgacaaactaaaaaaaaaagagaaaaaaactcaaataaataaaataaaaaatggaaaaggagacattacaacctgatggcttcaatgctgaattccaccaaaaatttaaagaacttatgctaatccttgtcaagatcttccaaaaaattaaagaaaaggggatactttcaaactcattttataaggccagcatttccctgacaccaaagccagacaagaatattacaagaaaagaatactacaggccaatatccctgctgaacatagatgcaaaattccttaataaaatactagcaaaccaaattcaacagcatatcaaaaagatcatacaccacaaccaggtaggaagaaggatgtttcaacataaataaatcaattaatgtgctgcactacattgccagaatgcctaggaataaacttaagaaggtgaaagacttgtatgctgaaaactatgaaacattgatgaaaaaaattaaagatgaaaataagtggaaagacgtcccacgtttatgacaggaaaacttaatatcattaaaatgtccatactacccaaaggaatttagagtttcaatgcaatccctatcaaaattccaataacattcttttttctttattttattttatttatttatttatttattttgagacagggtctcattatatcacccaggctggagtgcagtggtgcgatctcagctcactgcaacctccgcctcccgtgctcaggcgatcctcctgcctcagcctcacaagtaactggaactacaggtgcatgctaccaggcccagctaatttttttattgtttgtagagatgaggtctcactatattgcccaggctgatctcaaactcctgggctcaagtgatccacccaccttggccttccaaactgcgaaacttacaggcatgagccactgtgcccgccccagcattttttacagaaatagaaaaaacaattccaaaactcatatggaaacacaaaggatcccaaatagctaaaacaatcttgagaaaaagaacaaagctggaggcatcacacttcttgatttcaaaatatattctgaagcttcagtaattaaaacactaaggtactgtcataaagacagctttatagaccagtggaaagagggcccagaaataaacctgtgcatatatgaccaactgatcttcaatagagatgccaagaacagacaatggggagaggatgatttcttcaataaatagtgttggggcattgtatatccacatacaaaaagaacaaaattaaacccttactgtacaccatacataaaaatcaactcaaaattaattaaagacttaaacgtaagacctgaaactgtaaatccttagaagaaaacgtaggggaaaatcttcatgacattggtctttgcaatgatttcttggatatgacaccaaaagcacaaacaacaaaagcaaaaacagagcaagaggtatactatgtcaaactaaaaaacttctgtacagcaaaggaacaatcaatacagtgaaaaggcaacctgtagaatgagacaaaatatttgcaaaccacatatctgataaggcattaatttccaaaatatataaggaactcctccaacttaagagtaaaaaagcaaacaaactgatttttaaatgagtaaaaaatttgaatagacatttatccaaagaagatatacaactgggcaatagatacataaaaagattgttcaacatcactaatcatagggaaatgagaatgaaaaccataatgagatatctcacacctcttagggtggctattggtttttatttgagggggtttgtttgtttgtttgtttgtttgtttgtttgtttgttttgagacagaatcttgctctgtctcccaggctggatggctattgttttaaaaaaaaaagttacttggtgttattaaggctgtggagaaattggaacccttgtacattgttggtgaaaataaaaaatggtgcagctgtgtatatatatgtatggaaaactgtatagaatgttctcaaaaaaattaaaagtagagttgccatatgatttaataagtccacttctggccatttactcccccaaaattaaaattagaatcttaaagagatatatggaccccatgttcactgcagcaatattcacagtagccaagatgtggaaataacctaaatgtctatcaaaagatgaatggatacagaaaatatggtatatatgtatatatgaatggatacagaaaatgtgagatagatagatagatagatagatagatagatagatagatagatagatataacagaatatcattcagccttaagaaaaaggaagtcctggctgggcgtggtggctcacacctgtaatcccagcactttgggaggccaaggcaggcagatcacttgaggtcaggtgttcgggaccagcctgaccaacatggtaaaaccctgtctctactaaaatacaaaattaaccaggcatggtggtgggtgcctgtaatcccagctactggagaggctgaggtgggagaatcgattgaatccaggaggcagaggttgcagtgagccaagatcgcaccattgcactccagcctgggcaacagagtgagactctatctcaaaaaacaaaaagaaagaaaaagaaaaaggagtcctgccataagtgacaatatagatgaatcttgagaacattatgctaagtgaaataagtcaaccacagaaggcaaatactgcatgattccatttatgtgaggtatcaacaataatcaaactcatagaagcaaagagtagaatgctggttgccaggggctggcaagaggggaatacggggacttgctattcaatgggtataaagttttagtcatgcaagatgggtatacaacgtagtgcttacggttaacaatactgtacacttaaaaatttgagagagtagatctcatgttacctgttcatactacagttagagtattagtcctttttcacactgctgataaagatatacccaagactgggtaatttaaaaaagaaagaggtttaattgggcttacagttccaagtggcttgggaagcctcacagtcatggcagaaggcaaggaagagcaagtcaagtcttacttggatggcagcaggcaaagagagagaacttgtgcaggggaactcctccttttaataccatcaaatctcattagacttattcactatcatgagaacagcatgggaaagacctgcccccatgattgaattactgcccaccaagtccctcccacaacatatgggaattcaagatgagatgtgggtggggacacagcaaaaccagatcaaatagaaatagaaatcaaaatagacaaacaaaaaactagaaagaatctgagagcctatacttcaaggtgttttacctaagagatctgaggaaattacaaacatgatcaccagcactgaaatcttgaacttggatcaaagtaaccctacataaccacaaaatgacagggatataagtctcagagactttaaatgaatataacaggttcttgtagataactcatatacagagatccaaaaatgaaaaacttgttttacatcctattcacaatatgtgtagtacccttttcccaaatacttgactgataaaaatacatacagatttttaacttatccagtctattacagtttatttgccaactcttagttccctcttgtgctacgtttaaatttataagatgagtacagagactttttgaataactaatttaattaatgaattttaaagttaacttttgtagagttttagatacgtcctttggtcatacagtttagaaattacattgaaaagtaatctaatgcaaagttttttgtttttttttttaatttaaaaggtttgagtaaatctttctttctttttttttgaggtggagtctcattctgtcgccaggctgcagtgcagtggtgcgatctcggctcactgcaatctgtgcctcccggggtcaagcgactctcctgcctcagcctccagagtagctgggattacaggcacacgtcaccacacctggctaatttttgcatttttagtagagacggggtttcaccatgttggccagaatggtcttgatctcttgacctcatgatctgcccgcctcagcctcccgaagtgctgggattacaggcgtgagccactgcgcccagccgagtaaatctttctttaaaaattactgaagctgagtttaatatactgtatttatttgcatcaactcaaaattgaattttatgccacctttttggtcagttgtgaattgaaattttataactgaaattgtttacaagattatgttaaagtagggctgagagaatgaattttaaagtatgattcaaggttatagattaaattatgttcttatatattttagtcactttttgaactattacaaatatctagtaaattttttaatgctctgcccctttaattctggtcatgtaatttaggactgaaaggtgagctttatcttggaacaatattatctttcatttatatgatagcaaaaaaattaactatactgcctttattcaaaagtgcttaaaaacaactatatgtttactctctccacttcattattttcttcctcagtgcaaatatgtttatctggaaataatgtatgcattgtagcatgcagaatgtcaagctattttaagagatgcaacataatgcttgctataaactcttatattcagtcctcatttcataaaactctcatgtttaacttgaacatgctttcatgtaaaagctcaacttaaaagtgtgcctgtttggatgataagaaaaaaaagcaaacaaataaaataactacacctatcttgtactctttaaaatatatatgttggtttttaaaaataattgcactaagctaaacatgagaacctctatattagcaacttacattaaaagcaagtcttttttgggaaagcaaaataaaattaaaagacacatgattttagatcactgatctgagtacacagatctaatctctttgccagggttgtgtatactgtacacgacatttattttatttttttttttttgcactcacttattttgatccagtggatcttgacctattatcaagagtgagtgaatattgctagaagtggtcacttcagtatgacttaatctgaagacagagaaaaactggttataaaagaggaaatatattagaaaggagagtatttttgtatctagcaacctggaatatgaatgtaaaagagaataaacagttcaacacagaatgataaagggtgccattgagagggtcttctggagttggttttgcttcattcaactatgaaatgactacatgtattcatttatccctcccctccctcattttgagggtataataaatgtgtttctcctttttctcctctttcttcaactctatctccttgaaagagaataaacaactaaaaacaatgctgcacccccactcaccttgataagcagcatgagtctattaaattaagcatgcttgacactcaaacaccaattttagggacagagtgctcaaaatagaaagcacaatggtgacatcctgttaccgtctctttgtgcccttggactcataaataaagttctgcaggtttctgtgctcccttgatacaaaataaagaaaagtgaatgagttagaacaagctctggcagccatcagtaatgttgcaccccattgctgcaggacaggagacatccaattatggagcaaggtcagcctcagtctctaccagtattttctctggtggtcaagagaccctcaccccctcaccaccaccaccaccaccaccacgattcccttctacctgatggtgctccgggactttatttttggatccttcactgcttgacttaagaggaggaagacatgataggccagtcagtcttggctgggttgtgggaaaagtgagaggacagaaccagattggtcagtttgtgaatcttgtgatcagctacttttagaatttatttgttgttaagtttgaccaacaaatttccatatccttcatgttttctcacaaagatctttaaattgcctttcccagcttcccacctaaatacattcaaccatcataacacattccaaaatacagtggttgcccatggtttgcccaatactgggcaataggcactcagatcccagttagtgaccaatatacctatgggacacaaatcatatcaatgaggcacagctgcagggtgcatgtctactaaggatactgctcatctgaaccctcagactatacattctggtaccttagttctgtctcttggtgccctttcctgcgggtaacccacattcttattctctctccatgcggcatgggcactctctctcctgcctgagtcatagttcctggagcagactccacccccatgtttcagatcctgcctgagtccactgaatgaaagcaacaactcctgcgtgtcactcacaattccctggatgatactaaaaagcaatctttctctcattttcgaaacccctttgagatattaatgacttcctagatttttttcaggacttagagattatttcagaaataatcatataataagaagcattttgaattggagactcaaattgctctttagatcatactatataatcttaatgatgatgacgatgataatagtagctaccattgaacaaatgcctactatgctaggtgccttctatcttaaccatggttaattctcaggggcagtcctcaaaagttaggatattgttcctatttctcaggtgggggaaatgactttcagcaggagtaactatttttattcatcttatagctttaaattggcagctagattttgaccccatgtctgactcgaatttcattttatttccacaacaccattcactgcgtagagataagaactgtgagctggtctaataattttttcttcctgcaatagaagtccttttctaaaatttgggtcaactctcagcactcgtaaaaatatgcatataaaaagggaaagaaatggaggaaaatattttcccattaaatactaagacctactatacactaagctacagtatttaaagcacacaatactaggaccaattggatggattatgataaagagactagacactgacccatacataaaagaacttggaatattatagaggaaacacgaagaattaatgaaaaaaggaaaataaatgatgttgcattaattgaatttcaatatttgaaaaagtaaaatagctttccctcctgaaacaaacaaaaaattcagggagatattggatctcaatgaaaagaacatttaaatatattaaaaaacaaaactttaaatatattacaggaatatgaagataatacctttatgatatctgggtaacaaaaggcaaaccacgtaaattaagtaaagcaggattttttttaagtaactaaactggtacaatttataaagtacacatactcctttgaaaaagtaggtctcatgtgaatctgctcaaattccagggctgtattcactttcaccaaacactaatgacctgaggctattgtatttttctagttttcctgttaaaaagagacatgagagtgttgactctcaggtgtgagatcttgactgatcccacacctagcccaactggaggcttaaggctactcatcacagagtccttctggagccaagataaatgcctatgaatctcaacttttattcacagctttcaatattagattttttaatattagattttaatatttttcaatattagatttcatcatttcctgtgcccatttccctagctcaagggttcacttatctttgataagtttattggctagatgtatgtacgatgactcactctccatcacataaaacatacaattttgacagttgataaaaagatgttcgcataaactataatcatataattaaatatgtaccagaaacctaaaaaatagggaagagggaagctgatagtattttactcacatttaactaaaaagccatacattttaaatctatgaggtaagaagaaaaatcaggaaatctgcctgaacccattagtgactattcatgtaggatttttttttttaattttattttttttgagacaggctgtggcccaggctggagtgcagtggcacgatctcagctcactgcaacctctgcctcccgggttcaagcgattcttctgcctcagcctcctgagtagctgggattagaggcacctgccaccacacctggctaatttttgtatttttagtagagatggggtttcaccatgttggccaagctggtctcgaattcctgaccttgtgacccacccatctctgcctcccaaagtgctgggattacaggcgtgagccaccacgcctggcctcatgtagaattttatggtcacaagcctgtagttctagcagggaaactcaacacataaaaaggaggcctttaaatgcattgtcaagaatgacgaaaggagctaagtatcattatattctgatcaaaagaaaaggcaagtgtccatttccaatctctctttctctctctctctctctcacacacacaccccccagcagatttgtaaagaaaggtaaataaatcccccatacaaaaagtttccttttttccccacttgggtctgagagttgttcagtttaacctgagttgccattagtgtccttcgaagctataaattttgcttttccatgcaattgtttcaaaacaaagaaaatctgtgactttaaaattactttagagccaagcatggtggcgggtgcctggggtcacagctactttggacactgaggcaggagcattgttttgagcccaggagttctgcgtggtagtgcactgtgctgatagggtagtcgcactaagtttggcgtcaatatggttaattcctgggagcgggaatcatcagtttgcctaaggaggggtgaaccaagccaagtgagaaacggagcaggtcaaaatttccattctgatcggcagtgggttccacctgtgaatagccactgcactccagtctggataccatagcaagaccctgtctctttaaaaaaaaaaaaaaaaaaaaatggctttagaagcaattttacaccctaacttaccaatataggtagcggtccgactttatcgccacaggaggaaaaaataaaaagcagagtaaaacttacagagcaatggtagatacaatacgatcaatacaatcttcaaacccaacttcactgagcatgagtttctacacataaaagagattctttcattatttcttttttaattatttatttatttatttatttttgagacacagtctaactctgatgccctggctttgagtgcagtggcgtgaacacaactctctgcagccttaaccttctgggctcaagggattctcccacctcagcctcctgagtagctgggaccacagacaagcgccatcacacctggctaattttttaaattttatgtagagacaagatctccctgttgcccaggatggttggtctagaattcctgggctcaagcgatcctcccacctcgggcaccaaaagtgctggaattacaaggcataagccatcataaccggtccaagaaaatcttttagaaaaccccatcaaacaaatcaccatactatttaactgtaagtccaaacaatagtttcaatcgtaatatttgaagcaactagtataaaaagagaaactcataagctagcttacatttctgttgtcaaagagtaatttatccttgctggagttggtttggaggtattaatagccggaattatcccaacaatattctggcaagaaactatacacgtactttctgatgtgctctgatgtggccacagtctggcgctgagagtagctccaacatgagggactgaagcaaaagggtttcccaaagaagcactgtgccccggagactggaaggagaatttgaggaagacattaggatgaggcatctcaggggtgtaagagagagaccctggaaggcatttggggccatgacttaattataagctaggaattgcgtgtgtagaatttacaaagtaaacaaaatggcagccgagggtggggatagttcacacccttagtaaaggctcgacattatagaatctgcctcatactaggattcccagtagcttttctggaaataggtctccttcctctcctgccagccctaaaataatattggtaacacacacaccaacttctagagagcactcacaaaaaaagttgtcaccgccaagtgacctcactgcttctccctggagagctttgcagacagaaaatagctctgtgtctttataaacaaatcactctgtgaatggcagtgggtacacaaacatgtcgattctcttccagagttcttactcgctcaattgccaggtttgcttctattttggttacagaattaaaatgtaattagttgtgtttttaatgagtccaaatgtgacacattaagattcagtaattactctaaaatgataagctgtgattgaatgtccccataaacaagggacatttaaaggcagtaccatttcttgctcagttgttactgcttttaaaaccgtcactctttcctgggtgaatacagttttaggatttaaatgattacgctggattattgcacatatttacagtcagagccagctataccgacatatttaaagtgtgtacgttctttgatcatgtggccatgtctacctaagaacctaataactgactttactgaatgttggctgtccaggttagtacctcattatgacttactggcttttaagacacgtttattttatgtggcatcagtttttctcttcaacctgatgcaagacctcactgctatttctgaggttctttatgtccttagtgtttggcagggctcacatcaggtctagaaaagtggtgctagaggttcaagatccaatacaacaatggcagcagtaattgatgcacttgccccatacggaaatctgatctcttaacccacctgtttcctaggctaactgaatcagcagcatgtcagtagctgccaatgctgatcaatttcctagtgacattggtaacttaaaaaacattgaaatagttaagttcgttgtagaagtaagcctttcatcctacagcaaatcaaaaacaaacaaaatggataaatgttttctgataacttttaaaacagtttacctaagaggaggaattgtaaaaacttaaacataaattgagatcatcccacctgattttttaatattcgtaggaagcctgttcatgatattccagtcaactactctagaatcctattttggtatctcagtatctcgtgcagcagtgaatagcactgctcaatattttagaggcttcatatttccttagagtcacaattgtcaccctaaaatttagatctaataatcctactactgtcctgtgtaggaaaaaatacagaaagcatatacttcttatttcccagccttcaagtatgtgaagactgctatcaagaccactgtgtcttactggccaggcgcagtggctcacgcccgtaatcccagcactttgggaggccgaggtgggcggatcacgaggtcaggagatcgagaccatcctggctaacacggtgaaaccccatttctactaaaaataaaaaaacttatctgggtgtggtggcgggtgcctgtagtcccagctactcgggaggctgaggcaggagaatggcatgaacccgggaggcggagcttgcagtgagctgagatcaggccactgcacaccagcctgggcgacaaagcgagactccatctcaaaaaaaaaaaaatccccgcttccaacagcagttctcctggaaccctaccttcccctgaattttgtcatatttatcaatgcctttcttatggcaaccagaagtatatagagcagttcagttcacaaagggctgtaaatacagtaggacaatacctatctcactttactttggacaaccagatgcttcaaaacttgctgatggtagattaacttttcatgtaactttatttattttactgttggcacacacggcatttttgtgtaaagttttctaatgatttttacatgaaatgatgtccagttataaatctctattctataccttgaatttaaaccaacaatttttttcacttaatcctattgtattatgtggtgttgtttttattattctaatctatttaaagcatattaatctcactctgaaagctgtataaaaacctctaaatctgggccgggcgaagtcgctcacgcttgtaaatcccagtactttgggaagctgaggtgggcagatcactagaggccaggagttcaagaccagcctggccaacatggtgaagccccgtctctactaaaaatagaaacattatctgggcgtggtggcacaggcttgtaatcccaactacttgggaggctgagccaggagaatcgcccaggagacagaggttgcagtgagctgagataatgtcactcactgcactccagcctgagcaacaaagtgagaccccgtctcaaaaaaaaaaaaaaaaaaaaaaaaaaaaaaaagcctctaagtttggttcatctgaaaatttcatgagtctgcttactcttacaagtccttgctcataatattgaacaaaaatcaccaagaatagacatgtgacacatacaccaacagaagtctctccccagcagttcaataagtggaaggtactctagctagcatctccatcgttcaactgtaccccagtatatcaacaaacacattatgagtggttcaaatgaatgcttttctgaaatgatgccatcctcaatggggaagtttcccagtctatcaatctccatgcagcataatttgtagaagtcctacctttcatttctagatgctaatcgatcttctattcaatggaagatctagcctactggtgtctcattttttattcttcctacaatttagaaaatcagatcagcataagaactttatttttaacaaatattaatataaaagtattacgtgtttttctactgcccatatctgttctgtccaagccatgtacattcatgttaaataaataccgtcttttaaaacataaatagcatggttactccacattgactcctgatgtcccaagatgttcaagatgcagtaaggagaaatattattttaaaacaattcaaagggagtgaaaatggtagcacacaaaggaggcagcatttcctgcttctcacaagaccatctgcctgtattgtgggcaagattttttaaaaatcctaactgaaaagaaaataatgttaagagacatatgcccatgtttacaagctgagggaaattgacaagtgtgtctgtttcgccagtatttttacagtcaactgttatacataatggggaaaattaaaatcggtaattacttttctagtctgccattgttttaaatgtgcttggaattttccttaagcatccattccaagtaattatttgtaataggccagaacacttaaagggttgtagggatggatacacagctattttacaaagtgaaatactttgacaataacaaattatttttcctcctttctctccccaatgttggctgagttatgtttatacctcactttgtagataatccttctagctacactttttttaggcacagccattataaaaatcttctgtttgggcttggcactgcttagaactagaaattgctatttgctgcctgccaattacagaataatttaaggtttgatgctcccaggcacagtttcttgaaatacacagaaaaaaatatattaaggtggatgcataatattttttctgcattgcatagcttcaattgcctgtatagaattatatccaaattgctaaacaaatcaattggagaaaaattatgtcttctaggaaagtgttttgtaatggttttactactctttcttttgataagatcatagcaaatattttacaaaaattttatattatttgcaactgaatgatttcaatctatgaaatgtgatgggtataaatattgatataattttaacataaaatttaaacttctaggaaataatagaggaagatgtgatttttttaaaatcaatttggaataattaagaagaaaagaaaaaagagagttaattaagtttcccggatcttttcaagtctaaaatgcaataatttttcatctttgtatattcgtatctgaattatccatcatttgcagtacgaagcaggaaagcggtaaagcaaagtaaatttgtgatttaaaaggatcaagtatatggttgaagactcaaaaagctttttatttgggacagtagaaggaaatgtgctgattatcatgagaacaacaaaaaagagaaatgagttatttatgtaaccctgtcatcatgcctacaacacctcgaagggcagtcaggcatagtctgttatcaggaaaagcaagcaaacaaaagcctttatatatatatatatataactaatcacaaacatgctcagactccagaagatggtaaaataaaataaaataaaataattttattgacttctttcacctaggtgccttggttgcactccctggaaaccattcttcgcattccccacttacttctcttttcttttctttttttttctttttcttttttttttttttttgagacagagtcttactctgtcgccccaggctggagtgcggtggtgccatctcggctcatggcaacctccgcctcccaggttcaagctattctcctgcctcagcctcctaagtagctgggattacagatgcgcgccaccatgctcggctgatttttgtatttttagtagagatggggtttcaccatgttggtcaggctggtctccccacttttcttaattcacccctgaaatacactacccaaacacgtagcaactgaggtctggaaacttcattcttgacttcttctaaggaaggccactttcttcaaaatacagcaagacaaacacatctagctcctagcatgacttcagtgtgaaaaggctgggcttgggagagcagcaggtagacatgcctattaacattgtgctgccatgtttactttttttttgtttacttaaatcatggacagaaagccaagtgtataagtgaaaacccaagggacaatgacatggggtagactgcagaccaagaataagcaggaagttaaataccaagatattcccccaaaataaaccagatagcttggtttatatggaagaaaataaaccagagtaccactaacataagcatgacagaaggttttacacaaaactttagcagaagtgggtccaaatttcagctagtttcaggaatagttggtcgaggatggttctccaaagagggtggaattgtgctgttgatcagctgccctcacatgagcgatttgcattttcttggcgagaaatagtcgctgaagtcaagcagaagagtacgtgagaaggaatagctgtgagaccaggacaagccaaggccacagtgggatattctcagtccgtctgggtctctagatttacaaagaagcatgttgaatctgtagaggcaaatgggaagctcccccttcaccctctaaaggttagctgaaaatgagtaaatgacaagagggggattaataggaggaaaggacatagagaaggtaattaacatgcttagggacaggggaatcacaggaggagaatgacccaataatccagtgaggtcctgacacttatttgtatacccttcttcacagggacagggttgatgaggagtgtagggataaatgacttacaggggaaatgaataagcccaaagcacggtggtctgggacaaagttcctctgagctctaggacaggtggagggaaggtgagtggttgagcttcactgtaatcaaaggttatcttattatgcagataaagcctcccaggtaatctcttggagctgtcttgagaagaatagatgaaaagtctttctgggtgcagtggagactcccagtgtctcctcttctccagtggttaatctttcctggttgtttgatgagattcctagggaggaggtcttaagacaattgcatttccttttaaagggttttcctagtcagataaggaaattccggttctggtacagtggctcacacctgtaatcccagcactttgggaggctgaggcgggaggattgcttgagcccaggagttcaagaccaccctggccaacatagggagaccctgtctctacaaaaaaaaaaaaaaaaaaaaaaaattagttgggcattgtagtgcatgcctgtggtcccaggttctcaggaggctgaggtgggaagaattgcttaagccagggaggtagagaggctgcagtgagctatgatcgctcaactgcactccagcctgggtgacagagaaagaccctgtctctaaaaaaacaaaaaataaaattccagcaagagtagctcccaatgcttcaggaaagaaaagagatcagagtggggcttgggagggaacactggagagaccttggttctgaggcttatttctgatgcctttaatttcctttaattcaaagcatgccaaagagccatatttttggaggagtattttctgagccccaagaactcctcacaatgcaaaatggatgcctggctttcatttttttaaaatgatttatttaccttaaaaataaacttggattcatttgatcttcataatccctgtagataatttaggcttccaaaggaaacatggtctctattggcctaattaccaataaccaagttaaattccatttctgtacagaatttttttaaaatttacctcacaatctagaaagaggagaaaaaaataccttaaaaattaattattttcaaagccatgtatatgcagatttggtcatggcttattcagaacacattagaattattttaaattctaagtatcctcaatggtgaacttaaaatttcattctagggggaggggggcatggttaatgagtagaaaaaaatagaaagaatgaataagacctactatttgatagcacaacagagtgactatagtcaataatgactgaattgtacattttaagataactgaaagagtgtgattggattgtttgtaacacaaaggataaatacttgaggggatggattccccattctccatgatgtgcttatttcacattgcatgcctgcatcaaaacatctcatgtacccccataagtatatatacctattgtatacccagaaaattattttaataaaataaaaataaaataaatgaaataaaattttattctagccattccaggaaaaaaaaaaagccccattttgcaaagatgattataaccatatatatcatatgattatcaccttgttttcatacacacaagcatatatgtatgtatatatacatatatatttacacacacacacacatatacacacacacacatatatatatgtgtgtgtgtgtatatatatacagttgacccttggacaatgcaggggttagggctatgtcctgcacagtcaaaaatctgcatataacattggactccccaaaattttaaccactaatagcctaccgttgactggaaaccttacccataacataaacaatcgactaccacatattttgtatgttatgtatattatatattgtaatcttacagtaagctacacaaaagaaaatgttattaagaaaatcataatggccaagcacggtggcccacacctgtaatcccagcactttgggaggctgaggcgggtggatcacctgaggttgggagtttgagaccagcctgaacaacacggagaaaccccatctctactaaaaatacaaaattagctgggtgtggtggtggatgcctgtaatcccagctactcaggaggctgaggcaggagaatcgcttgaacccaagaggcggaggttgcagtgagccgagaagaaccattgcactccagcctgggcaataagagcgaaactccgtctaaaaaaaaagaaaagaaaaaagaaagaaaatcataatgaaaagaaaaatatatttactagtcattaagtagaaatggatcatcatgaaagtcttcatccttcctgtcttcacaatgagtaggctgaggaagaagagacgaggttggtcttgctgtcccaggggtgaaagaggcagaagaaaatccatgtataagtggactcacacagttcaaacctgtgttgttcaaggatcaactgtgtgtatatatatatatatatattttttttttttaggtttattgcaggaacaaaatcctctctccaaagctataatcctgactggctcaagatgtcttaagaaacttagaaacacagctaggaataaattacagcccaggctagttggttgttctcccggaatgagcgaattcaaaaggaacctggttatttagcaagaaatagactcagtgacctcagcagcattctaatgcatggaaaggtcagagaggtttcgtaccactctgctgggtcagatggaagccagagaagctgttggggtctccttgaaggttgaccctgggctgcaggtcaggaaacccaagtaggattccaggaatggattgctaagaagcttcgaggagaatggcttccacccatgactgagaattgaattgaggtccaggtagaatgggtagtacctggtcacagcccataagaaataagaagaggctatgatttgaattggtattaataacaaagaagaaaagcagcatttacttcgggcacaaggccagccagcctgctctcagaagctaaatgcaagtgacattttcttgtcaaatcccaacttttacccatcaaaggcttggggagaaagggaatccattgcaatgagttggttctgtagatagccctgcagaatcctggggggtgtttcacacgccagagaccaggatgggttgcggaaagcagttaactaccaagtatagtaagggaggcacagtaactcacctggaattgactttgcaagctgaagactgttttcaactgtgactgtgccattaggattaatgcaattcatacagttggctagcacatcagataaatatgatgaattgtccttatatccttagtccagtgagaactggcttttccatcacagcttaagctatacacatagagaggcaaaaaaaaaaaaaaaaaaaaaaaaaaaaagaccttacagttttgtttattgtgcttatcacaagtgctggaaactcacattttcattgctaatagccctctttgaaagtttgttgacatttcagctgatctttaatgtgctctactgttataatacccttgggcaaagtcagtttccaataggaaaatagacagcttctgggtacccctgtggaagctgcacaaacacaaacagactggcaccccagcctgcaatacctggtgagctctgctctgtccgaatcacagaagggtggcagaatatataacctcaaagcatgccactttggcataaggattatgttgaagtaaaggctcttgaaaaatagcagatacaagaagagcactttgaccttcctttttcttcctaaaagcaggagataaatctccaggggaaagttgttgtccctgtattgggaggaagaaacattcttatcaccagagatagggagtgaaggtcaagagaaatccgtaccaaaaaactttgttaaattaaccttatctgtctcttcacttttctacaattaactgctctggcccaagcctctttgtcttgccatgttttcacaaggtgctcctcttcatccaacttaggatataagcatctgactctaactgcttctttgggtcttcattttcctatgtgaattcccatgtccatttaaaatctgtatactcctatcttggtaattatctgatagcgatttaattctcaggcccagccgaggactctcagagggcagagagaaagttgtgccttccaggatcactgtatttgggagcctggaagacgaagaatggagcccagtaaatagagagggaaggaaagacatttaaacaggttcctaaagagaatgtgaggacacgtaagaacaacagtaagaaaaagtacagaaagaaaaatttacaatctattctacagagcaaattgaggtatttcttctgtaatagggaaagaggaaagagaagattcatgactgaccatcagtaggctttatagtggagagagaattgtccaaacctccgtataatcaagcacatatcctgattcttagaatatatgttccaaactaaattaagaaagggtgatgctggacagaagcagttattaattctggggtcaacaggataaaaatagtcagaaatgaacgttgtggtttgggaatataagcagctgaattcaaaataagaattctaatagaaagtgttaaatcaaagagcagttcataaagtcagagctagaccttgggtggggggaagagcaattcaaaaatttagagcagcatgtatcttaaaaataaattttattgaaaaatgagaacacatggacacagggaggggaacaacatacaaggggggcctgtccgggggtagagggcaaagagaggaagagcattaggacaaatacctaatgcatgcggggcttaaaacctagatgatgggttgataggtgcagcaaaccaccatggcacatgtatagctatataacaaacctgcacattctgcacatgtatcccggaacttaaagtaaaattaattaaataaaaaaaaatgaaaatgaaaataaatgttgttatgagaactcatagtggcatggccccaattttagaaactgagcttaatacagttaataggtaaatgttagatgaatacctcaaactgaatgttaatgccaaaattaagatcattctttggttcaaaatatagagcatgtttatatcttaattaaaagcagtcatacttaaatctctccttttcggccaggcacggtggcccacacctgtaatcccagcactttgggaggctgaggcgggtggatcacctgaggttgggagtttgagaccagcctgaacaacacggagaaaccccatctctactaaaaatacaaaattagctgggtgtggtggtggatgcctgtaatcccagctactcaggaggctgaggcaggagaatcgcttgaacccaggaggcagaggttgtagtgagccaaggccacgccattgcactccaggcagggcgagaagagtgaaactctgtctcaaataataataacaataataaaataaatctctccttttcattatttatagaaaatcatagtattttggcacattaaattgaacatatttctttaagtaattaaatgtacgcctatcataatgtattcctcctggtacttaactatcatagattattagcagtttagtgtttaaagggaactcaggactgagagttttaaaaacttagactcacagtaagaaagtcatctcatgttgatgaagtataaatatgcacatacacacacagacacgtcacatgcaggtacataactaaaatgaaagcttcctgaaataatacttatttacactttgtacagaatcgaatgcactttatttcctagtctttgcattttaaaaatatacttattttttttaatgctgctcctggttccccaaattgaaattactatctaccaatgtatctcaatttacagtttggaaaacactgccttagggaatagctagtctaattttgcacctgagaaacgtagagatttagggaatattcccaaggtcacgtagtatgtggcaaagcaagcctgtgctgtcttctaagttctggcgtaatgagttttccccaatcttacattgttacattgttttcaagatgaatggtcatgtatagtgtactctttgcctctcaaatttgatgaagtaagcattattccgttgctacgtgtcttgctcactttgcgttttcttagtttcataggaagcatcagttgtgctaagttttatttgtgtgttccattgtctcttccccctaaactgaaagcttcctgagaatagtgtgtattcttatcaatatcccctaaaccaagctgagtagtgtgaatgattgaatccttagaaagacaagctcatgtagtcaaatagtctaaattacatgagtgggacaaaaatatcagcatccaggtagccacagatgctcttctttccttctaagaaatacgattctcattccatacctagatgatgggttgataaggtgcagcagaccaccatggcacacgttcacctatgtcacaaacctgcatgtcctgcacatgtatcctgaaactttaaattttaaaaaaggaaatatcaattctattggttatgctgattagagtaataagtggagagggaattgagaagttctaagacaagctgtgttagtatcctagggctgcagcaacaaagtaccataaacagagtagcctaaagcaacaaaaatttactctctcaaggttctagaggccagaagcctgaaatcaaggtatcagcagggccatgatctctctcgtagcttctggtggttgccggaaacccttggtgttcttggcttgtagacacatcgctccaacctcagcctctcttgtcacgtggcattctctctgtgttttctgtgtccaaatttcccccttcctattaggacactagccattggattagggcccatcttaatcaagtatgacttgattacatctgcaaaggtcatatcgagaagtaccaggggttagaacttgaaaatatctttttggaagacacagttctacccaccacagaagctacaccaatttacatgaaaaagaacctaagtagatctagaagagttggagagagaaatgggatagaagggagatgagcaggaagacatgaaagcaaacaaatgagttatcttcaggggagaaaagtgcttgtccagtgtactatggagagacgcataaatgaagatgactttaatacattctgctttgcatcatgcaacataactttttttcttttggtgcctctcacagagacctctgtaaatcctaaattatcttttaagactttgttcaagtcagattttttagagttatttcagatgttatgttattgcaggaagcagctcacaagtgacctagcattaaagataataaaagctaatgtttttatgtgagtagaagatatagcattgcatttaaactatagtttcaccattatacagaaggaaaagaagacagcaagcagaagagacaataatgatatattgaccttactgaaagatgatgacataaagcagtaggatttatcattttttgtaagttactgaacattgattcagtgttatgcatcttgttcttctatatattaagcaattatgtttatttctagcactgaaaagcatagttattttcagccaataattgctatttgaatgctatagttaatgtttttataatttttagatgacaattttattttaattaactctcttagaaacaatcatttatttatttgctcagcaatatgtgttcagtatccaaagtgtgttagacacaattcagtatatccgtcccctatatcgagagtctagttagagtgagttaacaaaagcttttattcatgggaatttatagtataaaagtgtacaatagtataaaaaggctgaaagatttctatagtgatttcactatgaagagatctctctgatatttttcttccctttcaccttatccagtctccaacgtttctgtaaaaaacagctacacccacttttttcttcctgtcaggtgaatccagatagtgcagcaaagttgagccaccgacactgaatttcccaccacaagtgaaacagcagaaaaggctttccaagttcactgtagggaaaataaaagccatgtgatatttattgcacatccaagtatatggattaagattaattcctctggagcaataatgatcacactttttaaatcttacaactcgttgatagtcatcaaaattgaagatccaaaaagcttttatttttatgagttttacatatcagaatttcatgtattagaaattaaaactgacaaactttaaatatttattttaagacaaatgatatactttaaatattaatttaagacaacattaaaaaccctctacttattagcataacatgcttttattttttaaaaaaactacattattccaaaacaaaaaaagattaatgagaagagtagtgttgttccattacacacccatgagtgaatgagagtgaaaaaggaaattgatgtcttaatattattatgaaaattatttggtccaatagttaatggatcccctgaaaggtattcagaacccccagttgtctcctggccacatttagagaatttcagccctagaatgttctgatatgtagtggaggaaattgattctatagtacagaatcagagggcaactcactggcctgctccccacctcagctatcatatgatgcacagtccctgaccaagtggatcggaaatgtctcctgttgtaggtcaaggtatccctgagaaccacaaactgagatatggacaaaagagcaaaagcgccgtgcacatatcttgagatgcaggttaaagaacaaaacaagaatgcatgtattttatctcaggacactaagtctccaaagaatggcttgtgatgggggtacagacttgacccaagaattactgactataatcaaaccacagtttaacagaggtgctatttatagtgaaaaattttcccccaagcaagaattccatagtaaagtaagatcacagttgcacactgcaaatctttaaaagaaaattccagaatttatagcttacttagcctacttagctacttgctttgctcatatataccagttctttcaactaccacaaaaataataactatttgaatatactcaataaacaggcattgtgaaatttgaattttacaacatagaatttggttactgttcctgttaaaacacaaaatacatgagtgaatatttatgtgtatatttttcaataatgttttccaaatgacctttggagaatatctcaagatgattatttctttggcagggggcaaaaaaaaaaaaaagctatcagtgagataagcacatcaatcgaactgttttcatttgagccatgtttaaatgagctaggatgcaaaatagaaattctggaaatatccaaaagaaagatgtacatgtcctctgatttctcctaagtctggacagaattggcagcagaggctctaatgaaatcttgcaattagtctgagaagcccattcagagagcttcactgtgttcagccttctgccgctgacacccttgcctgaagacacatgcccatatcgaagcacatgcagatgcctttcctcatacctagaccctgaaatgaccatggaccgcaggattctcatgtgagatttcagtttactgcttaatttttcatcttgattggacttttcatccatcatatcaggaaaagctgaatatacagacccagacatagataggtttggggacaggaagaagatttaattctacttagattgatcccattttttcttttcttttctagaaatgagtgagatcatttgctgatcctgaggtgtggagggaaaaagtcttggctagaggtgtaagagaatgtgtggaagatggaattgactaaagaaagtgatagggttgtcctgcaggtctgaggacccaggtgatattcatggtctccatgtaacgcataactggtcagcaccttttgtttgcttgtttttctccaagttttactgcttagatgcggtaaaataacatctggcattcccagagttggttttccaagtaatgtcacttactgaggcaggaaggagaaaaggtgtttgaggtttgaagagacaggggaaaaagtctgttaagagaaaaggagtgaaagtgaccagaaataagttagtaggattgacaggaactaaatgggttagcatgggttagcagagaatgagatgtaaactctgttggggttttgctgacaaatacgatggagagagctgaagttgtttgtttgtttgtttgtttctcaaagatgtgataattacagtgaaccttggaatctaaactaatgaagaaaaggagtgaggacaagagagtgaaaaagtgatagtcaatgaattgaaggtcccaggagaagaaatactgtatttgagaaccagagtaaatgaaatggaaaattaaaggcagtggtcagaagtcagcataactagaataaaagtttgaaaagataatgactaagtcaagggtatcaccaggggagtaggtggctgaagtgcaatcggatgaaaaaacagtgggaaacgagatgctcaaagaaatgggaggttcgtaggtcactgtggtccagaattgcaatgattatgtattcagttccggttaaccaagaaattaagcattttgcaattctaaaatcatcagttgatatactaaaattaaagtctaaaatgccatgaacattatgttagatacatatatattaaatggaaatcaaattgtatacgtaaaaaaagatataaagaagaaatatagggctagacatagtgtcttatgcctataatctcagcactttgggaagccgaggtgggaggattgcttgaactcaggagttggagaccagtctggacaacatgaggagactctgtctctaaaagaaaattaaaaattagccaggtgtggtgtcatgcacctgtggtcccagctgcttggaaggctgagatggaaggattgcttgagccttggaggttgaggctgcagtgacagatgtttgcaccactgtactttagcctaagtgatagagtgagactgtctcaaataaataaaccaataggacatattaataaatactgtgatcttaagcaaagacgctttaactttctagagcttagttttctcatctgtatcacgagtaatttgaattaaattatctagaagttaattctttgcctgaaatggtttgtttcctttatccaatattactcattgattataatgatcaccaaaaaatgaatacttacgtgaatactagagaaaaaatattgcttaattttgaaaatacaaattgcttatttgtagaagctattttggttttatttgtatgtttatttaaagtttgcgagggaaccagggttatcaggatcactctgatctgaaatctgagatttgggtaatctcacttctatccaaaaatctctaggacatcaagctcatcaaggtcttcagatgctcatgatgcattaattgccctttgagaataactgcctaagagatggatgtttatattgattttatggtagatattttcttcttcatgggagtggaattccttttacaggttgattcacaaacctagagccaaaaatataactgaactattacagatttaaagtatagattgcataattttgtaaaaatattatcatacaaattctaacatatcgtgagctgaattatactaccacaactaaaactcaattacttataggagtcagacgtatattctaataagacagacactgaaattgctatttttgtctgctggccaaattaactcccaactcatcagtttgcctcccattccctaaagccttgtgcatatgaattacctggcactattgctaaatacagatttttttgcagtaagtgtagggtggaatctgtaattccacatttctaacaaggtcccaggtgtgtcagtgcaacacatctaaggaccacactgaacataactctatacaaaaaggctccactttttattaaactgtgattctgaaaacccaagtagaaatcaggtttttaaaaacttatcattcctttctttggctgttgagacttgtatttctccatgccatatcagacaaattgcatttacctggttccctctgaattagcaatcttaggaacttcagctactctcagattctattccgttatttcagagttcccagtggttggctcaagtgtgagtgcacattcaggttttccagttgcctcatagcgtctttccatgaccttctcccttattccagctcctgcttgggtgtctctggcaccttcttaggacagatgtgggttgtccaatgctcaggacactgaatccagctcaagtacccaccatgagtttgatgcaaggcaagcgagccccaaagtggggcttagcccatgagggttcttggcttctcccaggaaagaatttaagggcaagccaatggtagggtagaagaaaacagctcttatggaagtggccgtgttacagttctgtgattgctcccacagagcagggctaccccacaggcagtgtgctgagagtagcaactcggggcagttctgcagtcatgtttataccgaccttgaattacatgtagattaaggagcagcttatgcagacatttctagaaaaggggtagtaactttggggtcatcaggtcattgccatgggaaggggtggtaacccccaggtgttgccatggcgatggtaaactgacagggcatgctggtgggtgtgtcttatggaaagctactcctgccccagtcctgttttagctagtcctcaacttggttcaggatctgagccccacctctggagtcgagtcccagttggtacctcaacttcaagtgaagaaagtcacttaattcagttttttgttgcccccttaccaataacttgaaaccatttgagtggcctctcatcctattcaaaactactcctttcccttaagcctaaaacattatccttggaataagcctcagcacctcgactctctccttcctttaggctcagagaactgatgactacttcatgccaatacatccttggcaagccacctagtaggctgccattcccacagcaagcccagcagaaccatcagagtcatggagtggttatagtttaggctcttaagttggaattcccaaggacactataacatagtgttcctgcatgggtgagggaaaaataataactggtttttatggagggctaggagaggtagatgaattacctggtgcaaagccggagtcagcatctgtaactgatgagtgagcaggacaagttagagttctatgaggaagctttatgccgtcactggcaaaatttgaggcagcaaaatgcaaaggaactcaataaatggtgagatgattaaccaatgaggtggtactgactccagcagtggtgttattgaaagttcaggtatattcaattataacacattttaaatcttggattgcctgaaatcagcctgccaaatatgagaataatccaggcagacaaggacaaagaacattacacaataatgatactaataggcagtgtcctgtacattgtaattgtacaatagtgacagtaataggcagtgttttccagcatcaactggagtatcatttcctatcccaagtaagttaaacacaggatgagctcaacatcctaaggtccagaggagagtggacggtagtgagttatgctgtctccctgtggtgcccagggactctctctctgtcaaagatgctgtatctaattacctaggctctttctttctcctttcctcctcctttcctccctctctccctccttctctctctctgtctctctctttctttctttatgccctagaaataagtctttttcttctttcccagaaatcatggtgataagtagaagcctgcatgcaggaaattattgaatataacaaaaaaacatagttggtgaagttaactcaagacaaaaattatatacaaagaggtaattgcatatagattagagaagtccagtgtattccctttttgtaaaacgccttctgaatcgagtatcttttgattccatacaattctgtctcccctcacatctgacctattcatgtcagagatctcctacctggctcctttttcatctagtaattaatttatatccctgtcctaacttctatctcctgctcccctcaacattatatctctttttataactaggatatactcaaatgaaaaaatccatgtatcttactatcttctgccttcttctaaatagttgtgcttccttttgatctatttatttgctacaccaggaatatttgacatttcctggagaagtaggaatctcttgtatgctcatttgaaatgagctagtgtggttatttaacaaatatgcagagcaacaatgcacaagatgatcaaaagatatacgtggagaaggaagttctctatttcacaccactgagttacattttaagcatggggcttgtgaactaataccactgttcaccttctcaaaagggcatggtatttaggaatggcattattacagttttctacagttttccaatagaagacattaaataaatgagagaacatttctattgggcaatattaaaacctttacttccacatccactgctttcgccagcttgaacagattagttattcccagtagattattctcattggtaattctgtaataaaagattctagatattgtgcattttcatcactggcattacaatttttatttcagaatcttggtcatcgaatattcattatctaattataataaaaatgcatgattcccttaggaatgcctataactaaatgaatatgaactttattaaaggaattaaattaggagattaaaattattcaaagggggtaacaactttattcttaaagaactgtaggattgcaatactaggaaagaaagagaataggaaaggcaacagaaaagtagtaaaaagaaacagaaacaaaacagatagatccctgatgtgctatgatggggaatagagtattaatttaattattcagttataaataaactaaagcctaagcctagtaaattatgtgctccttgaagattagagttaggactgattaatctttgcattccccaccagaccaggcagtgcctggaatgtagtggacactcaataaatttttgttgaattaataaggaagcaaattctatatgaaaatgataacaagtttatgagtactttttcaagtcagtttgcagatacaagtttaaggaaattcatactcggatatagttagaatgtgtatactgaattagaatgttagtctatgtgctttgggaattaattttgaagctcaggaagctatgcaagaggcagccaagctcagaggaagggtgagagacttgatcagctgcccctccctgtcttgaactatttcctgttatagatggaaatcatccttcattacctgggaaaaagtatgagcccaaagcagaattagccttctttatacatgtgttgaatttgtgttcccatcatattaagtattaaaggaaatgattatgagctgtttgttggacagtaaagggaagtgataatgataattttaatatagttaacattagcttgaaacacatgaaactgatatttttgtgtgtaaacacctaagtgaatattgacaatttcacatggtttaatttaatattgatcaaatgctacgtggtaggcactgtgctaagtaatgtatagtccattaatttgtttaaatttcatccaaaaagctttgtaatagatgaggaaattaacaataagttagggaacttgcccaacatacaaagaggacatagaaggtaaacagtttaacatcagagtcccttttcttaaacagaatactatcctgccagggaaaatatggatgtcataaattatgttatcaaaatcttgccttccaatcacttatttatgtcaacaaaaatgtgacaataagatataccatggttaattcacagtgcgaagtgtctgcttctagaaaggtgaaatttgcttataatacagttattattataccactgcaatatcgaggtcaagttctatggctacaaaatgacataatctttactcaagaaggtcacattgcagtaaagaggacataattataaagagtattacatcactagagttagatttttttttgttggtcaaatgactcaatccaaaaagtaggatacatagtaagaatgtgctatagagacaaagagataaatatctgaaaccaaggccccagaaaattaacaatctatgtcaaccataactgtattatccatgtgagtcaatttctatgggaaatacagttctgttatctatggataatacagttcttcctagaggaagaagcaattaattgatcttggaggggtcagggagagtttcatagaagatataacaactttacaaggcttgagggatgagtgggattgcattaggcagagaaaagaagaaagacatcctagaaaagggcgcaacatgtacaaacagaggaatgtgtgacagtaaacagtcacgttgaggaacagtaaatggtttatgtggctaggaggcaagtttgataccacattatattctgtattcctaaaacacccagacacgcgaaatgctgaaacagtaacttggactcttttgtgaagatcccaggactggaaatttctactgtgtcctagaaagcaatgataagccaacgatgctgtttccttctcgagctataactttcatagagggaagtgcacacatcttaaatggacagcttaggcattgttacatattagtatacccatgaaattatcacccagatcccttgcttggaagaccaaatgtcttttttcccccctcagaaatttattaccatttttcagaattaatattttctaaaacccaatataaaacattatatataaccattatggactgaactgtgtcctctgaaaaactcatctattaagccctaactcccaacatgattgtatttggagacagggtcattaaggaaattatttaggtaaaatgaggccacaagaatggggccttaatgcgatgggggtggtgcccttataagtagaggaagaaacacaggagaggttcctttctccactttagttcatggaaaggccatatgaggacacggtgggaaggtggccctccacaagccaaggagagaggcatcaccagaaaccaactctaccaacatgttgatcttggacttcaagctttcaaaactaccagaatataaatgtcgtctaagccacccgatccatggtgtctcaatacggcagcctgagcagactaatccaacagtctcgaagaattaaatttagaattggtcatcaagattttgttcacctcaaggaaataaaatgactcaatcctccacggatttgtttccatcattttcctttcctattttcagattatttgcaacctggagactgccctgcaaaagcacgtggcaatttccccttctggatcctcacaggagaaaaataaattcacattaacaaatattcagatgctttatttattctgaaaaaaataaaaaagtgaaattgctaaattgctaaattgagtttttcactggtcaaaatttacatagcccaataggtgtaggctccttactccttttgaggcattttctctctcttgattaacagtgatggatttttattgccccacttctgagaggaggatttatatgtcttttaatctgtgtaagttggactgaatcataaatggttcaccctctaaattacagagtaagtttgccaatagagatgaccttgtttattaaaatctaattaactgaagttttagaatgtccctgagtgggttgctgaatttctgattttctccaaaccaatatagatcaaatatccagctggctggagttaaccacaaagctctgaacctcactgtgaaattatctagttaattcctctttcagacattttttccaaaggtacaagcccaagaatcctttaatatgttggccatcctatttcagaaaagccatgtgcccaattatgagttggagaaagaagcccaggtgctccttgttcactgcaactgaaatgagaggaccctggagtgtaactttcattccccagcaatggtcagtcagaatgtctctgatcatgtgccacttttcatcttctggacaaagttctatgctgcctatacacataaggcagtaatattcatgactttttactgccaaccttggaaagcaatgttggcaaattgattacagacatatgggataaaacataattaattgattcagttcctagtctatatacaaaattgcttaatgctaaaactcctctagtttctgccctattgcttcttccatttctcattccaactttaagagtttaaggtttgtctcttctctctcatctcccatttaattatcagctattgaactttttcttcatgacattactagatccctttgtgtcccgtccaccgatgatctccatattgatatagctgatgtacatgctttaattttttgataacggacatttttgcaatatttaacataatataccacctcactcccaccccaccctccagaagctctctgttcccttggcttatagtacatataattcttttggttccttcagaattttagatcctgtattttcaacttctttggttcattcttcttctttcatgctgacactgacagtgctctcaaggctctttccatggctgcattctgacttgcatttagtcccagtcactgagagatattttgaagttctgtttttatttgggccacctcaccctgaagagtaagtacttttcattgttgtagctgaggtggtgtgcctttttcaaacgtctacgtcccacagcatcttcgagatattgataacataaaaacaaatatcgatcatcctaagggccttacagacttcagagatgggtaaaagaaaccacttccaccttcaaatcagtcttttgtatccactaggggagcaaaatgacctgctgagttgaagtgggaataacaaagtatctcaaagatgatgtgatgtttgtagagaaaagtttgtggcagtaatcgatacaggaatcacttatatggatctgtgttacttggagggggctttagaaatggcatcaagaagaaaaaaagcaatgcttcttggtttaaaaaataatgcttttatcattgaaaaatagtaccttttaagatggccaaatccccaaaataaaaattcaaagcatattgtacttccttctgaggccaaatgcatcagaactaatgctcttttgagaaaaccatgctatttaagcaaaaatttagggagtggagagtccgattattgtttttcatgagtgttgaagtctatggaaacaatgaaggaatgtacagaaagtaaattagataaagatttgatttataaaaattgtccaggtttagaaatttttatatatccaaacagaagtcatgaattaggtttccccaggctgtgaactagactaaggtggcatgtaccctcacattccaaagctgagtgccctctctgtccgtgtcacccagttaccctccttgggtgacataagagaagcccaacaattcctgggggtgtctcagagtccagcaggaaagatttatttgcagagttgagatgtcagcatattccgtctgcccacaaccatcatcaccatcatgggagtggactatcgctgtttagtttcaagggaaagaaacatggatgtgtggaatgaagccagccatgagcaacctttaaaggcacccacccaggggccatcaaggcaagagtgaggaggagtgtgaactgtgcagaaacagaggggagttgtcagtggctgggtgcacatggcattccagtttctgcacttatttattggttataaataacgcttcagaaacaccgagaagtcctagactattcactctaattttaaaagaatactgggccattataagggaagattttccccttgactacttttgagatgccaggagttggccattaattgctagatatgaaaacacatggaaatggcaaagaggctacacatcaagcattccctctactaatcatgcaaatgagtcatgatgtacaaaatgtaaggaactcctgtttagggaaaatatgaatgtagatgcacaaagtaaaatgtatgtagtccaaattagtcttctagccagtaaggcaattttcctatatgataaaaagaatggatttttatatcatttaaaggaaatacattgaaattattttagaatttaaaaaatgtaaacatgcatctttccttcttaaactctagagtatcggagatttgatctgtttttttctagctcagctattaactggttgaataccttagtctaggcattgttttattcctagtctattacctctgaaaaatgagggtagtaattagattatctcccaaaatattactgttctaattgcatgtggggaaattgcgtagaactacaaagtcttgtcatacaacctacattaactggttgagtaccttagtctagacactgttttattcctagtctattacctctgaaaaatgagggtaataattagattatctcccagaaatttactgttctaattgcatgtggggagactgtgtaggactacaaagtcttgtcctcaaagggctcacactgcatatctacgtgaagaaatattggcccagataaactaaccaacttacttttacatagagacagagccaaggtagggtttgcctttgcaaatctaagtcttgtacccctttcaccacgttaatgagatatggatcttctaattaaatattaatttctaaagaaataataagccccaattacagaaaaaaaaagatactaaaaatatttcaagagcattcaaggagcttcaatacaagaaaggcttgttgttgggtttttttcatctctctccattgatagttaagtacatacgggtagctattttagagctgcgcctagttaacgtctatgtttattcatgtatttattcaatcatgaaacacgtggagccggccacttttatttgaatccactttaaataaacacttttgtgttgattgtacaaagttccatgaaacaatatatctgccctcagggaacttgctttccagaaaggcaaatcaaagaaaaacgttttgcaaagaatcccgaaatggttacaagggctttctaagagaagtctaaattgaacagataattgtctcacattttgtaaaaggcctagactattctcactgaaaagcagtaattgaatctgtaattactttcatttcactggggacataggcatggattctaaagatctcattgtcatggttgttttcttaatcactctcattgcttcctagcaacactagcttccttccttccatgcaggaaagctcaacagtcaatggtgggcaaggacactatgagaaacatttaatggcacccacccaaggcccatcaaggcaagagtgaggaggggtgtgaacagagggacctgccgcttatttgcctttctgatgatccagcccctgtttgttttatgaacaaaggctttaacttctgacatagaagcgatttttgaaaatgaacgtaaaggaactggcaaactcagcccatgggtttcccttttaagaacatgaaatcacctcctcataatcatttcagtgatgccaggaacgttcctctctctctcccattcaccctccaccattcacagagatttgatttctagaattttgtcaaaagacaaaattgcacaaaaaattaaagatctaattggcttttattagcaattctcaaattgggcaacaccccactctataaactggaatagctgtcccagtgccctgagtagaggagattggctttataggcagaaaaggtctgaagaaagcagaaacaaggaataaaaagtggattggtcatttcaaagttactttccttgtagggttaaaacagggggatctcttatcatgccagctcaggcaaactggtctccttctctctttttggttttgacaaaatgtcttgctctatatggtggtatgatctcagctcactgaagcctcgacttcctaggctcaagcaatcctcccacctcagcctcttgagtagctgggacgacaggcatgtgccaccatgcccagctaatttttagtatttttggtagagacagggtttcgccatattgcccaggctggtcttgaactcctgagctcaagtgatcctcccatcttgatctcccaaagtgctgggattaagggatgagcccccacgcccagccaaactgggccccttctgattgatgactatgactctcctgttatttggaaaactggtggctttcaaagttcacgttagttatgtggcacctagcacaagtgattgcatgttggtttggtctgagttgttgggacctactgcagggcctactccaaaacaatggcctcccataaaccctgtatgacagtctcattaaggcattgcttctacttaactggtttgttaagtgggaggtttaaggtttgtcacctttttctctgagagcaggttttagtagagacttggacagagggcatgtagcagagaggatacagaaagatggagctgagaacaaaataaatacaataaactaaaaattcgccatacttttaaaaatatttaacaaaaactaactttggcttgagttataggtttcctctcctgttttatgtgcattagatacacacttttaacaattagatagtttttggtattaaccatgaagtagcatcttatttctgggtaaagtctgtctatttttttaagttgttttaaacttttaaaacattttttagttatgaatttattttattttattttattttatttattttattttatttttgagacagggttctgtcacccaggctggagtgcggtggtgtaaccttggcttgctgcagcctcaacctcctgggctcaagcaatcctcccacctcagcctcccaagtagctgggagtattgatgtacaccaccatgcctggctaattttaaaattttttatagagacagggtctcaccattttgcccaagatagtcttgaattcccacctcagcctcccaaagtgctgggattacaagcatgagacaccatgcctggatgtgaatttttatttaagagatagaaagaataagaacaacccaaagattatttaatagaaataactagacattaatcaaaaatctttagtgtaagccattagtaaaataactttccaggaaaattcttataggtttttaccttttgacctactttttctaaacacttgctatggaaaaagtacagtgtatttgaggatgattgttaggaggcagaaaaggtggagaaaagagaggctgggctcagtggctcatgcctataatcccagcactttgggaggtcaaggtgcgcagatcacttaagtcaggagttcaagatcaacctggccaacatggtgaaaccccatttaaaaacaaaaaaagatggagaaaagagatacaaagatttagaggtaaagtgaacttaattgtctgaacaagaaatcaaacaaaagactccaaaaagtttagaagccatccttgagatgcagatttaatgctaaaaatgttggcattttcagaatattacaatgatgaatgttgacagtcaaacagaattttattgttaagcttgtcctggaaaaaccaagaatgtttgattgtctgtgattgagacacagtccctaaatctagtttggaaaagtgacagatgtttcaggttgggatacaaaagacaaattctaaataaggaatgaaggagagaaggaaacatggaggaaattggtgggacattctgtgccatttaaatatcttgactcttgttaatgaatgtctatatagaggtcaaaggtgaggaaaacagacaaatcatgggtatctaagaaaggtgtgttttctatccaggaagaaaggtcaatggaatacataaatatagtgatataaactttaaaggtaggaaaagcccttaaaaacagagtcagtaaagattttgtagtccctggttcatagtcacaaagtagaagacaccaaagccaggaaatacaccactttgtagttcattaccctgctacttctagtgagatgtgtgcaaaacacttgtcagaccttattgccaattggcatttgagactatctacagttcttttttttaataacctcattgaagtataatttaaataccataatattcatcgattttaactgtacattaactgtacaagtgtacaggtttttttagtaaatttttagaaaattcattgagttgtgcaacaaatcaacacaatcccaacttaggacatcaacattatccctatacgattcccggttaccatgaatttctgtttctactcccagcccgacaaccactaatctcctttctgtcctggtagatttcctttttcatatcagtaaaattagaatatgtgatttttttgtgtgtctggcttctttcacttagcataaggtttttgaggtttgttcatgttgcaacatgtattcagatttcattcctctttattgtctaataatatttcattgtatgtattaccatacttttatccattcactagttgatgggcacttgcgtgatttccactttgggcctcttatgactaaatctgctataaacatctacctaaaaggctttgtgtgaacatatgctttcatgtctcttgtatagatatccagaagtagaattcttgagtcatatggtgtgtctatgtttaactttttaagaaactgccaaactgttttcaaaaatgactgggcacagtgtcactttagtgtaatccaagctacttgggagctgagacaggagaatcatgactttacagcccaccccccgagcaatgtgtgatgattccagtttctccaaatccttgtcaacacatgttattgcctctccttttgattatagctatcttggtagtgtgaagtagcatctcaatgtagttttagttacatttgcctaaggaatgatagtattaggcttcttctcatgtgtttatgttgtatttgtacttatatctatgagatatcttctgtagctataactttgacttcctgaattctgtccagaaatttctagtttgggtgatgctgtgatggaaatgcatgaaagtatgcagagtaaacattttttaagggttactaaataatcctgaaacttcacaaaagagaagtccatctactctgctagaattactgtataggaaaactcagtgtaatcattttcataatatttggtagaagagcaggcttattgtaaaaactggggatgtttatttttctttagggcttcatttttctactttttcattaagctaaggataagattaaactgcctggaggcttctttgctttctcagcacaataaaaaagtcaaggaaagacagcaaagcaagacagaattcttcagaaaaacaatactgaagggaaataacagtaacaccaggttagagaaacaaaatccatagaatcaagctttacttgagtaacaatgctgatggaaatagcatgtaagagtcttagttcagggcctattggaaatggatgatagaatttttccaatgtacaagcccactaacagatataattagcttattatgctaacatgataaatagttactgaatatctccctaaattagattgacctcaatctgtaaggatcgtaactttcaacaaaggctcgttttgcttgcaaaaagattcacacaagatgctcagatggacaacataaaggtatttcagaggacccctctccagaaaccaaattggttgtggaggctaggcacagtggttcacaccgtgaagccaggagtttgggaccactctgggcacaaaagcaaaagcaagacctgtctctacaaaaaaaacatttaaaacagtgggcgtggtggcatgcacctgtactcccaactactcaggaggctgaggcaggaggatcacttgaatccaggttgagcctacagtgagctatgattgcaccactgcactctggcctgggcaacagagcaagaccctgtctctaaaattaaaaaaaaaaaaaaaaaaaaagtaggttgtgctgtaggatcacaaaaactttgtgctggttaaaccactttactgcctttcatgaattagtttccacaactaatgtagagtccgcttctttgagagtttcacatgccattgcttgtggctttccattctctggatccctgtttagatctttggtcaaaagtgaccaaggaggcatctttatactattttctccttttattattttctcagctgacaattctttccctcttttgttgattgggtaaggaatatctgagtgttattactactagctatacggcaaccttttataaacttcaatatagcattacaaacattggttgatttgggcatgaggtagttctagaattcttttttgcttagtatggtatattgatagattaggggtaaatgtgaataaaacattgcagatatctttgaatttatgacttacaagtaacctcaatatttcagcctagctaaagacatctttaaaaggtaattttcacctcatctataaatgagagttaaaaggaaaattcttttaatttacatagtggtgttttggcttatattctgttttggtttttcccctttttaagacgaaaagtccaaggaggggatccagatagtgtgaatctgaatccagactgccactggtaaactttgtctagctaaattctctgattctcattcttctcatcagtaaaatgagaataatgtacattatctcacttaatgattattattctcacttaatgaatcatgatattaaattttcagtatcattgaccaataatgcaaacattttcataaaacgtggcttataaatttctatcatccctgatgttaatcagtttttcttgcaaaataattaagtaatgcctgcttttagtattaaaaatttttttaagttcaaaacctactaaaagtctacatttataaaattattacaaacacttaaaaattatatttccaaattatgagagtgtgtagatatgtgaattcctataaggttatacacatatcaatttgggcaatacaattacataataattggaatatttccaaacacttgttttaaaaatgctttctcctagcactagtttcataagaaggtagtacactgtcactcatcatatataaaccaacattactggctgggtgtagtggctcacacctgtaatcccagcactttgggaggctgaggtgggcagatcccctgaggtcaggagggcagatcatctgaggccagcaccagcctggccaacatggtaaaaccctgtctctactaaaaatacaaaaattagtcaggtgtggtggtgggcacctgtaatcccagctactagggaagctgaggcaggagaattgcttgaacccaggaggtggaggttgcagtgagtcgagatcgtgccattgcactccagcctgggcaacaagagcaaaactccatctcaaaaagaaaataataataataataaaataaaccaacattaccaagtgctgacaatgatcttgagcaacctgaattttcatacatccctggtagaaatgtaaattggtacatgcttttgggaaaactgcttgaaattatccactaaaattaaacatgtgtactttatgacccagcatttctacttttaggtaaatgcttgacataaatgaaggctaataagtaacacatctataagaacattcatagcagctttattcataatagccaaacactggaaacatccaaatgacaatagaatattcattcttattgttgtattatattttatttatataatacaatcttttgtattatataatacaaatacatgcaacatgtattatacaattttttgtattacatataatacaattttttgtattacgtataatacaattttttgtattatgtataatacaattttttgtattacgtataatacaatttttttgtattatgtataatattttttgtattatatatactattttttgtatcatctaaataaatatttaaagttgggtagaaggagctaggcacaaaggaatgcatagtgattccatgcacataaaggtcaagaacaggcaaagctcatctatgatgacagtagacaaatttatggttacttctgatggagtgtactgattgggaagggcatggggggtgcttctagggtgctggagctgttctaaatcattatgtgggtcatggttgtacaggggtgtgtgtgtgtgtgtaaaattcattgaactgtacctttcagattttcatgatcattattcatttcattacagaatgtcatagagattccaccatttaaagaccttgtttttataaaattacccatactatcttatagatgctggaagggttaaacaatgagagtagccacaagtagcagagcaccttctcttcctacaggatagatctcacttgtaccaaagctgacatatgactgcctgctatgtaatgcacagtaaatttaaaaatttattattaattaaatttatttctcactgttacaataaataaattgaagtgtagatggtttctgtcctcttgcatgtttctttgcatttattctcagtacatatttttgccccctctttggtcccttcccaaaccccttgctcaactttggaaacttgattgagttacacaacagttgcctaccatgatagtcagtgggatatttgctcaataaatttctaaagcaaaaatggacaattatgccccattatgagttagaattggcaaactctataaaggaccacataatatacattttagactttgggggggtcttatgtctctgccatagcttcttacctctgtagttgcatcatacatagacaatacatttttttaaatggctgtatttcaataaaacttttttatgaacactgaattttatagcatcacaaaatattttttcatcttttttaaaaccatttaaattgtgaaaattattcttagctagcttttgagccatacaaaaagaagtgatgggcagaatttgggtctcaggacttagtttgcagagctctgatttagagtcatgtaattttaagtaataacttgaatctcaaccttcagttccatcatttctagtaggttatcaaattaccatatgctgttagagagtgcttttatttattgttcctttaagaagcactaaatattaagtttaatatcaaaggctttgtttcctctttggcatgattgtaattcataagacttctaataaaagagggtgggtttgtaaaaaattccacagatatttgaggcctagtcattagtagctacagtgtcaataagaatcacagtacttttctgcattatcttaattctgatttgataaataattattttttaaaaacccttcattttgaaaacaatgaaataactaaggcagtatataatgcatttatttgaggccaactggccaagttctgtgactccttcctgggtttctatgggtcctgacacatgaggaaacaaatattcactgacattcaagaaggtcagaggtacaagtaactgctccacactgcatagcattttcaagacaggcctccaagttggttcctctccattccctgcactatttgctaagagacatgaatgataaatctttacatcattgaactgtctgtctcattctcctgtcatccaaaaatcagggtgggatttttctgatgagttctatgtgcaatttcaaaattgttatttctattcagactgaatagtaaaaaatcatctgaaagggtaaatttgaggaatgacatcacactgctttgtgcctcccacccattcactcccaaatgagggatccctcagccacagcagcagaaaaagaggacaaaaggccactgattttccatgaaggtgaaatctgtgctgcacgggctccaaaactcactgcacataactcatcttaagcccatctccaggaacccctcctgggtttctatgctccattctagagtcagtactttgcaactagccttgtctttcctcctttaggatggatacagggtagacttgggagacctgaaacaagataaatatagagtcaacagaagaacaaactcaggaggaaagccaactgggctcaaatctcggctccactcttcattgtagatggaaatagacacttattgaatacctgttctgtgctggaaacttcacataaactgttccagttgttaaactaaacaagaagagaggaaggaacaaaaggtgtcccttatttaactcatgtacaatagggaagaaaacttctgaaggaactgcttcaaatagggttttgtttcacatattattcaagcgaccaggttgactttgttgaacttctgattccatgacaacagcaaactctgcatgtgtgctcagggtttgacatgctgtggtgtactctctacctaaaagagtacgcagcataatggttgtgaatctctggaaatcagggtgtcgcttctgttttccagaagatgaagatgccagaagggcttctgagcaatgtgctatgagaccacctatggaagagagagaacaactctttaactgtggctttacttagtaaacttccaaacgattactgaaatgtcatcattagacaacgtaagcaactagcagaaaattcatatgtctaatgcagcctcctcattctttttctgtctttccctgtgatccaggaggaaggatgctggtttcttatcatacaaagatcacctgccagtgagccaagtggtggttggagatactgaccgtcaaggctcagaagccaaattgagcgtaggtcctctgcgctgccaaggagacagtaagtttgcatagcagctatggcttgcactttcttatcccatttaaatattgtttccaggctcctcagaagatgcctgcaatcagacttgctctcctgtagctcctacagaaacatcacacaacccaagcagagataacttagaggaggggaacagccataaagcctccagtacaggagccgagatttgggcataaagtggggatatccatctttcctctatattcatatgtaacaagtttgactacctaagtttatgatgatattaatagcaatgctaatagcataaatgcagtactcaacagctgtgattccacggagtgctgctgttaatgccattaggatgactatttatatcaccataaaccgagtttatggtgatataaatagtagcattatggcttaatgtatcattgtaaacttggattatggccatataaagtttgacattattgctatcaaacttcatcatcatcagagcttgatggtcccttgtaagccaaagattgtttctgttaactatgtcttgctttcaagattagtcaccccagagaggaatttggggctgctagcttggacagtgggaggtaagggagttggagtgatggtccctcctaattaagggcaccattaggattttatgttgtttgatacccttcggtgtgctttatgtgcagtcagagggaaacagtgacatggttgcactgtggggattctgcagcgagcatcctgggcatcgttttctctcttctttctgggacacgtggtttaggcaactctcctgagagttctatgcttttgtgattgtgtgctaggcatccggagacctagattctgctccccaaatagctgacttgccaggagacctcaggcaaacccctccattgtcttagctgtggtaatgagaataccacacacatcccaattcctcctggggaggctgtgaatattttagtgcctggatttggattcctcctagcaaagcattatgtgagatggaatattattaccactttgtaaatcaagggagaattagacctacttgataataaattatagcgtccactcaaagagatgtcctaaggaacgtaatgatgcatgcttaacagtttcctacttagtaaattgaggttgtcagcaattaagcaatgccatgttcctaatacaaaagggagatggactttgtactgatttttctctacttacattgaaaatgctacctgtaaaattgagactggtcaagatctttatcacgcacttattgaacaataatacttcatttgtttagtcaggcttagtaaaactgtgcagaagaaatttaatttcaactgcctaagaaaaggatattcacctaaagcaatagtatatatgcattttaaacaaatattataagaaatgaaatacagtgttgctctaaaattaggaagactgtcatgtgttgtctaatgaaaatcatttttgttatggaataattactcattagcatataaaggtaaaatatttctggcttaccgattctaattctgaagttagctttgaatttgagaaagtgttcccattaaataattgattaacttaatatatttataaaaattccacttctgcaaactttttttcttgtctgttttgttttgctttattttctttttttgagacggagtcttgctctgtcgcccaggctggagtacagcggtacgatctcagctcactgcaacctccgcctcccaggttcaagtgattctccagcctcagcctcccaagtagctgggattacaagcacacgccaccatgcccgactgatttttgcacttttagtagagacggggtttcaccatgttggacagactggtctcgaactcctgaccccgggtgatccacacgcctcggcctcccaaagtgctgggattacaggtgtgagccactgtgcccagccttctgcaaacttttattaccattcttaaaaaaaagattctaggaacattaaatagtagatgctgcagtatatgagcactttataattaatattagcttatttgttcttaataaatcagcctcaggaagaatttattgtgaggctgtcattcatctagaactttcctaggtgctctggaaagtaagaaaaagaagttcaaaccatgttatgtgaaatgaacatgaaaaaatattggaaaacacaaattggcttataatttaattttaggctttgtaatataaaattattgcaactgataatcaagaaaggagccatagaaggtgtatttcaggcagactttctttttaaaaaagagaaaatgagaaaagtatagtggtcattgttcatttgcatttctattctagggctgttgttcttagaaacatttttagaacctattatcaaaataaacttatttattcacattacatgatctcagtatacttataattactgtaacttcagagaaactcttttaaataatattttacctgatatttcatgaaagcaaaagcagtcaacagttaatggcaattatgtagaatacttttgtgtctgtgtgagagagagaaatctcattgttttccaggcaaccgagaataagtatcctacctggtactcgaattgcctggtagcagtcagcagttgtgaagcccatgttccctttaagaatgttctcacggccgggcgcggtggctcacacctgtaatcccagcactttgggaggccgaggcgggcggatcacgaggtcaggagatcgagaccatcctggctaacgcggtgaaaccccgtctctactaaaaatacaaaaaaaaaaaaattagccgggcgtggtggcgggcacctgtagtcccagctactcgggaggctgaggcaggagaatggtgtgaacctgggaggcggagcttgcagtgagcagagattgtgccactgcactccggcctgggtgacagagcaagactccatcttaacaaaaaaaaaaaaaaaaaaaaaaagaatgttctcacatggacacagtagtgatagagtgttccgtatcaactgcattttccagtttttatacatatgtgatctccctggttacacacagcctcctgtgaattgggcagggcaaatattagtctttctgccttacaaatgaagaaaatacttctttgaaaatggcatttacacagcaaatttctgagcatactttcagcctctgagaggcttcaggacaaaagatggaacagagaatagaaatagctgtgtctgtacaaggtcagagttgttttcccaactgtactctcatccctgagccaattgttgattaaattaaaatgccttaaaatgtttcatttgggttttatcccaccactagcctcagccacacatgtcagttaccaacatagtacaaacattatagggattacatttatgtaatttaaaaagtggcatagtgcatttttcctgctgtttatagagatgaacttactttgtgtcatttactgaagtctgttcaaacctacagcttataaagactaaacctattgttgaaaaatatctttcagtttgaggagttgagtgatgacagccctcagaacctgcctcttgaattaggccccagttccatcctctagtctcagagaatgaaaccatttttgtgggctctgcccaaccatttcagcagttttggttgatttcatcatgcctgctgagtttcatttttgctttgattcgtctgaactcagacccatataatcaaaatgctaaagaaaatcagtgcatgccactcagatctgctgcatttcccatatagttctgtgaaatgcttatgtccttacaggtgtgtgtgtgtgtgtgtgtgtgtgtgtgtggttttttttttctttcattctttcttttttgcaaagcctatccaaatggaaacttcaaatcaaatgacactgaaagtatgagtggtgacggatggttcgctgaaataaaaagtgctgtgaaaatacaaatccccctcttaaactacacgtacgcacctagaaagaaacaaaagaaccatttggaagattaaaaatcaatgatcaggtagacattgtttcaaattgaaatatgtaatcatctttgcagatggctgccaaactttcatactttcatgaaattagttaaaaaaataaaagacttccactttttggaggtagaaatctcatactatatatgacgaatataattaattgtaggaatatagtatttgctagacaattgctttattttcagccatatgatgtaaaactttactgtactcctctagggatacggggactgtaaataaatactttggagcaagtttgtcagaaccataggaaaggtttaaaaaaaaatcaaatgttttcagtaaacctgggtagaaacaattccagaaaatgtcttattcaagggcttcttccaaggccatgccagaaacactggctgtgaagctggcagacagagcactggagtcacactgcaggattaagatgcaaattcagtttctcagagctacggaggtgacccagagagacaaggaaggaaaggcaaggcagtagtgacacatctagttctggaacactcagaggacagacaaagctgtgtgtaaacaaataaagatactgatggagattcatcaagatgatggtgaatatttgttctttgggaaagttattttatgtgccagactaataggaaggccattatcttttttttgcaagaattttacaaaccaggatcataacctgccattcccttgacaggagagataagatggccaggcatggtggctcacacctgtaatcccagcactttgggaagccgaggcaggcagatcacttgaggtcaggagttcgaggacagcctggccaacatggtgaagccctgtctctaataaaaacacaaaaattagcagggtgtgctggtggccgcctgtaatcccagctactcaggaggctgaggcaggagaatcatttgaatccgggaggtggaagttgcagtgagccaacatcgtgctgttgcacttcagcttgggtgacagtgtgagactccacctcaaaaaaaaaaaaaaaaaaagcaaaaacagacaaggcaataaggcaatgcctcggtctccacgttgtttctgtaccaatgaaacatttccaacaggggcgcacatggcagtaactctctttcagaagataatacccacgagcatacataggccacatactctgtgcagtgaatagggactgaaggagaaaccacttctcatctgggttcaggaagcaattctccttattgagaggaagcagctctccaggctccagagaagagttcaaaatttatttatctcctttttctttgctgcttcaggcttggaaaaggcaagaaaggaaaagggactagcatgcaggttctaaaccaatcactttcgattcattttctctcttgattctctcaacatcccttaataggtgatactgttgacaaaaaaaaaataaaaataaaaataaataaataaaaaagtaccctgtaaaatatttaaagaggtttatttaagccaaagatgagtggccatggcccaaggtacaggctcaagaggtcctcagaacatgtgtccaagggctacaatttggtttttatatgttttagaaagacataagacatcaatcaatatatgtgaggtatacattggtttagtctagaagcaatgtgagagtgtggcttacaagtcataggtggatttaaaaatgttctggttggagattggttaaaagagttaagttattatctgaaggtctggaattgatagaaaggagcatctgggttaagataaggggttgtggaggtcaaggtacttattatgtagatgaagtctcctaggtggctgcccttagagacaatagatggcaaatgtttccatttagacctttaaaaggtgcttagactctcagtaaatttcttctggattttgagggcctggaaggggaaagatctagttatgttgatagagattattcatagatgtgaattttcccccacaaaaaaactgcttagcagggtcatttcaaaatatggcaaagaaacatgtttgggtgtgaaatctttttatttcttcctttttctgtcatgtgatgttatgctagagtcaggttaaaatttggtatcttattgctacagtctgtaaactgtcatggccctggtggaagtatggcagtgaggacaaccagaggtcactcttgtcgccatcttggttgtggtgggttttagccggcttctttactgcaacctgttttatcagcaaggtctttgtaacctgtatcttgtgccaacttcctatctaatcctgtgacttagaacttctaaccacctgggaatgaagtccagcaggtcttagccttatttcgagatggagttggtgcttagatttttagttttggttcacagtacctttgactccagtgtactgatgaggaaacagaaacaatgttattaggtgctttgccaataagtttcagagttcagactggaatctacctagttccaaagtcctcctttctactctattcaatcagagctgatgttaggataaaaatgggaagaaaaaaaaatctcttatgctctcggggagtggctgggtctagctgtttgctaatgagggggtctagggaaacatccctattgccctgtgaagggtcactgaaaaaccaactcacaaggcaggttaatagaagaaaaggcatgcaaattttactacagggagaatcacagaatgatttctcaccccccaaaggagttcagaagcttatatatcatcctggaaaaacaggttttgggagcaggggaggagaggaacttcactttcactgtcaaaaggactatttactggctgggcgcagtggttcatgcctgtaatcccaacactttgggaggctgaggcggatggatcacttgaggtcaggagtttgagaccagcctggccaacatggtgaaaccccatctctactaaaaacacaaaaatcagctgcgcatgttggtgcgcacctgtaatcccagctgctcaggagactgaggcatgagaatcgcttgaacccaggaggcagaggttgcagtgagccgaaatcacgccattgtactccagcctgggtgacagagcaagactctgtcaaaaaataaataaataaataaataaataaataaataactatttacaagttcatctctgttcctagatccatttattctctctggtaatcccctcaacagaattcctcttctctccactcccataatctatttttccaggatggtaaataagcttctgaacccccactgggggtggggggtggggagtggtaatccctctggggctctccttggttctccacatgtacatgttaaatcaatatgtatgccttttctccatttaatctgactcttgggagttgatttatgtttttactttttttttttttttttttgcgaatcttcagagggcaaaggggaagattccattggctcttacactggcaagctgtgtcttctaacttactcttacatgaagggctggttctgaaagcagagataaaaaaaggataggtgacaaaaactgctcccagtcccatgcttagtggagaaaagatcccccttgattttgcacccctctttttgacaagtcatcaaacaactgatctttttccacttactgcatctattttggctcccctaacagtgtacttcttaaaagtaaaaacaaaatctaattcacttgtatattctcagtagtatcacatgcctaacacctagaaaggattcaacaaatgtttgttgaatgaggaagaaaaataatacatcagagcagagggagagtgataatgccaggtttggcctgaaactcagcttctgcccttagggcactcatcaccccaagcagagaaatctcagggcgctggggctttggagttctctaatggagccacaggtgctgggccaactgacttcctacatgaaatctggattttagaccctgttttcctagacccctcatttcctgcttgggtacagctcttgcctctgccttttcttttttaaagttttcattacactgtgtactgatttctggctcactttgcttccctactattgttctgaaagcttatctctgattcagccccacccagaaaagagaggttgcctcaggcaatctatgtaggatgataataggtgtattaccagcatagaggaccactttctctctgtctctccattcctgccctggccattaattataatacattcgatttacttgggtttggtcttcagccctcatgcttttgcaacatcatgatgggctcatacatgatttttaaaaagagcattaacatcacaaatctcagaatgggtaacgtttgatcattcccagtaactatttcctgagaagatgctctaaattgtttttctttccccattttttcccacaaaatgtggctgtatatttttgcctcacgtatagctcaaaacaagaccaagaatcacagtgtcctaacagtggaagcgtcttagagatcaaccagtgcagaacctctcattttacagatcaggggtctgggtctagagaggttaagtgactggcccaaggtctcagagctggtatacagcagagcacatcgagaaacagtttaatacagccttcatccttagtaattccccagggccaagatgaatgttgacacccaaagaggaaactttgacctggaacaatgaccttgggtctctgcctatcaacagctgagtgggtatcagaactcttaatcttactccatcatgagatcaatcatctggaaatcttgatagaaaacctacagccacagaagtgagggtcagtggcagaaagttgatgacttctgtttttttgttatgttttttgtttgtgtgtgtgtgtgtgtgtgtgtgtgtggttggttttttttaactttttagggttgataatagaaggcatgaaaaaaaaaacaaaagcaaaaacgccctggagtgatgtgtagaaatcattaagctctattttttcttaatgtcccagccttcactgctattgccatgggctactaacaactgagaagcagtagtgggtctaagaacaagcagaaatagtgaaattttcaggatcacaacctaggctgactcccattaatggattgagcccaccgggcatttctgaggtcaggtccaattacaaatgctgtagcttttacaagtagatggaagccttcccttttatcttccagattccagagtgactttaaacaattagaagaaatggacaattcctgcgaaggaaatcagctctttaagattactcagttactcaacttcagctgcaaactcactgttgaaatgggacgtaaaattggttacagtttggaaaaaagtctttctgttttacaattgacatgatatttgtgtgcgtgtgactgattttcttacctgtcctttcaaataccatttgtatttggaggaatcgtcacatgccacagaggaattaacgtgaatgagctgatgccagacttggttctgcaggtctgtgttgtcaacaaagagtcaaattctgtaaaatatttgaagacatttattctgagccaaatatgagtgaccatggcccatgacacagccctcaagaagtcctgagaatgtgtgcccaaggtggttgggacacagcttggttttatacattttatctattttatgttattttattttatattttattttttgagacagagtcttgctctgttgcccaggctagagtgcagtggcatgaccttggctcactgcaacctctgcctcccaggttcaagtgattctcctgcctcagcctcccaagtagctgggactacaggtacatgccaccacaccccgctaatttttttatttttagtagagacagggtttcaccatgttggccaggctggcctcgaactcttgaccttagatgatccacccctctcggcctcccaaagtgctgggattacatgcatgagccaccacgcctggcaggttttatacattttagagaggtatgagacatcaatcaaatacatttaagaaatacgttggtttggtccagaaaggcgggacaactcaaagcggagggtggtgggggtaggggttccaggctataggtgaatttaaatattttgtgattgacaatttgttgagtttgtctaaagacctgagactgatagaaatggaatgttcatgttaagataaaagattgtggataccaaagttcttttgaagtcttatagtggatgcccttagagacaatagatgacaaagtttcctattcagatcttaatctctttaggattgggagggtctagaagaaagagatctagctatgttaatagagattctttacagatgcaaaatttcccccacaaagaacagctttggaggcccatttcaaaatatggctaagaaacatgctttggggtaaaatattttgattttcttccttgtctcataatgttatatgagtcaggttggaaaataagtcacaatatataggttaaataaaacccatctgatgaaaatttattatttgtagggcatgactccccacacctcttagataggaatttgggcaagacttaaaaaaaaacaatcagagtttagtcctcagtgtggctggatgggttctgcctcctccatgtcctctctctgggtgcctctcccttcctgaacttgttactctctgcagaagaaacagcatccccagatgcaggcgggagatttctctgcaaattgaatccccgtaatttggtttctctgctgaactctctgaccaatctctcaccatttgaagagaattagtcttggcctattggatctaaacatccacagtgtggagcatactttggaagtgacagaaacacggagtgaaatagagtctaacctattccaggatcagctcctgaaaacaaattcaacctaagagactttattgagaaaaacgagacatggctctgatcctggatcagtttatgtttcagtgagggtgaaaattttaacaaagtggaggagattaggatggaagtttggattcctagtgggactttgagtggaaagctgagaggcctcatgtagttgtgctttacaaacattaatgtacttagaaaccacctgagatcttgttaaaatgcagattctgattcaggaagtctggagcaggacctgagatgctacaaggtgtggctgctgctagccaacaggccacgcttaggccagcaaccttacatagcagcatggtgaacagcacagactttggaatcacacccacctgggtccaaatcccaactttctccctcactaaccatgtgcctttggacaagttccttaacctctctgggcttctacttctcacccagatccttacctcagctgcaaatgagaataattgtaacatcactgagtttgctccagtaaagcctgattgtccccagtccttgcacatagtcagagctctctaagtgttagccaacatcatcattcttatatccatttgctgtggaaaaagtggcaggcttgatatcagaaaagctctgcccatcttcctgctccatgttcctgtccctgtacccttgacttcatgccttttcttggagaagacaggcctagtctcaggtgacagtgtagcatccagccatttagcttctcctaatttggaggtgctggccacaatacctgattagagctcaactgcattttctgagtccccagggacaatgtccttccacataagcaatctctcatttccttctcatcatgtggatctcagcttcgatgttaattcttctaagaggacttctttgtccactcagctgacatagccactcacacctccctacagcccttcttaattttcttcatagaatgtgccactccctggaattatctctgcaatgcacaactcaattctgacaccaactgccctgagttagcacagccttcacaagttaaaagcacagtccccaacaaaacagccttctcttcacacaccagctgcaaacttgggtggctctcaagccactcacatttctgaccaactgactacaaatttggggttgctactattctttcagggtcaataattcactagaatgactcacagaactcaggtaagtgctatacttataatcagagttttgttataaaggatacaaatcaagtctagccaaatgaagagatgcacagggtgaggtcgggggaagcttcagagacaagagcttgcatgtcctctccctgtgaagtgagaattgtaggagttaaagaaagaggaaagaaacacaaaaggcagctcaacagtcaaagacaggtttattttggagaacaaacctaagaggggcttctggctgatttcagtcaagagcactctctcttacagactaagagtatttaagggttttagggtgagagagcttatcacaggcttggactgtttctgtgtggaagagaagtttattgcagggttgaaatgtctctggttggaggggggttatcttggggctgacatctctccggcctctctggccagaggggagattatcttggggctggcatgtctctggctggggaggggtttatcttggggttggaatgtttctgattggagatatcatttgtggtttatggtcatgctgaccttagcctgatgccctttggacttaggcgatttttttatcaaggggaactttaaaatggcggtgcttgtccaagatggtgatgctcctgctctgtcaagaattccctactcttctggtacaccagtgtgcatcaccaaccagtgacgctcacccaggctttgggtgttcaatgatttattgggatctcattctgtaatcatgattgattaaatcattggccacatgattaaatataatgtttagcccccttttcccctcctccctggagatcaggctgatatcaggaagctcaaagcctcaaccctctatcaggtggctggtcttcctggcacacccagcccccatcctgaaaccacctaggggcccaccatgagtcaccttattggcatggacccaggcatggtccctggcgctcactatgaataacaaacactcctatcacttgagaaagtcctagggtttagaaacttggtcccaggaacctgggacaaagaccaaattaatgacctgttatgagtcaatctcttttctctatttatttgctttattgtcaccattgtccctaacagtagacgggaatctcaggcagaagtctgtatcatggtgccaaggacaatgcctgccacattgaggcactcagacatgtgttcattaaattaatatgaatggttaaataaccacaaaagatgatttaaattagcatttccaagtaacaatggaggcagtgcatgaggcacttcatgataaattgcagaaaacttgcacagacaataattgttataaaggtccaagagaagcactatcacttgatttatatgcacaactatttttaacctcaacagggttttgcacatttattcatcttaactaaatgaaaacttttattcctttgtaccttgaaaatcccttgaatctgatgattatctttaaattaaggattaaaaaaaaactcttttgctaagtttttatacattctttggcaattctaaattaagatgcacatgaagtattaaatttatataactcattgtttaatctaaattagattaacccccttggcccttcagagatccaagtagaggcttccatacttttgtttatccatgtctcaaggttattactgacaaaattacaattagtcagtacttcatgtccattgttagggtgctaagctgtgagctataaactacctcactctggcataattaaaaccgtgttccagttcacctattttatgatacctacttggctttccataaagcttcttttcacactcctaactatgtgcaggtctgggaaacttgggaactttactgaagaaaactttaaacataagcttcttcttgaagtttgctgatagttctgttatagcagtcttactatcatcaggataaaaaaattgtactaaactattgtaaaaacataagatttgtattactacctctttttttttttttttttttttttttgagacagagtctcgctctgtcacctaggctggagtgcagtggcgtgatctcggctcactgcaacctccgcctcctgggctcaagcaattctcctgcctcagcctcccaagtagatgggataacaggagcatgccaccacacccagttaatttccacgcccagttaatttttgtatttttagtataggtgaagtttcaccacattggccaggctgatctcaaactcctgaccttaagtgatctgcccacctcggcctctcaaagtgctgggattacaggtgtgagccaccatgcccagcctctattactacctgtaaaataaatcctaattcaaaagtcgccatgtgtatgtacataggaaatagtgcatttgaactggcatttacctactggcataacaaattgctctttggaatagatgcctagtcccaagttaagaagaaaaggggactcctgtgtcccatccatagtttctcattaagtccaagagccaattgtgctaaagtaaatgaatatcttcaagctaacctataaggggtggtgggaatattagttgctagaccaacacttaatcaagaatctctcacactgtctaagggtgaatagaacaactagacttgtagaggattgcttaatctttttatgaaaaagtcatgtgccaattaagattctagccatacctccttcagggttttcttgacttactcaagctttagacaatgaagtggctcaataatcttttctgtaatccctatgtctaatgtattaagtattccttaattcaatttggtagattaccctaatcgattttgttttctggtatttaaacctttagaatttaattatattatactgaataggatacaaagtaggacttgagcttaaaagatggcctttcatttcacagaaaagaaatttatatgtcaagtattttgctgtggtattctcattgacatagctgagatgataatgtaaccagttcacgacgtcaggattgctatgagagaaccccgttactgggtgcttgatttgctcttttggtttatccaaagatactgagtttgctctgactgcctcggttttctccattttaacaaaggcaaaaaccaacactttgtattaaataacctaaaccttggcattgaacttgtcaaaagagaaaatgacctgaacattagagccaagaagatactctgttgtattttactttgttacttaggtatctttatttattctttacttatatatttcaaaaagacatagccttcctttatggaaaaattcatttgttattatttaagtacaacagatagatagatgctccaaaattaagtctgagtgttttctttgcctgcagaactgacagtttgcttggcttatgctgataatccccaaaaaagtcgcttgtgtcttgaacatccataggaaataaaactgtagttccgggcagtgtcgataagaaagcaaactttacaccttcacttaggggttgagaaagagaatgagctattgattccactctgaactttagatggccatatcacatctgaaaccagtcatttcgtggtgggcagtattaaacccgactttgtcttatgactttacaaattagcgaattatgttgttatgataagagaacccaacaaaagtatctgagtttggaacatcaattttcaggatgttatatatttgagaacacttctccactgctcctctaactcctctagcctacctaactttaatagccaggcctccttcctacctgtttccttcccccttcacaagaagcacctattaaggaatcaagaaaaaaaaaaggatgacacttactttcggaataaagtaatatagtctctactatttctgctttcacacagatttgccctcctttctggcacaattacacatacacacacacacacatgcagatatacttacgtatgcacacatgcaggtatgcttagaatttagcattaggctgggtgcattggctcacacctgtaaccccagcactttgggaggccgaggtgggaggattgcttgagccccaggagtttgagaccagcctgggcaacatagcaagaccctgtatttacaaaaaaataaaataattaaccaggtttggtggcacatgcccgtggcccaactacttgggaggctgaggcaggaggatcactggagcccaggaattcaagactgcagtgagctatgattgtgccactgcactacagcttgagtgacaaagtaagacctgtctcaaaaaaaaaaaaaaaggaacttggcatttgcaatcctgaacctactttaacccaaggtaatatggtttggctctgtgtttccacccatatttcatcttttagcttccataattcccatgtgttataggagggacccagtgggagatgattgaatcatggggacaggtctttccagcactgttctcatgatagtgaatggctgtcagaagatctgatggttttaaaaatgggagtttctctccagaagctctctttttgcctgctgctatccatataagatgtgactttctccccttgccttccaccatgattgtgaagcctccccagccatatggaactctaagtccaataaacctctttcttttgtaaattgcccagtcttgggtatgtctttatcagccatatgaaaatggactaacacacaaggtaaccacaactcagggcttaaaacttctggacaccagtgtagttggaagatatagagaggaagctgaagagaaatgagaggcagccttggaactcgttcctctcagataagggggaactgctatagttgtactcatgggtatgactacagcaaaaggatacaaagcaaagtcagcaaaaggaaacgtgcatgagatgaagtccagaggaaaccaaacacaagcttccaagagactcccactggagtccacagaacacacttaattcccccagctattagttgtggcatcatgtgtgaaatgctgtctacaacagaggctcactagagactcagcacccaaggttttattgggtactggtcacaaaggcagcccctaccaggcatgcacccaaaacccagactcccagaagaaaggcagttgtttagcacaaaccacattgtttgtaccaacagttcagcatagtggggcattcttattaatcagttaaccctcctgaaatctaacttggtgggccagccatgggaagcacttctccagcacaaggatgctgcctctctccttcccctgctccccaaacccttctccacactcttttccctctcccttccatagaagtattaagaagatgtgggaacatccagatcttcaacctcacaccaccctgcatcacactcctgacaccatcatactccacttccacctggctttgtcctgcctcttctaattcttttgttgtttttttttttttgagatggaatcttgctctgtcacccaggctgcagtgcagtggtgcaacctcagctcactgcaagctcctgccattctcctgcctcagcatcccaggtagctgggactacaggcgcccgccaccatgcccagctaattttttgtatttttagtagagatagggtttcaccatgttagccaggatggtcacaatctcctgacctcgtgatctgcccacctcggcctcccaaagtgctgggattacaggcatgagccactgtgcccggcctccctgtccgaattcttagagaaggaaaagaaaaaagactgtgctcttttcccttgagctgatcctttgtatctcatggcctgcagtttctgctgcatccattccccgggcagcaccagctacataatttgcaaagtccagtgaaaatgcaaatgcaggaccatttgtattgtgaattttaaaagagagacaataaaccaggtgccaggcccttctgaggctgtgagggtcacacacctatgtttctacgtgctagcgaaagcacaaggtcaaccctagattctgaatatcactggggcatggcagaccttgcagatgtggatctgcaagcttggtttctctaatagctttgaaccacaagaaacatttatgtgatgaaaaccaaactatatatggcaaaaatatttaacacaggggcttcttatatgtactggcaaaccatatcatattattgagttttccctaaacttgattacagaaattacctggggttcttatcaacatgcagattcccacacagctcccctagagattttgatttggattctccagagtggagcccagtaacctgtttttaagaagttttctagaatatttttctgacagggaaagtgtagaaacttaggctcagaatatttgggggcagacaggcctatgctgaaattctccatttatcagcagtgtgacattgggaaagttatttaatttcactaagcttcaatttcctcatctgtaaaatagaaataattgtgctagtacaaaaggttgctatgggaataaaatgagacaaatgtctgtaaagaacttagaacagtgactgctacagtaagctgtcagtaatcgtagttataaatattacagaaaaagagtagaactcatttaaaaccctcagttttgtaatactagatgaattaagcttaaatgcaaattgctaaaggcaacagttatttctgtcaaattaaactcattcagaaataataaattacaatctgaagtgaacaaaaggctcaatcagtcatcaatggtaaacattttgagcactgctatggtctgtttttgtctttccaaaatttatatgttgaaacctaatcacccacatgacaatatcaggaggtggggctctgggaggcaattaggtcatgaggccactcccattaatgggattagtacccttgtaaaagagaccccagagagcttattggccctttctgccatgagagacttcagctggaaggcacgatccataagccaaaaagtagaccttcatcagatatcaaatctgccttaatcttggacttcccagcctccaggactgtaagaaataaatttctgtttttcataagctacccagtttacgatattttgttataggtagcccagacacactaagacaagcaccttgtgttggcagtgtcacgatgcctccgttcttgtcttcttagtttaaaagaatttaaacagctgggtgtggtggctcaggcctgtaatcccagcactttgggaggccgaggcgggtggatgacctgaggttgggagttcaagaccagcctgaccaacatggagaaaccccgtctctatttaaaaaaaatactgaattagctgggcgtggtggcacatgcctgtaatcccagctgcttgggaggctgaggcaggagaatcgcttgaaccgggaggcggaggttgtggtgagccgagatcacgccattgcactccagcctgggcaacaagagcaaaactctgtctcaaaaaaaaaaaaaaaaatttaaacaagagacgcacagtgaagcgggtgcagcataatttattgcaaaagaaaaagaatactttgaaagttaagtgcagaatagacaggatgctctgagagagagaggagtcagggtgggctgccggggaggatgagacagaaaagattggcgggagggagactccccttatgggagtcttacctgattattcctaaggaggtgaaaagaggtgttaccagtaagcatgttctgggtggttctctgggtgcacatgcgcagtagccgcacatgcgtgttcatacgtctcatgtctcattaacatcttaaatctccacctaggggtgtattttataccattataatgaacaaagggtcagtctgaggacggatgaaatcaaagtgcgcatactctctacagggggagtccctaatgaagatagctttgcttgaacgagctcaattaccaagcgaatgctggggcttattgtattgactgtgtggtcaccacggttgctgcgtcctaagaacatggtcatttcttttttcttttttttttttttttttttttttttgagacggagtctcaccctgctgcccaggctggagtgcagtggcacaaactccgctccctgcaacctctgcctcccgggttcaagtgattctcctgcctcagcctctcgagtagctgggattacaggcgcccgccaccacgtctggctaattttttgtatttttagtagagacggggtttcaccgtgttggccaggctggtctcgatctcctgacctggtgatccgcccaccttggcctcccaaagtgctgggattacaggcgagagccacggcgcccggcccatggtcacttttttgactacctatcctgcctcattgatagcaggctgcagatacagaggcgtgaccgatgatttttgcaatcaaggaattgatcatctatttcaggataagttagagaggtgagaagatgcatctctttaaaaggaaacacataaaggttaaagggcaaagcaaagagaatgagtaaagaccattttccgtggggattggtggagtgggtagaaggcttgagctggagaatattagacaatgattagccaaacgtaaagaagcaaaagtttcctgtagaaaaatatgcaaacatacacagtaagcattcagtaaatacttgaatgagaaaatgagacctgagttggaaccagaaaaaccgacaaatgccaataatcccagagctgaagatagtctgtagacagtggggagtttgttagccagaaataggaggggtgagtgggaaatctttaattaaaataaaacctttaatctttaattaaaatattaaactcttcacttgtgcttagttgcagagatctatgcctatgtagttttttaaacaaataaaacaaacattgccaataaaatgatgtaattcaataaagggcttacagtaggttccacatccaacaacgctatactgaaaatacacaattaaaacttattgttatattctcattatagaagtctttttttttgagacagagtgttactctgtcacccaggttggagtgcagtggtgcagtctttgctcactgcagcctctgcctcccgggttccagtgattctcctgcctcagcctcctgagtagctggaattacaggcacgcaccaccacacacagctaattgttgtatttttagtagagacggggtttcaccatgttggccagatggtctcctgacctcaggtgatccgcccacctcggcctcccaaagtgctaggattacaggcatgagccaccatgcccggccagtagaaatcttttttaagaagacttttaaaagctactcattttagacaagcctttcttaattgtgtaagaatgcttggaaaaaagtagtattttactatttttaataaatctgtaaaattattgatgactgctagcttttctgttttgcttcatttataagtgaatgaacagtgattgttgtgggttgaataacattccccaaaagagatgttgaagtcgtatcccctcatgcctgtgaatatgatcttgtaggaaatagggtctttatagatataatcaagtcaagatgaggccatactgaattggggtgggccctaaccctatatgaccggtgccttataagaagagaaagcgcacacacacacactctcacacacggggagaacactatgaaaaaatggaggtagaagttgcaattttgcagttgccctgccttaagccaaggaacatgaaggattgccggctactgccagagcctgggagagaggcacgggtgaacattctccctcagaatctgcagaagaaatgagccctgccaacttggactgtggatttctacccccagtactgtgggagaataaatttctgttgatttgagccacccagtttttggtactttgttaaagtagcctgaggagcctaatacagtgacttcctaatcaaagaatgtggaggcgcaattcaagtggtcttttcaactccaagaggattgggctgtgtttgttatggttaaaggaccattagcagttgttgaaaggataaagggaaggtacttcagtctgatgcggagtcagtgaggacacccaccgctcccctgcagagcagtgtcttgagagagaaagggttctcctctctgtaggagaagcaagctccattcctggtgctcctctgtatgatgggcatggctacctatgcctgccctccagaggggaagaagcctttgtgtttaggaccccgggatgatgttgacagctatgatcacataataataattgtatgataatgattgcagataacatctgttgcgtatctaccatgtgtcagatctagttaagcacttcacaaatcaactcatttaatcctcgcaagtatatagtccatgaaggtcatattattacccttattttacagacgtgaaaaccatgatagagattcagtaatttgctccaagtgacacagtgaatgacagagctggaatctaacccaggcaaattggctccaaagcccatactttcagcctttacagtttagcaaggctgcaccagaccccaacaaaaactagttcttttgtataacaagagaaagattccctggctgaattctagcagactagattcctcagtgccattacgggctgaggacttacaaacatgaggaaaagataatggctagtttggttttctaggtctgccttagcaaattaccacaaacttggtggcttaaactagagcgacttctctcaacagttctggagccagaagttcaaagtcaagcatcagcagggccacatccctctgaaggatctgggggaggatccccttcttgacttttccagattctgggggctcacggcagcccttggcttatggcagcaaaactcccaactctgcctgtctccacaaggatttcattgtgtgttcaagtgtcctttctgtctcatgtcaggaaagtctcattggatttaggacccacgctaatttagtgtgatctcaagtgatccttagcttaattacatctgcaaatacccagtttccaaattaggtcacactctgaggttctgggtggacatgaatttgggaatggggaatgatattcaacctgctacaatggccaagaaacatctacctagttcaaaagagaacaggatctactggaaagcttctcagctcttggagccccacaactgtgtctcctgggtcctagccttcagcctggctctcagcacagctctttgcggataacatggctctacactgcgtcgaacagatttggtggcagtgactcacctagcagagttctcagcagcccacctggaaggtcccatcacattgttgttattgcagatagcactttcactgttactcaattttttttctagtatcttgtgaacaatgtgtttcaaagtataggacgacttggtggttaatgtcacaaaagcaatcattggagttgtcaatcacagaatgacattacataaaagaattaggactcttcttgctcaagatgctttatacatgagcataaattgagagttatgtatatttggatagtagaaaagctatacattaatgtgcatcttaatgaggatgattttcttcttttgataaccaatgtgtctatgaagccatctagctaggtactggtgagaaaaatgtttcaaataaagtatttttattggagcatataaaagagttacaaaaatatttctgtaaaattttctggtctatttttttcaggttggtactttttaatggtttagctgttaaataagcttcatctattaacttgtattcagaaataagcttaattattcatcaattcatgctcaccttatattttatggttttccaaatggatgatatcttctatgtctgtacattttttattaaacataagtcattttatgcccataaagcttattcctgaaaaaattattttgctactaaaaaagatcattaagttcacaaattttctctccatggcttgatgctgctatctttctgcaccataattagttgcatgtatagttaattattatgagaaaagcagaacatctcccaatttctacaagatacttagagtttgatggtttaactatgttttctccttcatttctcccatccaccctccagccacgtgtattttcatggtaggaagatgataagcatacgctttttcaaaatgacagcaaaatgttcatcaggaacttcataaagctttgatagactgaatatatatttagaaccagcatttcaatggctctttaccttttcttaagaatttccttatctatgaccctcattgctagaaaaaaaatgcgcacttttatataaacacaacatttttcatataattttaaagagatttgaaaccctctgaaggctatatgtagtccccatgccaagaatgccagatttgggaaccaacatttcttatccatttataatgctaattaattatttctcttaaaaaatactctagttagcctgtaaaattcatttagatgacacatttaattttgcccaaaaccttgatttttttggaggaaaaaataatgtaagaaaatacattattttaggttaggatctttaaattctcacagtcaaccaccatggtttctttgtacgacctaagctcattcactggtgggcaagtgttttggggaccaggagtggatctgattcatctctgtatctgccacagagcctagcatgatggtttagacatggagggagctcaagtaatactgttaccggtacacttgttatttaattttaaaaattaggaatggctactgtgtaagtacataaacatttaagttcataaatttgtttacagttgaacacaaaaaggccatttgtgttcagatatgtgacctggggaagaaagatgaaatgggtattttgatcagcacggggagcagtcagtgggcctacagagaaggcgattagaaaagccttgtgctgacagtgcaggttctatgatatggaaagaactagtgaggaagatgcacatgcttagtagctcctaggaagagttctcaaggagcatcaacctctatgtgtccttcccaaggaagcagtgggccctagattggaggaattcaggataaaacacacagtcctgctaaccatttcttatcccagtcacctgaagggatgagatcagaattactagggaaagactttgcagtgggatagatatgcttccaaggtacttctcccagcccctaatacttcctgtttgctaatgcttaaaatctctctaacctaaaatctccctaacctaacctttcattttaacattagaggaaaaaaaatttgctaaatattgactgaaatttattcaccctaaatttaatcacaaaagtacaagagcaagcatacttcctctctgattccgtgaatgagaagtattgaggagccaaggttggagaaggggttaccattgagaatcggagagggcaccagaggtcaagactggggaaaaagacaaattgaaaagacattctatctttccctaggattgttccaattatcaatcctattagataagcatatgtagaaacctggtataaaagaaattattttgtatggctaaccactctccttcaaaaaacttcacaatttgttaagtttagataaagatttatcctcttgtttgattagtttccttagaaataaatttcattcttaggggtttcactaattaagataaatagacaattagcctcttggcagcagaagctacttcttatttatctctgtattcccaatgcctaggccagtgcctagcataaatattgtgcttaatcaggattataatatgtatatttcttgaatgaagataacaaaaatatctattacaactctaagtgatttattaattgatttgagaaaggatttatgttaacttacaaaagttcattcaataagaggttacatcaaatatttaaatcattgcaagaggaaattagaagtaaagccaatgaaatgaagttatatagctaataaatcaatttttcttagttgtaataagtatacaaaatctttctgcatgtaatgtgtatgctatcagcttaatataggcatgttttaaaccatgataaagaaaatattccaatatctcaaattctttcagaattatgccaaccctagaacacagtttctagtatgtgattaagccttctattttttaaaaaagtatttctcaattgactgctttacataaatcatataggtgtaaatttgaattattactacataaatttttcttagatttatgacagaattaaaatagccttttaagtcttaaaaatattaataagaaaagctcaattatgtgaacacagctaataatacattcattctggcaggcattgtgcaaagttttcaatgaatatgaatatctttatgaaatatgagaagctttgttcatttacatacaagttccttagtctcctacattaattattttttctcattttttcatgtggaaccttttccagtaagttctcataagacaacaaatgacccagtggagtacctatttaaaacattataaacaaagaaagcttctttcttcagccctgttctttaatatgtaatgaaaatgcttcatctttcattacagaaatgttttatgttctaacctcttaacctcattattatagtttggttagatttttaaatagaactcgagtttttctcagtgtttcagacaggaagaaaggtggagtacctgacaacctgttccaggaaagaatgttcaataatcaagcatctatctcctcttcctgagttaatccagttagcttatgaggcaagcatgggggagttgcaaagtaaatcaaggtgctgaattctactctcatcctgatcctaaatggattgagttttgttctttcttatgtactatccccatattcacagttacagactttgcaggtcacttgctgtctttgtcatattgggatgctctaacataccatagactgggtggcttataaacaactgaaatttgtatctcccaggtctggagaccagaagcctgagcccaggctggcaacaaggtcaggctctggtgagggcactcgtctcggtagcagtctgccaacttctccttatatcctcccaagtgggaagaaccagagagctcgttagggcccctttttataagggcattaatcccactcatgagggctccatcctaaagacctaataatccccaaaggccccccttctcatgccattacattggtgattagggttttagcataggaatttgtgggggacacagacattcagttcatagcagtggaagataaggggtgctgtgcagacatcatgggctctatgtgtcacataatgtagcatctcatacagggtaaacaatcgccactgttatctcttcccaaagccctgctgtggggtctgctcaccggccctgcatccagtcaaggaaggggaggtggagaagggcacttgaatgctgagtggcaccaagaggaatgtgcagatgtcataaactggaaaattggggctaaaggtgaaacagcatcatacaaatgtcttccctccaaaagctcaatcttattttagaaatatatgatccatgaggactttatcataaattggcccaaaacagccagtcagctactgagggtcctcattttccaatgagtgcatgttttgctgcttcagtggtccagcacgatttggaagtattattgctttgttactgaagagacctttgttttgattcagttgccaatattctctaagatggtttaatgtgagccatggtacttaggtgtaatcctgtaaggtttcttttcctgggattcacagtccctgctttcaatagagtctcacgagggtctatgacccttccagacagcactgatttcaagtctgtatcactttataaaatcctacacatagtcgtgatcttagaaaaaaaatggacacaatatagaacacaaaaagatgaacccattactaacaaatctccatatatccattgtatctaagtcatactctatgagcccaaaggctaataaaaaaacaggatcagacccaggtacaggggcaacagtgccaacttctgaaagcagggatattggtgtagcgaaatagagaatatgaaagaaaaaacaatactctgtgagaaatagcctagtagcctatactttatgccaataagctttataggaagttctttttttttttttttttttttgaaacagagtcttgctctgttgccctggatggagtacagtggtacaatctctgctcactgcaacctctgcctcccaggttcaagtgattctcctgcctcagcctcctgagtagttgggattacaagcatgcgccaccacgcctggctatttttgtatttttagtggagacaggatttcaccatgttggccaggctggtctcaaactcctgacctcaagtgatctgcctgcctcggccttccaaagtgctgggattacaggcataagccaccgtgcccggccataatagtaacttttatatcccagacaaaaaaaaaaaaaaaactgagttaggcttacagacttgactctgaggggctcatgataataattttcttttttttttctttagttcgtttgttttagcatgtgctcagaggaaaaagaaaaagaatttatggaagaaatctctaaatcatattccgttctttcatgaaagtgggcaattcaaataatttcactcaattttcaagtgagatattcacagtaatttgtatcttcaggttgaggctaagcttcattgcacttcatgggaatatatagaacattctagcaaatctttcttagactattacatctttgacttacatgtttatgaagaatcatctgtgcctctgattggccttatataaatacaagggtcatttcagagagcagttcttaactgacttggaaaagcctaagagccaaacaattcagcagctcttccacattgatggcaccagccacatgcagtacatgtgctttacgcatttcattattgcatctctttgtcttatgagtttattgatggaaaattgtgccttgtcttttatcaagtaaacatatttcagaagacatctacatgctatcaacaaaacagagcaaattcagaaaatgtaggacttcgttgtacttgggggattacttcaattgccttaatagtctaccagagtagaaatattacattctttaaagttcagataaataatttgtgctgcttatgtaggaagtaagctattctccactgtaagcagtcttttatgttgacaatatagaaataatctgtcttataagctacactgcatctaaagccctgacactacagatttatgcatacttctggctgaaaataatattgaaatgtgaaaatgaaatctttcaccaaatctctgggaacataggtttgaggctggctttggaatcactaaaaattcattgattcccaaacgtagactaagtaccataagaactgactagggtacttgattgagcttgtgctgtatggtttattacactggtggtaggaatgtgtcaatagtgattatactgctctaagtattttgttttagggtatgattctagcttcccttgtatcattactcaaaactccaaatgaagtgtgtaagagtatttttcaaccctggatttacttgcattccatactcattaaatatatgacacaataaaatgtctaggtcttatgcaaggaacttcaactcttctatggctcctggcctaaaaaggtatctgtgagaggcagaataatgtccgccaccaaagatgtccacatcctaatcttcagaacctgtgaatatgcgaccttacatggcaaaggggatttagcacttatgactaaattaaggatctataaatgcggagattttcctgcaattcgctgggtaggtagaatctaatcacatggatccttaaaaatagtaggaggaggccgggcacagtggctcatgcctgtagtctcagcactttgggaggccgaggtgggtagatcacgaggtcaggagttcaagaccagcctggccaaaatgatgaaaccctatgtctactaaaaatacaaaaaaaaaaaaaaattagctgggcatggtggcggttgcctgtaatcccagctactcgggaagctgaggcaggagaattgcttgaacctgggaggcagaggttgcagtgagtggagatcacgccactacactccagcctgggtgacagagcaagactccatctcaaacaaacaaacaaacaagcaaaaaacatttgaagcattgagattaaagtgttttctttgattaaaaatctgtcaagagtaattagaacctgcttcctttcctcttctcattgtacagcttacaatatggatcaagaaattgtttctattgacatacttctttccatgtttagatcggcttccaagatcttatcctttccactttcaatgtcatgaaaaatcattgagagttcctttaatgcgaaatgttatgccagtgtcacttcctgtgagacagcttcatcctttttggggtcacaaccaccttccttatttgtgtagttcaattcatttaacctgagttcctctggctacaaatctggagtctctgaaacaatgacacattcagctattgcttctataactccatttacattcatttcacatttcactttcagcatcatcactctctgtttcttgatgcacttttatcttagttagccaattctcccttctcgtgtccagttttgtaaagtgttatatgggcttatcactgggaaacaaggaggcaacataaccacatgctttgctgtgtgtggaaagaataacattatgtggagtaacaaacccttaatagattttgaaagaagtgacatggttggtcactgatcatgatgcacatctgttatttctgtatagatacttctgaatgcacaatgaggttatgtcccaataaatccatagaaaacacatagttgaaaatatatcaaaagttgaaaattcgtttaatacacctaacctaccaaacatgatagcttaacctagcctaccttaaacatgctaagaacacttacagtagcctagagttggaccaaatcacctaacacaaagcctattttgtaataaaatattgaatatctcatgtgatttatagaatactgcactgaaagtgaaaaacaaaatggttgtacaggtactcaaagtacagcgtctactgaatgcatatggcttttgcaccttcctaaagtacaacaattttaaggcaaactgtcataagtcagggttcatctgtagtgtttttggacaggagagctagtaacaaaacttgaacactatacatatgcataattaaatttgtatattatgcaattactcaaacttagtatagcacagtaactaaaatttgaaccatgttgggagactggtatatttacctatactatagtaactgaaatttatgcatattaaagtgtgtgcaaagcaaggactgcctctttgtgtgtgtatgtgtatgtgtgtgctctgtatgttttgcatattttcaaactttaaataaatgccatcatataatatttatccttttatgaacttgctatttacattcaaacaatgtttctgattattcttattaatgtatgcagtcaccgtttatttctttttctgttttatgatattccattcacatgactatactacacttcaagttatttatgtattctttattgaaaatatatattgctttcagttttttatttttgcaaatatgactcctctgagaattaatttattgcttccatgtagtcatgtgcaagaatttctctaaggtaactatatctaggtgtggagttattcagttttaaaccttattagatatttccaaattgttttcccaatttacactttcaagtaagttttaattttattttgactcaacttgctccataacagttagtattggcaaattccattttaccaatctgatcacataaatgaatgaggctaaactaatttaatttgggttttcttgattaagggtgagactgagcatattttcaagtttcctcaaatatgagttatctgtatcttttgataattatattaatatatattatttacataaaccaaatattaatgtttataatttgtatatactgcagctgtcatctcctaatctttgtcttgtctttttatttgaattatgatatattttgatgtgcagaagttttaatttgaatatagtagaattcatccattttcctttttggtttatgttttgtgtcttatgtcataaaaatattatcttttgtgcttcatgccttttttcttttatgatgtcttttttcttttaaaagttttaaccgttttctatgtttgggtcattaaaatacatggaactcaatttttttaatggtataatctaagggttcagtttcttatttttgacacatatacaaccaaattttccatcatcaaacatgggaaaaattctttctccactgaactgtaaagccacctctgtcatacatcaaggtttttttttttttattagactttattttttagagtcaatttaggttcacagcaaaactgaatagaaagtacagagatttcacattcaccctctgcccccacatatgcacagtctcccctactgtcaacatccatcaagtttttatacatgcaagggtctcttttgggctctatatttttttcctttgttcacattgtcaatgctgcacaaatttcatactgtgctagtgatacatcttcataatagaacttggtttctgatagagtttagtctacagtgttgatttttaataaagttcttaaaatttctaactaaaattcatgcaaattttgctactgcaaatagtatcttttaataaattactttttctaatgattgctgatagatagaaatgtaattttttgataatgtgagacagaattcacattacatataattcatccatttacaatgtaaaagtcaatagcttctgttttttgaaattatatgtatatatataatcatatagtgtgaattctttgtgtctgacctctttcagtcaacgttatgtttctgatattcaagtttttgtgtgtagttatgtccatttatttttatcactgtagagtatcccatcatataaatatatcagtatttgtgtatcctgttttcagtttgggctattgctgattatacatcattattctagaatttccttttggtacattttaaacctgcccactctctagagagtattttattattttctcacggttttcatttcttttggtctgtcttacaagtgtcttaagtatatttgttttgtatcttttttataattattacattaccttgagggtttagagggtttttctggcactttttcacagtggcttatttcctcatctgttttggtatttttgttatctttctgcttatcccttgcaccttgcaatgtgtgagactcattttgtcttaggttgatgttgctctgtctcaacaggatttggatttgcttatacacgtgctttgatacataatctaggttgggtttatgttcatttattggcttggcttttcttggactctcaagtagtgtatactcaaactgtagacctctgtgagggcaggcctgtggttatgaactctcaggagaatagctcttccttattcagtattctggccaagacagatgacagacatttcctatggccagtagtcagctgtgtttcctagaacatcctatcattgaagatgtagccttcaggggcctcagccctgtgcatcctctagattcccaccacaggggagcccagggcactttcctgtccctggaatgctgtgcaattcaatcctctcgctttccaagataaaggaatgtccccagttaagggccagctcaccactctgatgttcttccccatttttttggtttttgcctttttgtttatttctttgtttaagaggggatgttgctttgttgcccaggctggcctcaaactcctggcctcaagtgatcttcccccctcagtctcccaaagtgtcgggattacactggcatgagccatcatacccaacccttccccttctttttctaccattgggatttatcttgctctttcgagtccccagctataccttaaaaaagacacttgttaatttttatgcagcatttgtgggaattattttagagattttcagaacccctagtctgtcataataccaggatagaaagtagaatggtgctggccagggcctggggagatggagaaatggaacattgctgtccaaccactgtgaaatttcagttatgcaacaggcataagttctagggatctgctgatccaccttgtgcctgtaggtaacaatactgtatggtgctcttcaaaatttgttaagagggtagatctcatgttaagtgtttttaccacaataaaaaaattgttttttaagagttgaagactattttctgaataaaaacaaaatgaaacctcataagtaaattcagagttgcctagtaaaatgtgtcacacgcataataaaagtgtaaaacattcacactcctcactctcatttaattatcaagaattaattaagcttttatttttcttccataaattccaagttcccgatagctaacttccaaagctaaaagtaatgttacttttgactcttttgctacaacaaataatactacactaataccctggcatgtattgtgtggctatgtagagtatatctgtaggaaatgttggtggaggtggagctgctggttaagggtgagagaaattttaattttctagctttcaaattataccattcagcctcccttttgtaaactgttagtttaaatttgcttttctgtaattgtacgtgagtgacaattattaaccccagttaaatgaacaaggagttgatcatctgggggtgttcacagtgctgaaattatgaggaaaagatgtggttcaggagaagcttattaaatgtactttcctttttctccacccccacaccaacatgctgacaatagaaactcattctcaaactgaccttattcaaggtaagaaggtattgttccagtgtgttggtttcaaggactttcttccatgcagaataaatagtagaactaaaatatcactaaacctctaagtaagcagattatgtgctgtcaacggtgaatgcccaatatatccacagcgcaagaacttaagtagacagaggtattaactgtcattttatttgaaggaagccaaaaaatcttgtgctcacatcatattccttaaaacctcattcttccagaatggctaccacagtcccaggcatcacctggagacagagacataatacccagcagaagaaaagagtttattattttatgatctctctgtttgaagaagaaaaaatacaacactttcttaaaaatttctaagtggacttcctcttgtgtattattggccaaaattgaattactgaatcatatgccaaccccaggaaaatcaattattggtgtgaggaatagaattcccctgatcaccttagcctaatcaatttgtatccatgacttacacaccctgcaacaaaggaaaatgtaggacttgctattgattacgtacacaagtgtgcctgatgtggacagcaaataagtttgatggtattgtttgtcataaagttaagtaacagcatgagtaatatggccctctgtggaatttcttggtggcagttgagcaaaatttaaattgctctgaaatggaggactgtgatcacggaaacaaggtagagttagctgatataatttggtacaaggaaattaaccatggttgggtttttgagccatagatatgataatactcagaaatatatgtaataatgcagcattcccaaatgattccaatgttgagttctccacacaaatcatttcattttctttcagttggtgttaaagatattggagtcctcatttggaagtcactcactatagcatttatgggaaaccgagctctgaattacaaacatcgagttgacaaacgaaaatctggaacagaacccactcaccagctggcgaccacccagtattatttgactttaaacttgatacttgaacatgattttttaaaagaaacttaagcaagtaaacataaaaaaaaaaaaaaaaaccacctctctttgacttggtcttgcaatgggctttttaccgctttgaaatggaatacagttttatttccaataaacagcagccgtaacaaaacttcacacagacacctggagaaggggcatttgatgaatgcaatactatcattgtttattatagaattatttactagaatctggcagagatcctaaacaccatttaccataactttggccaattttcctaaatccatacttcaaactctactgatataatgggctgctttagccaagaatgatagctctgttactccccaaatattaccaaaacaaaggcgtggtcacttcccacaaatccacctggagtatgagtcaccagctgccccttgttgatataaagagctcgaagaatgaacagttttgaaatccattagtgaatcactgagaatccactcagtacagcttggagatctcaacagaagccaataataattaaagaaagaaaagctctgggttaaaggaaagcaagcaatccagcggaaccaactagaaaacatcagccaactgcagcgccttgctggaattagggcagaccacagtctagtgcctgctagagcaattgaaggaagcccagctgagagagaaggcttcagtaaagaaaattagggaaggttttatttttatgtgaagttcttgtgagaaggatgttaagagaaagcattatctgttattatttatgattgttgagccccacaagcaagcctttgagtttttataagcccacatagcatgtttttttgtttttgtttttcctgagggtaaacacttttatttgtaacagcattgtccatggctgtcaatgtatctgatggaaaatacctgtccataagcatgaaggaaatccatgatcttcccctttaatttgcagaacattacatagtatttttttaaaaaagatgcaaatagcagcctacttctttgctgctaaagagctttaatggaatttttagtgaatcagatgtgtaagggctgatgtcctccaagctgagctggatctccccagttcttcctaaggttccttttgtgtcacattcaactcaacagacaggaagcaactctcctgcagtgaaggccgcacagtgggctctgctcctaaatccaaggacacagaggagcgcctgtgtccccaaatcaggaaggcgggcatcggcgagacccagtgtcacagagaacgagcatttttgctgctactgttctgtgcaagtgatcacagcccagatgtacagtatgatttggaacctccacactatttagcatcccttaatttgtatccagtgtgctaactgacctggaaacattagaaccccatttccaagtttctcttaaaaatccccaggtcccaacacacaccaaccactttcatcctcaacagggcatgttacgccagagacagatccttctgcatgcattttgccttaatgccagtaagaaaattgattttttgtttcaggatttttcaatccagaagacaaagagattagtcagcagcttttaaaatgaaagtttccaggtgagagatttcaacactattttgtagatctggtgaattaagatacatattttcagtattttaggaattcaaattctaatcctttccaattcaccaactccctttatccaaatccatggaatcagagtctaatgaaaggggtacttagcatttgattccaagctttcccttacaactacatttacaagaaagtattttgaagctgagaaaactgacaggtcctgtggttgatctgcacagttctatttcctttgggctccaaatgttaaagcacatgccctggcaattcgggcaccagttttgaatgaagacacccagcatcttgcacctgcctgccaatctccacgtcctttgtagaggaccggggtggacatgcccatcccctcctggggaagtctgtttacactgcaaactcctgacttctgcatggcggtagagctgattgtgatacctctgtccacctatgccagcccaggtgcctgacttgtgttgggttaactattctgatagctttgatatggccttcccacatgtgccttctcctactgtggccgctgtcactctgtctccactcccatgacacttggatgctccagtgacaccagctcctgcacagtaccactcttcagcagcgttcatatcaaactgtgcatgtctagcttatctgggggaagacactgaagagaggcagaggtggagacgtgaaagaagacagcaaaatcacagagcttcgcaagagaaactgcttgcttaaagataatttcttcttctgattacaaaagttacacatgctcattgtcaaaatgctggaaaatacagagaagtttaaagaaggaagaagttaccataatcatactacccagctaacatttcggtgtattggtagtagggaaatttctggttgtcaaggaggaaggtatatatccctaatcacagaggttttttcatgctcttaggtcctaagttatagcattttaatgggagatttctaagacggaaggtatttctggaatagcattccttccctttcttctgcagatctgtcaaattgttcagctttcttgactaatagatgctatggatagagcatccctctctctctaaaaatctcaaaaaaagcaagtcttatttattcaggatttgaagagaaatattcaggaaggatatttcatcaaacctgattcatatattatgcactgtaatgatgctagacacaaaacacaagatttcttgatagatggtcagaataaattacaccaactgcattagctcagcagcagtcctgcccggatctcagcacctgagcttctcatctgcgtatggttgctcagcttggtcactgagacatgcaaaagggaaatgggcattttccctgaacacctaaatcctttccaaaatctgtcaaaatgtttactaaaatgtagcttctttgtttatcagacgaactgtggtaacagcagttatgaaacttatcacagttcatctgataaactacattttagtaaacatttcaaagtgaagcagatatgagagagaacaaaattatttgtgtttacatgagacttggaattgttaaaatttttatatctagcatacaaaaaggctgcttatgttaaaaattgatagtaactaaatatataagaccaaaagaatactaataatgtgaattaaaatgaaatcttagcttggtttataaactatgaaatttgactaaaatctattctgtatatatgttctagttttagaatataaactagaactagaatctaagtagtagccaattggtaagtagtgtctgactgggatctaaaccagttcagattaaaccattgcaacactactcagaaaagcgtatggtcaagatcttccgctatggagattaacaagaaatgcccatctatgtaacagtaatttaaaaactgatagtggtatattacattccagtgaatgacgtaaataatagcctttttaaccctcttgcgaatatacatggtatttgagaaaaacgttgcttcagaacaggtgaaagaatatgcctggccaaaataagttcggctacccaaaatggtaatggcttaagccttttggtttttatctttgttaaaggcagcgagtgacattttaatcttcttgtgcaggtttttctaaaacacaaaacgctttctgttaaaactcgccacaaaggcagaaagggaaaagcattcacagatgcacacagattccaagaactctctcacactatctcaggaactcttactgctccctagaaactgtttttcatcagaatggggaaaataacacgactggtacctgcaatttctgacaccaatttcacatctaacctctgtaggtatttaacggactcagggcctaactgaaactgctgctaactattgatttgttgaggtgttcatcccaggtggtttatggggactctgtaaatatgggctgataatagtaatggtcaagctcccataatttcttaatttcagtttatttatttataatatttatggttgtaagatcgaatctggtgattatctgtgctgggggcagaaatttcatttctaaaggatggcggtaaatataagcatgttgttggttgaatgttcaaaaacatatttcaaaaaccaagtactaacagctaaggggaaaaactcacacaatgaaccagaagtgtatgaaacaaggaataaaatggaaaaggagaaggcatgaatgttggagggatttaagttatggatgaaactacagtgaacattcagggtatgttgggagatgaaaactgaagcatccttttactcggtagcaaaagtgaccgggatcaagggtcactcccggatacaggtatcccggagcacctccacaatggcttccagcccagacctttgtcgtgggaaggagtcccatgctctcatttttggcacaaacagagtttgactctcaccacaaaacagcatcaaacaatgtcacaggctgtgcttctcacaaggttttttgtttgttaagttcattttcctgaactcaaacattgtgggaagaagtaggtcataatatccatttccctctaaattgatccagagcttccagaaatctgaagaccagtgaagccaaggtttcttccaaacatagagttgtgtgaaatcactatgtaaaactgtcagcattattttggtggcaagttctgtccccatcttggctctcctccctgcctctcccacagcctggtacagtcagctatagagttcagccctgaatacctgctggatttacacctagcaatgcatctgttgatctcactgatgtgaaaatcattttacaaagaattcccactgcattttctttagcatggcattcacattcccccatagtgtggtcccaaatcactcctggtcttcatcttctaggttcctcagaggggacctcctagcatcagtctgggaattctctgtctcctatgggatccaggacctggaccacccagtgtccttccaacaggcctgaaaccttcctatgtgcaggtgtggaatgctgctttcgcttcttgcctcccaatatcttattgattcttcagttccttgttgtaatctccctcattcagagttgttttgtgtttgtgttttgttttgttttgttttttgagacagagtctagctctgtcacccaggctgtagtgcagttgtgatatcttggctcaatgcaaccaccccccaggtccaagagattcttgtgcctcgggctcctgagtagctggacttacaggtgcatgccaccatacctggctattttttatatttttagtagagacagtgtttcactatgttgcccatgctggtctcgaactcctggcctcaagtgatccgcctgccttgccctcccaaagtgctggggttacaggtgtgagccatcgtgcccattctcagggtattctttttttggggggaggggtgtgaggggagggtgaggagaatggagtttcactcttgtcactcaggctggagtgtaatggcgtgatctcagctcactgcaacctccacctcctggatgaacgattctcctccctcagcctcccaagtagctgggattacaggtgcctgccaccacgcccagctaatttctgtatttttagtagagacagggtttcaccatgttggtcagtctgtttttgaactcctgacctcaggagtggtccatcagccttggccttccaaagtgctgggattacagacatgagccaccacacctggccagagtattatttaattctctgagtaaccagaagccaaaggatattgcttcacctttagttgccatgtaattgaggcatacctcatcatcagcagtacacttggttttctatactggattacacaccttttggaggcaggggctacttttattcttctttaaatcttcacctgcactagcatgctaaaacaaggaaaagaaagttttatcttctatactggaaacaaagaaaaacaagggtaattcatcttacttttatcactagtctccgattaactacatgttcaagtttactgtatagtatatctatgtgatctaggcaggcatatttcccctcaaatatataatatggcaaaataaagtgcaagttgtgattggtgaagataaatgactgaacttttactatcatattctcactctgctgataaatcatctttgagaattcgtattaattttggtcaagaaatacacaagttaaatccattttattcttttttttaacattgggaggactaagtgaataaagaaggagtgaattatatgattgtctaccccacagtttcagtaaaacgatattttttcctgcaatatatttatgatctgccttaaaaccatagaatctggcttaagccaaagcaactgtatcttcctttattttttaacaataaacacctttaattatcttccttccgactactttgttgtaacacacaatgtgtttgtctcctgaggtgagcataaaaaaggagcccagcatgacttgaatgctaccgtaattaaagaaaagctaaaaaggtcaaaaacaagaatgtggtaaatcttaagcaactccccagaacaggcgccacctgccactttgtgctgacaccgtcaatcattgaatcggttactgaatactttcttgcatttcttcttctccaccttgtgcccacgttaagcaggaagacatcatattttcattagcacctgttttgttttttcaccttctgtagactgttgagtgaatttctaataataaagccaaaaggaaaaataatggcaatatgattggacaagcagtttcagaatcaaggtaggatgcctttttgttggtggaggttttttgtttttgttttgtttttggacttattctccctcatatcaaataaatttattaaacacacctgaacacttgttatgtgccactgtcggccacgtattagggacacggaagaacaataagacatactccctaccaaaagaggcttatggtttagaaggaagacacagtcttgtaaacaggtaagtaaaataaaatgtgagctgcactatgctggaagtcagcccagggtggcccaagtagaccatagccagtctacataaatagggagacacgggggacagctttctagatgtccctaacgctgaatcctaaaagatgagaagcatttctagggtgccagagtggagaaaacacctgacttgtgggagaacggaaggcctcgtgttcattcaatggatcaactatcattgggcatctccacctgcgagagacggcgctagcccctggggatccagtccccggtgagctggaaagctactctgtgctctcagaggacttggaacagagaatgcagacagggtggcaggaatgcaggaatgtgctcacagtgcaggaacccggtggctcgcagagaagggcaccaaacttagacctgggagatcaggaccctctcccccaaaacctggaggattgctccaaagctgtaccgagtcagtggcggaggccgggtgagcgtggggaagggcatcagacacggtatacctgctccacctttcccttttgttttgttgtcacaagaggcactacttcgctgcctccgtctcctctgtgggtggaaaggatggacccaaaggaacagaaggctgtggccactcgacgatggttttgatagggacttatcttgctctctctccctggacactctctttctaggcctgcagcctctctcctcccttcccatttccaaagcctctgccccaacctgatccaagtattatatgtaaacctgtcattagggttctttaaatcaaggctttttgatgacaaaaagagggtttaaaaaaaaaaatgtggctcacgcctgtaatcctagcactatgggaggctaggcaggcagattgcctgagctcaggagttcgagaccagcccgggaaacgcggtgaaactccgtctctactaaaaacacgaaaaattagccgagcgtggcggcaggcacctgtagtcccagctactcaggaggctgaggcaggagaattgcttgaacccgggaggcggaagttgcagtgagccgagatcgtgccactgccctccagcctgggtagcagagggagactccgtctcaaaaaaaaaaaaaaaagaaaagaaaagaaaaagaatctgtaagaatatccagtgtggcttctgcctctggaataagtaatagtcttagtgaccatggctatgggagtacccgggttccatcagtgtgccctgtgtggttttggtctgggctgcattggcgtggcctgtttttttgtttttgtttttgtttttcccttattactgttcgtggagtgttttagtttgcttttttgtttgtttggttggtttttttttggactctgcgaatggatgtctaatgctctcgtctccctggcaggacctccttcctgtgtctgcagtttctcttgtagccacaccgtctgcccgatcatcagtgctaggaaaataacgatgagaacagacctttcgaagcccgattatcagaaagagtgtcttcatgcttgaaatctgaatataaaacagacgcccctgaagtgcatccctgtgacactgcctgtacagcaccgttaaatatctcatcggcagtaatagcttaagactactgtgctcagtcacttctttgggtgtcactcatagcaatccccatccctgccatcatcattatcacacagcactgccataatgacaattataaagatgttagaaagctgagacaagtcattctgaattaaaccgcagctcccataggtcctctgaaattacccgtttccaatatctccattgtttccctacccaaaagcaaaaaggggagacaaatgtctcttgagcgatgcacaaaatacattataagcctgggaataatcaaagctaactgtgttcagtagagagagatgcactgtgactaagtttcactgaattttaatggcataatttttagcccagaaagcaagctcatgtgtgccggagtgattaatgatacagtttatgcagctcattggtcatacttaaattagtttaaatattcatctgttgttttgttataatgaatctccatgtttctttttatttctgttcccctgagtgtttcctcttgtctggttggaggatgtttgcctgaattgggaaagaaatgccaatagccctgtaggtgacaatgcacccaggctgctgaagatcaggggagatgaggcaataaacgcttcatttcacactgtgaaatgcacacacagctgcaccagcttcttgagtgagatgtcttggtggattctgtgaggtgccaggtcagagattaaacttactgatttgtggcacatgaagccattggatgaagttggatgctgtttgctgtccctgggacttcctttaaagtccacacatcaatttttataccaactccctgaaagtcctccttttatgagcattcataatttacattttgagttggaaagtcctgtaactctaccttctgggattttatgaattttcctcccaaatacaaaactctctagatgctgaaattgcatttgtggtgaagaagggaaaggccataagagtaacttaataagacttcatgttacagaactgaaagatctttcaaattcacataaaaggaggcctgcacttgacactgtcctgactatataacaacatctagaagtagacagtgttgcctttttatgctatatccttgggagtacaatttacaaatagtctactacacacttcttgcacttgtgaatcacccatatagatcaacctttaaagtgtaaaaaaaaaaaaaaaaaaaaaactttataacatcctgagaattaatccttggagagctggctagatacagaatgaaaaattccagacaccacaagtagttagagctcagcttcctggataaatcagttaatttggaaattgtggcctccatacccgctaggcatgtttgttcatccattgttctcctccctatctcctagccacagtgaaagaaaacgaagtgtggtgtacacacacttctagctatgaaagcagctgcatgatactggaaacacagtgtctccaaatgtttcagccttgggggcttccctcattattactatctgaataaagtgcttcagtccgctatgatactttactctaggaaacccagctttgttcctcacattatcaatgacttccaggagtgttcaggaaggacccaacttttacactcactattcaacatgttattaccatgctgctaatgtttagctttcttctacattatttgacccccaaaacagacactataacccaactaatataattctgttatagcatgttacaagtttttagcaaaggtgagaatcatcaaattgcatacgggatgttattattcttcatatccatcaaagtacaggaagtccttcacaggcagccatctttttctctgggccacaccagagaagccccctgccttctcctttctttgagtttcaaggactgaacttcatgtctcacaagcagtcagaggtggaagcaaatgaaattgcctttgcaaaaattctaacagtgagaggaatctcacctgactccatcttgcttctaacctcacaagctagctgactttgttagctttaaaacaaaaatgatacatcccttcctgaaactaacccctccttgcttagggactgaaaccatgtttgtaagtctaatgaaaggacataagattaggattatgggaggggcctgaattctgctaagatatatgcatagttaaacaataaccagctattgttccagaggtacaagatttgtaacttctccaactgctcctttagataatatccatatggtcaaaacctaagattgggctttgaggtattttccagacttttgcatttggtttgaccagctgatgccacctgaacccaagactcataccagggaactggctcaaccagtcctgtgaccttcatccagatactgactcagtgcacaaagaccattttggacattcctatgatttaatccccagtcaatctgcagcacccattccccatccccctacccaccaaattaccttgaaaaacactagcctccaagttttactatctctcatccttctcttggctggccctgcaataattaagttctttctttgctgcaatacctgctatactcaatgcattgacttttctgagcagcaggcaagattaacccatcaggctgctatacaaatacttcctgttaccttagtactcaaaacaatctatggtccctcttctcaacctttctttcttgattatttaatctctgttaccattcttacacttacttacttgcaataacataatacttactctttctgtaataacttgcaggttataattggatcatgagtgacctctccccaaattcatttatctcatcttaagcctaatgaatgaaaaaattatccataatgagagaaaacagcaggatccttttcataaagagatgtttgaaaacaagtatttttggaaataatatattaagatgcatatgtggctatatgaccgattctaatgtgtttaggccttgctaatatatcggtatgggacaatctccttcttaaaattgtcacactgtattgtttgcttcagtccaggatagcaggactttttgacctgaaaggaaaaggtaaggcaagggcagaggttggacccttgtcccttaggacaaagcaggcagatttacatcactgccttccaggaaatgacagcttacccccaaaagtaaagaaaaagtgtactttaaaaaatactagccaggtgtggcggctcacacctgtaatcccagcactttgggaggccgaggcaggcagattgcttgagctcaggtgttcaagaccagcctgagtaatatagtgaggcctcgtctctacaaaaaaaaaattttttttaaattagtgtgatggtgcaggcctatagtcacagctactcaggaggctgaggtggaagggtcacttgagtccagggggtcaaggctgcggtgagccatgattgtgccactgcctttcagcctgggtgacagaacaagaccccgtctcaaaaatatatatatgttttatacttctcactatagaaaagccatttaaagcattctgtgtagggggaataaagtgagacacaacctgagtattataatgagcactgaatttgtagtaaaaagagtaagtcagattcttgatttgcctcctgcaggctttgcactttgaaaaaattatttacattctctgggctttggatctcttgtttttaaaattcagagtttgaaccagatacccgcccacctcatacagcttgaaaactctacaagactcaagtttaaaacttctgcattccaataaaagttagaaccctaatcctcttgctacaggctagcaagatttctcgtatgaaaataatgacactgcaaatcagtacctgaggtctaccaaaacctcatgttgtcaaaaccaaattgtcatctaactatttgaaacccgccacaaccctttctcgtaccattaatgtcaaagcacaccctctgagcagaggcagcagtcactgttttttgttgttgttgttgtttttttctgagctttctcacatactaacagaggctttgatgcaaaatatagagcagtttccgacctaagggactttggaccaacagatatcatgctagccctaattttttctgtgggttttcacacgactgtgtgtgagaaaagcaagagatttcagatctaaacaagacccactatacgaactaatgaaaatattgggtgtgtggtctacaaaacagcctaaataagtacttctctctgaaagatccctttctccataggcctattcagattaatatctagttttcttcacattaaagtgtatatgacagttgtcatgataacttagtgaaaagtttagccaatagaatctatgtagcacttttaggcttctcctgctgtctgaattttttcttaattttctttctctcaaattcagcccacctaaagtttttgacagtctgtttaccaatcaggaaaagatttaattcttatttgtcttaaggcagacatccaggatggacagtgattatgggttcatggaatgttacaactggaagagtttataggattcatctggtccctcattttcctacttgtcaaatgaaaacaatcaccagggaatgtgttgaaaatatagatttttagtctccactccaacctgttgggtcagaatctcaacagacacaagagaatctgtacttttaacaatcataccatcaagcaaatttgagaaacgctgatataatcctatgattttattttgtaaagaggtttattttgattatacatggtcatatatgaaaaaaagaaaggatttcatagcctttcgtgaaagagttgactgcttcatatcagttataaaacataaattgaaaattattcctgaggttgaaacactcaacttgggcctctcaatttctgaaactcttgactttgatgatcgtaaaatgacaatgattattttatgttaattacagaagtcaccttccattctctcccaacctcaataacacctatagatgatatcaaatcgaggcatgtagagccacacactattttaaaaatgtagcattccttcatactcataaacattctcttaaccttaacatatgaaataatctccaaattctcacaaaaatgagtgcccacctgaactaaagtttttttacacctttaaaaatgtaattgtacagacgaaatcggtgtcataaggttactttcactaaaatagtatatccctctaaaaacaactttcacccatttgcaatcactggaaagtcatagaaggtgactagagtaactgatttctctcaagagcaaattcatgctctccaaaggagatcagggtctgtttagaaaactgaggtctaataatcaaggttgccacctggtagatctcatgttccacacatttggatgacttggctgatttcaggaatatgggaaaaatcagtttaacccaggctctctgaaccaatgtctcagatcaaactgatgacccccggacagcaaaaatgtgaccaaggtggaaggatcacttgagtccgggaggtcaaggctgcagtgagccatgattgtgtcgctgcctttcagcctgggtaacagaacaagaccccgtctcaaaatatatacatatgttgtatacttctcagtgtagaaaagccatttaaagcattctgtgtagggagaataaagtgagacacaacctgagtattataatgaacactgaatttgtactaaaaagaatcaggcttagccttcacttcacaacccaggttcacatgggtccttcctgtgcatcccaaggtcaggtttaaccacatcaacctcaaagccttccaaacagaaagcatttggaaacaacaccatctccccagatcattctacagtatgaagccgtgaaactgatggctctcggttcccctattcctggaacacaagtcttcagtttcagatttgggggaagagaaatcatcatagtatgacaattgggagaaaattacgtttttgttttcatatgtctccaaataaaatcccaatcatattttgtacaaaatttccatttttcattattaaaatttcattattttcaggcagccattgaaaaagattgtgccctaccagaatctggatatccttttgggcaacacacttttaacctctcttaggagatgttaatttgagtgagttttcaccattctatctactgcattcgtaaatttccctttttgattattctagtcatgtaacagtgagctcagcaaaacaaacacacgcacaactccaaagttctatgcttaatgtcagtgataaatttcaccaagtagctagaaaagcagctataataaagaatattctaattagtcttagaggcattatgtggcagaaaatatggaattttttttcttatgccgagtttgctaattgcccccaacaataggtgtgaatctcttttgttatacttgcagaaaatatataggtttgacttccatctgggacactctagagaaatgaaggagttgcataaaacttttaatgctgtgaacagctagacacaagttacatagctgctgaaatgaaactatacaacaatttctctatataaacacattctgaaaacacgttgggtaaatggagatattgttgccaccctagaattgatggtttccataaatatcagcatagcatccatactatcttttaattacaattttaaacctgcgaatataataccttgactcgatggtagtctcagagaatgtatgactatattttattccaccacatataaatttgtagaatagggtcttagtgcttagctctgtgagaactatctaactgtctgatgataaaagttgaggagttgtttctgtgaccaaatatgaacataagaccaattatctgcaaatactcctgtaaggtatatttccagtactgttttatgtttggcaggattgtggtggagaagaacagggagatgttctaagtgtttaaaattatttttacatcctagaatcaatgtcttcttaatatcatactctctggttggaaatcttcagaggacagacactcagtgaataacctttaactaatttccaacccatttgagtatgccaggaaaatagcatcttccaagttctagtctagttgttgtatctgtctgtgttgctttccggctgctatagcccagttaaattaccaagtgctgctgatcctttggagcttttcttaatcctcttttgacctctctaatttgaattattctgtgtcatcaacaaagatgtaacagttaggtctctgtgaaatcacaaactagaattgcaattagagtttcttaatcgttgtgcatattgtattgttgcatggggaaagaaagttttggaatttaattaaaagaaaggggaattgtcaatgtacttaatatgccattatattttttcttttaaaatatggagttaaagaaaagtttgattgtctttaatagttgcagttatctaccaatggggactactgaatacatatgctggggaaattcaatgtcaaggaataatgtatgcttgaggaaagtgtcattaaaaaagaatcagaggattagggattctctaagtttttaaaaatatatatattcttagttcttccggttctgggcccattcctttgtttgtagagttacaaaaaacatgattgtttggtagtaattttctttatccagctctttttttttttttttttggcaggtggtaaagtttattcttgtaatttcttgagaagcgtacagcatattttcatttagatgaagttcaaaaacaaaaataaactattaagtgagttagggctacaaaatgtggtcaactataaagaatatcaagggaaccataaacctgaaatctgggagagcagtttcatctgagtcaggaggaaataagtggatggaatcaggcggaagcacgtagcgtaaaagaaaaattgcaccagacactcattaaaaatggcagagagactttctttgaaacgattgtaatatggattaagactattgcagtaggggagagattgaactagactccattggcacaaaagactggaaagttttcaagcatgaagtgagccagagaacaggtactggaagatggtgggacgatgtgattaggccatctgcatttcctaattggcacttccagaatttaggctccttacccttccacagagactgagagactggggccctcccttcttgataacaacatttcaaagggatagctcccgggtccttaagaaaaacactcctgggctgtaaaaggtttacctctcaaagggcagagtaagaatttacaattgcaagttttctaatgtaagtgctctaagaaaagagaagtcaaaggcctagagtcaggaagaaagctgtctgaagtttagtcaagctgaaaggaacttaaagcctccttggtcaacagtaagcttcagtgataatgctgaagtcttgttttctaaaattaggtgggaagtccgctggtcattgtatcatgacaccttacaccttacacatactttaaacattttctttagtatttggtagaaacagaaatactacttaagtgctacttaatagaaagtaaatcaatagtattcaacagaagcagaaatgtatttaatagcactaaatagaagtattaatagcatccagtagatacagaaatgttcggcccagggtcagtggtgttgcccaggggaatagccttcctgggtaacatacgctgagattgctgagtggacaaggtatttccatgtgccgaatttacacagtgcacctctttcctttttcctggctgcactcggtctctctgaagtgaatggcagtatttttaccctcgatttactgaggaggagactcagtcagagaggacattaattgtttcttcctaatatcacaataaattctcattccctaaggctatgtcactccctagaactaagttatctacttagggaagatcattcgtcactgccaggtctccagggtaacatcaaggctttattgttgcaagtcgacaaatcgcctcccatctgtctgccctgactctgtgactgcagccgcgcggtgccctagatgtttccccagtggtctgaaagaattaatgtgcctccctaaacatctaacttaatgctagggaggggcttaggcaatgggggaaatccgcctggaagagatgttctggatgtcagtaggttgtgctaatctggctgtggtcatggctctattggggagacattgacagtccatctatgtctcactgaaagatctttgtgatatctacaggggcactggggaactaacatttcaagaaaataatagcgccagcaggtacagatggtgtctcagacaaagtttctgggctctccctgaagcttgacatcacatcagtgtgtgtgcaactctgcatgtggttggtgagtacaagggcaagagacagagagggtaggagtcagaccgaaggagctaccgtgctggagcccagtgaaaggtgccaggagaactcatggcctctctgctcagatctcaaaatcagaggaaatgacaaagaaccagaagaacaaaggagaagtgacatatgggaggagacacccaagggaaacgttcaaggtcccaacatgacaccttatttgcagaacatcccccaaaacaaagaaatcctctgcacttgttcagaggatttctgatcaacagcagccaacccacagaagcagcagcccttgggcgctaagcagaagagagaaccaatgaggagccattcacctcacctgctgacgcgaaggctgcttgccagttttaggggttttctatgttgatgagcactttggattgttctgagaaattccccctcaacacaaaacacactctttaatgaagagatcccatattcctggctcaaaaatttgacccttgaatcatttatatcatatcattttgttgtagtccatgaattcatgaaaggcacagagtgacccagggctggatatcagccaggttccacgcagacagagtgactgggatgactggatcccaacactcggtgactctcccattcaccaagctccctagtggtctagaataatacccagccacacacctagcgagggctcatagatcttaaaaagttaaagaactactgccactgagcagatttttcatgtctgtatctgcttgcctgccagatttccttcctcttccatctcattgctgaatttaaaaatacttctaagtctatatacattataattgggtaaaataagaaattcttcgtaatttagaagatgtatctctttcctgaagacttcctcctactccacccccaatctccagagacacatttttacccttaagatccttttttttcctttatttcttctaaaaaaaaaaaatgggatacatgttcagaacgtgcaggtttgttacataggttacatgtgccatggtggtttgctgcacctattgacccatcctctaagttcccttcctctacccgccactccacaaaggcccttgtgtgtgttattcgcctcactgtgtccctgtgttctcaatattcaactcttacttatgagtgagaacatgcttaatcctgagattctgagcaagacaacctcctttagagatgtctattgcttggaatgttttaatctgttagatttttgactgcacatattagctttaagaaattagaattgagcattaacatgttcagtttgttttcactattaatttctccataaattatgttagattgcattttttatagtatgtgcaagtgtatgtgcatatacgtatacacacagagagaggctttgagctaaggatggtggattgcccacatctgtttaaatctccctaccaggaaactagcagcaagcatattacttcttcttaccccctcctatattcctgccaaggagggaatttaaaaactctttcaaggagaaacaggtagccagtgatcatcaaacattagagaaagcattcaccgtgacagaggcaggaaaaagaaaattctaaaagaaaaactctagaataaacaaagacatagtaggaatcataaaaaaactgttaagtgagcaatgctgacatgcctgctcctggtaccattattagcagaaaagtagatacaaaatgctttgatataaatgagacatctatatctatcaggttaacatagagataaagtgaacagatgaatttcaagtgatagaatttcctgtgtgtagcacccacattagaggttataagaggataaaatttaaagtaaatttggaatcacccagtcttacgtcctcattatcagggctatggtttaattgttccccccaaagtgcatgtgttggaaggttgacccccaatgcagggatattgggaggttaagcctaatgggaggtgtttgggtcataagggcaccactctcatgaagggattgatgctgttatcttggaagtggattcatggtcttgggagtgtatttcttataaaagcatgagtttgaccccctcttgccttctgccatgttatgacacagcaagaaggtccttacgagatgccagcaccttgatcttgaacttctgtgctttataaattacccagtctcaggtattctgttacagcagcacaaaacagacgaagacagaaaatgggtaccagagagagcagtgttgctatagtaaatacctgaaaatgtagaagtagctttggaactgtataatgggtagaagcctggaaaatttggaggagtaggctgggaaaagcatgcattgctatgaacagaacatttagggtaattctgttgagggctcagaagagaagaaatataggggaagtagagattactaagttgttgtgatcagaatgttggtagaaatatggacaataaagggcattctgatgaagtctcagacagaaatgaggaatagcttattagaaactggagtaaaggccattcttgttataaattggcaaagaacttggctgaattgttcatgccctagggctttatggaaggcagaatttaagagtaatggactcggatatctggtggaagaaatttctaagcaaaatattgaaggagttgcatggttacttttaactgcatatagtaagattagagagaagagaaatgatttaaagacagaacttataattaaaaaagaagtagagcagaaagatttgggaaatctgtggcctggccatgtaatgaacagccatgtaaaggtgctgccaagcaaccctttaataaagggattagtacagctagaaagaagccaggtgctatttatcaagacagtgggagaattacccgaaggtgttttggagatctctgaggctctccctccatcacaagcccagagctctaggagggcagaatggtttcagaggagagtctcagagtgccctccttggtttctctgcccagggcggcctagggactctactccctgcattccagtgtagcagtcctcgaccactccagctgtggctcaagtgggcccaggtgcagctggtgctggtgctccagaaagtataagggtaatctttggtggtacctatatggtgcttattttgtaggcacacaaagtacattagctgtggggccatggtagcctctacctagatttcaaaggatgtgttggacagcctcagggcccaggcagagacatggtacagacagaagtcatagcagatttcccactatggcgatgcctggtggagccgtgggggtagggcaaaccccacaaccctgaccccagacctatagagctactagcatgtagccccagcctgggagagatgcaggtatgaaactccaacccatgagagctcctatgtgggctgaacccagcaaagctatacgggtgaggctgcctgagactttgagggcccaacctcaactccagtgtgttcagcacaagaagtcaaactttattctggagtcttaagatttagtgttcaccctgttggctttttggacttacctgagaccagctacccctttttccctgcttattcgtccttttcaaaatgggcatgtctatactatgcctgttttagttctaggattatattttggaagcacataacttgtttaacttcacaggctcatagctagagggaaatttgcctcaagtgaatcatgctgttagtctcaaccatttctaatttagataacattctggactttggactttgagttggggctgggatgagtgaagagtttagagtctattgagatagattgaatatattttgcatgtgagaaagacatgaatttggtggaccagggatgaaatgctataatttgaaactgttccccaaagttcatgtgttagaaacttgatccctaattcagcagtgttgggaggtggggcccagtgggaggtgtttggatcatggtggcactgccctcatgaaaatattagtgccattatcttagaagtgggctcatggtttctggggcgaattgcttataaaaggatgaatttggcctctcttgctctctcttgtgatgctttccatgtgatgcttttccaccatgttatgacacagcaagaaggccctcacaagacacggatgccttgatcttggatgtcccaggctccaaagggacgttttcattccaatggaatgaaaaacaattccattctttatacgttactgagtctcaggtattctgttataacagcacaaagtggactaagacgagcagttatgttatttacccataatcatataatatattagctgcagaatcaagtctagaattctgattcctaatttctagtcccatgtgatttctattacctaactccataaaatggatggaaatgtctgattctataaggaatctcaaagttccacagagtcaacatatagaacacataaagccaactttatgtgtttttttaaatgtaaatgtgactgatatctaatagctaaaaattcttatcaaatagctaattgttacataattagcacaagtggtaataattctaattactttctttcagattttagaagagctatgttgagaagatttgctaggcctctttaaaattttatcctaggaagttttaaatgggggctttacttttctcttgttaaattttccttaagctcagaatccagtattgcccactgatcaatattttcaaagatagatggcatagcactcaaacatttgaagacattactaaggccttgtcttgtgagttttcagaaagcagaagtcacttatatcttgctcccctcccccatcatctcaaactatgtcgaaatccttccaaaatggcaatcttcatgtaaagaattatttaaaaggagcagccattggcttctgacttaatataatggaaggaaattataaggcagatagtatgtgtatcagactgtctctgggccatgtccaatccgcagctgtgtgcccacttgttgcttctcttggtttgtaataaattttaatgggttacatctaggtcaataataaaaaataagcacaatgatcattcaattcactgaactctaagtctagctactagtgttccaactcgtataaaatctgtgttgaactataaatacagtagtccccccttgtccgtggttttgctttctgcaatttcagttacctgtggccaaccatggcttgaaaatatacagtattttgaaagagagagagaagaaccacataacataacttttattacaatatattgttattatttttctattttattattctcataatctcttactgtgcctcatttataaattaaagcttatcatagacatgtatgaataggaaaaaaacatagtatacacagatgattcttgatttacaatgttttgacttaaaaattttctcagctttacaatggtgggacagcgatccatgttctttgacttacagtagatttattgggatatgaccccattgtaagtggaggagtatcttttaggatttggtactacctgtggtttcaggcatctactgggagtcttggaacatatttcccatggataagggggaaactactgtacaattgtaggacttcagtatgtaattaggaaaagaaaaattaatttgttttcataaacaaatagatcattatagtttacatctgtaaacaatcatggtattcttctgtcaaaacctttccatatcttcttattagttacaaaatacaatctaaactatagagcatggtcttcaaggcaattcagtctgatgcctcaacctgtccatcaaccccatcaactgtattgtttcacttcaaccccagatgctaatcactccatatcatccagactgccttgaacgctgtatgcatttcatgaatctgtacctttcccaagctgcttccgcagttaaaattctctgatcctttgagactcagttcaagtatctatgatcctaggaaatctcttcaacaccccctctttgtcccctctcgtctcagcagaatccattgtttcttcttcattaaagttcccatagcatctaattctatttttatgaaagcatttctcagtcacaccttttttgccatttctgtttctgtttccctccccaaatggtgaatcactagaggaagtcaaggatcatcttatagtatccttgtgtctcaagagtttagtctacccctccacatgtttggtacccattaaatgtttctttaattggatttatgtaagagcttaagagtatttcccatgatttcatttgatgcccatagaaactccattaagcaggatggtaactgactccattaaagcaagtaatccaactgttttaggcttctccaaagagagagagagaagcaataggatggatggatagatggatggatggatggatggatggatggatggatggatggatggatagatagataaggaatttattaggggaattggctcatacaattatgaaagctaagtcccacaacaggccctctttttgttaaatcctttttgtattagttaagggcctccagagagacagaaccaatagaagatatacatctgtatctgtacatatgagaagagatttattaggagaattggctcatgcaattgggaggttgagaaatcctacgctaggctctctgcaagctggagaaccagggaagctggtagcatggctcagtctaatctgaaggcctcagaaccgggaaaattattggtgtaactcttagtctgaggctgaaggcctgagaacccaggtggccattatgcaagttcaagtccaaaggccagacagcctggagttctgatggccaaggacaggagaaggagagtgtcagcgctctgggagagacaaaaaaagaatttgtcttctgccttttgttatctctgggacctcagcaaattggatcatgcctgcccacatgagggaggatcttcctcactcagtccaccaattcacaccccaatctcctctggaaagacccttgcagacacacccagaaataatttttaccaactctccaggtatttcttaatccagtcaagctgactccttaatttaaccatcacagcaactgggcaccaaaaacagattagtgatttacctccaggtcatgtggtcagtcaatggcaggaccagtaccaacccctaggttttccaatcctccatcgcatactttgcaccatcgttgctcagcacctactgagaagtggggacatggtaaagagctaaggatgcttgcaacccaatattcatgtcacttcttgaggtttcagcagctttttcatgcatgcattggctccatggtcacatacaagaaccctctgctttctcatctaagagtttcagagatgccaaagtaacaggattgaggctgaacaatcaccttcatttctaatgtttttcctcacaaaccaattcagaaattcagaaaacatcttactatagtagttgtttcctgaattactaaatggaagctttattaggaagtattctctgttctttctaccaaggcagctttgttccttgggcataaacaaaactatcccttctctctctaaattgaccacagagccaaccttatataaattagaacttgttagttttggcttcagatgccggctctttctcttgaggttttcacctacttaaaattcacttgttgccctttaaattcacatctagcttaaggcaaatgtttgaatttctaaaataaaaccatgtgcccaaaataagcttagggaaaaaataactgaaataaatggaaaattctccaaaataagcaaaagcattaaaatgataatgctttaactttctgaactaaactgaaaataatgtatgctcaagataagcttacaaccacggagagatctctcttctacaaagccttaaagaaaaagcaggaaattacctcagatgaaacttcattacatggcatttccattcccaggatccatcctcagacacgttgacttaattgctctggaaaagagccccagcatcaatatttttcaactttctaggtggttctaatgtcggtcacaatcaagaaatgacatgaacaatattctgaatcatttcagtagatgttgactgcatgactgtgctttctaccagtcctatcccacaccccgcctttttcctaaaataggtatgcatgcagtgtgtgctctgcacacatgcacatacacaaacacacacacagtttcattcatttgtatattcattcaatcaataagttgaattttgccttcgtgcaaggaaccatgactatcagcacaaacaagaaactattcctgaccccaagagattcccagtctaggtgtggagaatatgaagcacagaaatgggaacaactctaggtaggaaatggaaagagagcaaatttttttttttaagaggcagctgggcacagtggctcacacctgtaatcccagcactttgggatgctgaggcaggaggatcattggaggcaaaatcaagtgtacctaacagttttagaaaattgtacatcgtatacttccactttccatcgtgacttctgttcatagtttatagatgtacaacataaagacataattcctaaataaacaaagcttctgtgaaagcataatgtgactctgcaggcctgctggcctgtcttattattgatctgaaaacaagattgacactactgtgattattctttagtgggaagggacattcatacttatttagccattgctatgctttcaggcaaatcaacccctcagtaactccaggcaaatgaatataggcctttcataaaaagtgtcttggagagaaagcccacaactgcaattaacaggaaatagctgatgcagtgtgacagcaagtccccaaacccttaatggaaggattgactgtcatgtgcatggagatgtggttagagaggaaataagttactgggttttgtaaggcaccaacttgaaaaacatgaaaagctgtggcaggccacaaacatggagcccatttggagtagaggcaggcaagtagaacggagaaccgtggcatttcaaccctagattaatctgagtgtcgcttttgctgccactacttaacaagagtagctgtagagagtgaaacatttttcctaaaatgtcatattttctctggtagctcctgttttcttctttgtatcacattatagctccacaaagttcatgcaaatgcataactaaattttgattatgagaggtctcagaatgcaacttgtttatgggaagaatatcattagtatagtttcaggcaattccttgcaaactatccccagtttaaaacagtcacaccttagtcaacaagcatctattgagcaacccactttcgacctggcattatggtaggtgcaaaggctaaaaaaaggtagaatgagatagaacctccacggaatatatacaataacaaattatttttttaaaaaactggatataacttgagaaactcttctgtacaggcattctggagtgagctgcaatccatcattattcagaaatgcattcatgcattacacctttgtcaagccaagttccaggttctgtgcttggtgctgggaagattgaaaggtcagctgaagttacagaaggccacgatgccagcacagctgctgcctactctttcgcctgatttatttctgttatttcttttacaattgtgattaaaaaaacacataacaccaaattgacgatcttaaccatttttaagcacaagcagagtcacgttcagtgactccacttcagtcaagttcagtagcattaagtagagtcacgtttacgtgcatctggtctccacaactctttcatcttgcaaacccaaactctataccatgaagtatccaaagtactcatatgtatcaaaacagagagtaggtggttgccaggttgccagggcatggtggagggggaagggaggagttgttgcctgatttctttttaaagctcagtcttccctttggcttctggttctaagcgtgttagcatcacggccccttttcattatcctaaaggacagacccagccctggttctgcaggtgctgaattctacttgactccaaagaggctcagcctctacctgcacccaggttctgctaacttggtctaccctctgttgtttttcctctctgttttgttcccatttgtaagatctctgccaaacttacttatttgctgcttttcacagacactagaccataccacctcctgggtattcacgatccatgcctggcccagctgactgttctcttattccaggctgttcgctgtttacctcgtccctcttcagcatcctcaatatgcctgcataatgcatatccatttttctccccaaattaaaagctatggccactgtatgttgaaaaatgcttaaaaccccacctaaacattccaggaagcaggaagccatgaatgactttaaaccaagaacagtctcaaaaatgttgtggtttccagtatgtgagtctcggacttcagcatattgctgttcatatgccacacaaatgttctgtaaagtcccattgagaattatgtgcaaatttaaatgctctccagacaatttcaaatatcagctttgatgcaagacttcacctgctaaaagcatctctttatggtttgacactacatctctgacattttgacgtgatacatattccatcagcctgatacattgccacctcccagtgagtcacagtgtcactaactcagaattaaatatgttgctaaaccactttacagcccttgcaaagcacataaaggctgtttgacaattacccccaggaaggcaaataatcagtacacctctgattctcttattattaaccattataaaatcatgtgctgtgatcaaggtgtgtaacaaagacattgatttttataagactacccaggaagcaaatacatattcttgatatacgaaacacacaggaggcctcttcattttcctttgtgtctttaatttgctcagagctgctcctcatacagcactggctttcacctgtcaagctaaggctttaattactgagttatggaaaaatcattgccaattgccttaactacaataataaagaatatcttacaaaggataagaaatcttttttcttcggctctgtagttaaaagactagttctagttttaatctgaacttttctatttctctccctatatttccctttcttcctattttaattgctggttagataattaagtaggtacctgacctgcaccaaatgtgcttgggaaagtctctcgtattttcgttttgctttgttttgtttctgcatgccattgaaacccctgtgttaattattctttccttacttgaagtatcttatacaacctttcttcaccagtatccttttcactaggccaaatacttattttggagtctcaaggatgattttctaaatcttttcataaccgcttttagcccttactcagttttattgtgcctgcccctcattgcacaaagggatatatttgactattccatggcatatttgactttgtaattcgtaaattatttttcatgtcttacatggttaaagatacgtttcacttgagcttgtaacagacataaaaatgacccatggtaaacctgtcgtattagaaaatcaaacaaaaagcataaggagataacacggtaaaaatgaaaagagtacaagctttagacccgtgtggatccgagttcatatctaacttggccaactaatagcttgttaattatgttaccttaggttgtattttttttttttttttttctaatttagtctcggggtctccgtgttctagctccgacccaagggggttcccgggacgtggttgtggatgttcagtgtgcctttaactggatacttctttatcctggcagacggcctgatgcccaggtgtgacttgtggccaggtgtcccacaaacaggaaaacctgtttacactggcagatggccttgtggcgtgctatagtctgaatgtctctatcctcctaaaatccgtaaattgaaacctcattcctaacgtgatggtgttaataagtggggcctttgggagatgattaggtaatgagggcagagccttcatgaacaggattagtgcccagacaaaagaggcccaaggaagcttgtccacctttgtgccatgtgaggacactgctggaaggcaccatctatgaagcagagagtcggccctcatcagacaccaaatctactgctacctctgtctcgggcttcccagcctccagaactgtaagcaatctgctgttgttgttgtttacaaattacccagtctaagatattttttatggcagcccaaacagactgagacatggcttttgtctgctctgtgtctagtgtatgttttgttttggttcggttttaagtttgtttggtttttggtttttggtttcgctttgtttttgtagacaacatcttactatgttgcccagactggtcttaaactcctagactcaagcaatccttcgcctcagcctctcaaagtgctgagatgacaggcgggagccaccacgcccagccaccctgtgtctagcttattcctaccaagagaatcactctctgtgaaagctctgagcagaaggagagttaggttcgcgtgtgttgctcaggtgagacaaagaggagatcatacagcaaaacacatgaaataacagaagcagcgtttgactcacagatccagagcagagagggcagcctgcctctcagggccaacaggaaaggggagctgtcctggacacgcaggctccaccagtgtggggagcaaaagagatcacaagagacctcagggcctaagactttgttggggtctcaggagttacccaagcaggtttcctgctgagagttctaatgggggtgggtggtggggggcgttacagcaacaattaccagtttcatggagccacactgtgcctgagcggtagtaactgtggcatctccatgcagtccatgcagcgggaggggtcttgggcgtgagtcaggtaggttgtattgagctgtcccctggggaggtgggcactagcagatacctggattgaccgccttgaggagctaggaggaagcagagaactagaaatcatgtcaagattcactaagccctgcatctgctatgagaaagtccaacttacaatcaaaatggatgcccaggcaacataaaattgtaagatttcgctacgccttaggcaatgaaacttggctgccttccagtgaatatttactgagcgtctagcttatttgagaaaccataatagacactacagggactgcgaagaatgggaaataaaccaattacacaatcacccacatagcagcgatacaaggccagccatatcaaacaacccaacagataaacagttcatatgttatatggtgtcagaagtaagacacatcaaaaaatggtaaaatacgtttgatactactgtccttataaaatcaccaaccataggaaaaatgatttttattaatgacagggatataatgaaaatagtttatgtgtgaaaacacataagtaattacataatacattatgatcaaaattagatacagcattgctgggcaagacctttttctcctctaatgctgtccttcaatattattaccaaaatatagcaccagtttttgtttttgtttgaggcagggtctcactctgttgcccaggctggaatgcagtaatatgatcatggctcactgcagcctcaacctcctgggctcaagtagtcctcccatttcagccttccaaagtgctgggattacactcgtgagccattgtgcccagccagtacctggttcttaattaactatatgaaaggcaaaatctgttttgctgctgagcaattatagtactatgcattatgtgtgtgtgtgtatgagtgtgtgtataacatgtagtttatatccatatataaactacatatagtttatatttaattgagtgtagacaatttataggttataatatctttagttataacattcacatgggtgtaattttttatactattctaatttatcattcctttctgttttaccttcaactctggttgaagtaatgtagttactatctgttttccgagttagacttccacttttcctctctggctacctgacaccccaagctagtgtaggtggctatatcattgcctggaattgaagtttttaagcctctgataattcagtctgtagaagctacccagctcaagaacaaaggggaaattacatatttcataacatgcttcaacatgaatgcatttaattagtatttataaatttgaatcaaaatgcaggaaatattctaaaaatataatttctctagaagagttatataatctctattaatgtaggccaactgcttctgtttcaaacacagaagaatgttcttcaatttttcatttgtgaaactgaatagtctcttctgaaagagtatatagtatttttccttttgggaatacaaaagcttttacaaaatgattatactaatcatcagatataagagtagtaccaattctctacctagaatagctgttaaccatggcacttggtgaattgggaatagacttaaatgatgcttctccttgggcccccacctccccaactcctacctttctcgaaaccaggctatttctctccaaatctcctttccttttgattcttcagttcgtgctacatgataactacttgccattggtcattaattatggtcgacgctcattattcacaggagtatgacccataaaatcactgcaaacactgaataagttaatactgaaccattgcccctagagggaattcagggttaagttcctgcaagcctctggtcacagtatattcatcaacctatcaatacataacgttattttatgcatgtttctgctttaagacatcttacttaacatatgtttttgattcattaacactgaactcatggccaacagctctataactaatgtctgaaaaaagcttatctaataggcatgttttccccataaggcacatcacagccttcttgtgcttaggaacactggacgacactcaacactgcgcttgggggccatttgaaacagtaatatcaccaataaaaaaaaagcacaaaaatgtcagggggaaatgtggcagtaaataggctgtgaaaaagacatttgtttgcagtatgagctaaaagaaggcagggcatcaccttgttctacatcagtagggatcatgagtgttatgccactcaatttttttgccagcctgtgtgtacacgtgtcctcaaatgaccatgaaagcactgcaagtatagatttggggattacaaataaatttcaacaagtagatgagtttgcaaacatggaatccgcaaataattactgttgactacaccatccttttgaacaaaaataaaagccacaattcaacttgagattggttatagatggcaactggcatttagtgagcacctgctatgagctgggtgccttacttttttttttgttttgagacagagtctcgctttgtcgcccagtctggagtgcagtggcaccatctcagctcactgcaagctccacctcccaggttcacgccattctcctgcctcagcctccccagtagctgggactacaggtgcctgccaccatgcccagctaatttttttttttttttagtagagacggggtttcaccctgtgagccaggatggtctcaatctcctgacctcgtgatccgcccgcctcggcctcccaaagtgctgggattacaggcgtgagccaccacacccagccactgggtgccttacttttagtaacacattgacctgggatgtgatcaactcgagaaccacatcactgtcatgtagctgcatggagctgtatcactcaacttctgggggcttatgtttcataacaattatcttttataaatgttcaatttaaaaatgaaaaacttccccaccccaatcaccacctcctttccccctctcccttccctttaatgaaccatctaagggaaggacatgtgtgcttctttgacatttcttcacagaatccagtccaatggcagggaggctgggtgagggtcagtgtcagcctagccagtagggaatccatggagctggggcatgtcaggggagtgtctcttactgagaactctgggtcctcttggatcaaagaatgtgcaaattgagctaagagatagaggggaattcgagaagatcacctaaaatgggcaaacaggaggaagctagatccaggtagcctgggagtcaagaacagtgagccctgtgtgagctaaaaaaccagaagcaaaccttggccaatggctggagctggtgtttttgctcaagcctggctttcatgggctccccttgatgtgagtctcagagtagggctggttaagtggccaggacctgagaaataaaatctcccttatatactcttgagagaacaagtctaacatatcagtaaggtaatagctataaaaatgtggctaggccgggcgtggtggctcgtgcctgtaatcccagcactttgggaggccgaggctggtggatcacctgaggtctggagtttgagaccagactggccaacatggtgaaaccccatctctactaaaaatacaaaaaaaattagccaggtgtagtggtaggtgcctgtaatcccagctactcgggatcctgaggcagaagaatcacttgaacccaagaggcagaggttgcagagagctaagatcatgccattgcactgcagcctgggcgacaagagcaaaactccgtctcaaaaaatagaaaaaataagtggctaagtcagtagtgaaactacgaagctaacttattacatttttcaccttttgaactttcaaacttgagtcatttatggacatctttgaagggaacagttattataaactctcactgttgacctaattaacattataatgtcaattatatatgtatagaaagaattctagatatacactcctgctaatatatttctaagattttttaatgttttatgatatacaaatttggatataagaaaaattataaaaccaacaaaattaaaactagtaaagtgaatgtaacgagataggctgtatagttcacaccacacaatgtcgtttagtcgacagtggaccgcacagataacagcagttccataagattatagaggagctgaacatttcctatgcctagtaacatcacagctgttgttaaggtcctatcacaacacattactcctatgtttgtgatgacactggtgtaaacaaacctactgcactgccaggcatatagaagtgtagcttatacaattatgtacagtaatacttgataatgataatatttgactatgttactggtttatgtatttgctatattatattatacattttatcattcaagtgtattccttctacttattttaaaaaatttgctgtgaaacaggcagggtacagtggctcatgcctgtaatcccagcactttgggaggccgaggcaggtggatcacctgaggtcaggaggttgagaccagcctggttaacatgcagaagcctcatctccatgaaaaatacaaaaattagccaggcatagtggttcaccctatgatcccagctactcggaaggctgaggcagaagaatcacttgagcccgggaggcagtttgcagtaagccaagatcgcgccactgcactccagcctgggtgacagaacaagactctatctcaaacaaaccgaaacattaagtgtgaaacaacctcagcaggtccttcaggagggattccagaagaaggcattgttaccataggagctggcagctctgtgtgtgtcactgcccctgaagacctcgcagtaggacaaggtgtggaggtggaagacagtgatattgatattcctgaccctgttaggcctaggctaatgtgtgtgtttgtgtcttagtttttacaacaaatatttaaagtacaaaaatgaaaaaattcaaagtagaagaaaaggctgatagaataggatataaagaaaaaatatttttgtatggctgtacaatgtgcttgtgttttaagctgtgttatcacaaaagagtaaaaaagttaaaagaaattaaaagtttagaaagtaaaaaaagttacagtaaactaatgtgtattaaagaaaagtatttttttacaaatttagtgaagcctaagtatacagtattttttaagtcaacattagtgtacagtaatgttctaggccttcacgttcactctccactcactcactgactcacccacagcaacttccagtcctgcaagctccattcatgataagtgccctatacaggtgtgccattctttttatcttttactctgtatttttactgtactttttctatgtttagatatatttagatacacaaataccattgtgttacaactgtctacagtatttagtacaataacatgctgtacagatttgtagcctgggagcaacgggccatagcatatagcctaggtatgtagtaggctatacagtggcagtttgtgaagtgcattctgtgatgtttgcatgacaacaaaattgcctagagacacactcctcagaatacatctccatcgttcaggctcagcaatgcatgactgtattagtaaactaaatttccactttcaatgagaattttttcagtgtagcttgttttgagttcattttgcctatacactataagtttgtgataattcaattttgctactacttttttctaatcaaactactatcaaatctccacccacagagcatacttttatgtaatttgctttcacttgggccaaatatcatttttgtattaagttggcctatgttcttttctcaataggtaaccaaaattaaagcagtagcatttggcagcaattacaaacagaaatgagagcatttatgtcctggcgggagttggttgttaagtggccatccggaagttatgcaatatgttttctttctcttttcttttctgtttttttttttaagattgctattgaaatgaaaacagaaactgcaccaactgatgttaaagataaatacaaagccatcgtaattaaaagagtatgtcacaaatgcaagaataggcagaaggatcactggaactgattagaatgtcagaatactgtttacataagaagtagtgcatactgaaactggcaatttaaatgaacggggatcctgcagtgtaaaactctgaaataaacaaacaaataaataaacagggatgaagacaaattttgctaagaaaattatgtgactatactttaaaaaatagtttctattttacgttagatgctaaaatgaattccaaagaattacagacttcaatgtgcaaagaggaagaatgcatagaaaagtgatactaaaagcaattcagtatttttctgttctctaaattttaaaaagcccttgtggctgggcacagtggctcacgcctgtaatcccagcagtttgggaggccgaggcgggtggatcacgaggtcaggagatggagaccatcctggctaacacggtgaaaccctgtctctactaaaaatacaaaaaattagccgggcgtggtggcaggtgcctgtagtcccagctgctcgggaggctgaggcaggagaatggggtgaacccaggaggcggagcttgcagtgagctgagatcgcaccactgcactccagcctgggcgacagacagagccagactccgtctccaaaaaaaaaaaaaaaagcccttgtaagcataaatacaaaggaaacttggtagatatggcaacataacaattaaaagttcatgtaagtacaaaaatcaacaaattaaaaactgagaaactggaaaaatatttgcaatacattgatataaaaatcataatatgtttttaaaaacttttaaaaactagcaacaaaaagtaaaagatgaacaaccaggtgatggaaaaaaaaaaaaaagatccagaattgttcagtaaaggtgtaaaaagtgtttccaatcaaagaaatacaaactgaaacaagaatataatattttattttggttttggttttgtttaataagcagaaaatggtgaggcatttttgacaagcaattttgcaagacagatcaataatctttaaaacgtatgtagttcttgagcaaggattttcacctctaaaattatatttcaaagaaataattgtagaccacatgcaagattttttttacagattatttgtcataaagttatatataattgtgaaaaatgcaaatcaatgatatctgtcacccagaaaggaaggaaatggttaaatacatttaagtttagccgtataacagtattccttaaaaataagtctcctaggccaggcacagtggctcacgcctataacccagcactttgagaggccaaggtgagcggattacttgaggtcgggagtttgagaccaggctggccaatatggtgaaacctcatatctagtaaaaatacaaaaattagctgggcatagtggcgcacgcctgtagtcccagctactcgggaggctgagccaggagaatcgcttgaaaccaggaggcagaaatttcagtgagcctaaatcacgccactgcactctaggctgggtgacagagctagactccgtctcaaaaaaacaagaaacatcacctaaaaaaaagtctttgaagactattaacatggaagcatgataatggtataattttaataagaaattatgatagaacactgatagaatattatcccagttttacaattccacatgtatttacatgtacctgggaaaattataatgaaaatgttaacacatttttttcttgtcagtaagtgcaggggaaccttacattttctttatggttttctgattattccaaatattgtaaaatacacattattcatatacttttaaaatgtggatcttaactgttttcctttaatctgctatcttacctttttaaatctaggaaatgtatgtatctcaaaatggtaaaactgaatatttaatattctagaaattaatgttttataaatcttaattttcttctcagtaatattgtataattttaaatattggcagattgtcagctatggctgtgcctatttaaagccaaaactcctgccaattttgtgaaaacttacgctcattatctagatttttgtttgtagtacgataaatattttcaccgtactttacctgctttggcaaaagatagatggcagaagaaggagctgattaaataaccaataaatacaagagaaaatctgggacattttttgcttttattattactttttataccattatgctggtaaattatttataatattatgattatgctaggattatagaacgaaaggtaataagttttatggattgtcagtaataataattactgtaaattgtcttttaaaataatgaaggctaaaatacttaggtattgagagtgttttcttcttgctactctgtgatgtatcgttgcagcaggctgagataatggaaaaggctgagagctacaagccaaaaagactgggtgttgagtctctaattccacttcttttttttttttttttttcaagacagagtctagctctgtcgcccaggctggagtgcagtggtgtggtctcagctcactgcaaactctgcctcccgggttcacgccattctcctgcctcagcctccagagtagctgggactacaggtacccgccaccacacccggctaattttttgtatttttagtagagacagggtttcaccgtgttagccaggatgttcttgatctcctgacctcgtgatccacccgcctcggcctcccatagtgctgggattacaggcgtgagccactgcgcccggctaattccacttcttattagctctgggattgtggacaatttctctaggcagagcttcctcgtctgtaaaatatgaatgagtctaatatgtatgcatctagtaatctgatttaatcacaaaatgggactagactatacagtccttaaagaatctatcactatgacttctctcagtggcctttttttttttttttttttttttttacagagctggataataaagagcttagaattttattcctgaaaggcaactagagtgctaggcattctgggtttctgatagaagacatgcacataagctttagcaaacactcagaactctatgctccctaactacaacttcgccagagtgcagaggccaactcttttcctttaaaaaactaactccaggatgtgttcacatggtcaataagatctatagttctttgctgatcatcccctgggaaacttttaaaatgaagtctgacacattacaaaccatgcacagaaacaaacaatatcagtaaaactctcaagtaatgcgtggttttgagccatgtagagtccaggtaagccttccaagcttggttaggtgcaaaacatactttctccagtatgtaaattaataggaatctttttttttttttttttctgagatggagtctcactctgtcagccaggctggagtgtagtaccacaatctctgctcactgcaacctcttcctccctggttcaagcgattctcctgcctcagcctcccaagtagctgggattacaagtggacaccaccacgcctggctaatttttttgtatttttagtagagacgggttttaccatgttggccaggttggtctcaaactcctgacctcaggtgatctgcctgcctcggcctcccaaagtgctgggattataggtgtgagccaccatgcccagcctataaataggcatctttgatggccttttaaaacaaccagactttgtaggctatctgcaaaagataatagtttgaaattttaatatttatttaaatagtcctcctgatggtaactgatcactaacttttgaagtgcgttgggttggactcagtaaaaatctcagcaatagcttataggaaattattcttctgttttctaaggcaggaggctatgcacccgtgtcatctaaaagagtggcccatggtgctatggagcaagccaaatcttcattgcagtccagttctgtcatttaccaaatctgtgacctccagagagctgttttattaatctacccctcagcttcttcatctgtaaaatgggacaatgatagcccttctcttccagattaggcacctaatgcagaacctagtgagatctaaatatatattagctacatctattattatgtttataaagacaaaggataaatggtagtcctgttttgtcccactcaaagctgttctctgagccacaaaaagactgtttcagctgcatgccaagttaacacattgcagttaagaaggaaaagcattgcagttaagaaggaaaagcattgcagtagagactagtccgtgaacatctttgtcctcaccattcctatcgccttcttttaaatgaaggaggcagtgggtttcttatattttggtccccatgattttgcaatttatagccttgataacctggccacagctaattaagccaaggttcggggctcattccttaggccgtgatgtgcaacttggcctgtaccctctaacatggcttctcatgagaactctacctaacagaaagttctgtgttgaatagcgatgaacggattcactccaaccttctctcagtgactttgaataaaagatatgcagactgtatagcagcctaaagagtgggctctgttccctcgcaaattttagcatactcattgagaagggagggagctttggggagacagtgagagaagagaatttaaacattgtgggcaatttcttctgcccttccatttgctgtggaattttccagccattttatgttctgtggatttttcatgcttgatatggttggtttctgggatgtgtttcagtcaacattgacccaaaaaccatgcagtcagttttctgtctaaaagccaaagctgtaacctcactgatattgcagaaatgtttctatcactttctgacccctaaaagtgcatgtctcttagatcatagctttgctggtatcaagattacatttttaacagtataaaccttttacatatgcagtagcaattagaatgctctccccaagaggaggacattctctgaaatcccaagtaggagtgaacccagagtagcatagcatatctgctaacttgattccatctgtctttgttgcaacatgctcactgagcatatgcccctaaatgaatatgagatgaagacaggatctgtggtccctcccgcaacattgatggggtaagtttttttgctaggctgagtgtggttcaaatatttttgtacaatatatatcctaaacacaaacaactacttcgtctgttgcccacccaaaaatatgctgatctgttttgtgctgaagtatgatcgttcgtgttggcgtccttgagaagtaatgggataaggtacttgaagggcgatttaagagctttccagagcagcccttggcttttcttaattttccagttttgcaacaacttttagagcccaatcctcatgtaagctttggatccactggaattaaaagctcagactttatagacaaacagacctgggtttgaatcctatttccatcacttgcctttaggaaagttgctcaacttttctgagtcttcattttctcatctgtgcccaccctcttattgcagtgaggcttgagtggtattcacagccctcggtgcagtcacttccatacataagagccactgttgttgttaacatagtttagaagttaagagagtcacaggcgtcgtaaaccctcagatagtaccagtcatgaggaagcagaattcactaagcggtgggtaggagggtgcacaagtagccaggtatacaagtagccgggagctgctgagtgtcccaggtctccatgaggatcaatcgctcaatagcttggatagtctgcgtgtggataacacatcagcaaggaatagagacaacgccttaaaacagactttcagcatttctggtgtcgaaaggtcctaacatgaggtctcactaaattcgagatttcatcagcctgagaagaactcagggtaaaataagagtagtaatacacaccccttttaacctgggttagaatgcgtttatgagtgtgaggtgatcttcaagtataaagccctatgtggatgtaacatgatagcagattataaatattaatagcattttaagtcaaagataactatttagaattgtgaataatagagaagaaagactgtgggcatcactgtacctcctaccctcagttaaaacttactgaaggaactgaaggttaaacattcttgataaccattgtatttctgcagtgtctcagaagtattactagaagacaagcatgggatttagagttaaactaaccttgggttcaaatcataatgctgccactccttgactgtgtgatggtggagaagttatttcacttctctaagcttcaaattctctatcagaaatgttttttctgtagctatctgcttaggaacaaagagaaaggcagcttcctgcatgactcagcttccagcttattattattattattattattattattattattattgttattatttgcttttgacaaagtgaactgaggtcccaagtttttatttccctttcacagagtcaagtttattggtataatcctgctaagaagtacttaaaacaaaaactagctattcacaaacaagtcaaatatataccctctagagtgtgttgataacgtgacttagtacatgaagagagagcatggtgttcaattgtgcaggtcaggtgaagctagtctttcatgcctcatcacaagtagcagatttccattaagaattggcaagctctcaaagctcagactctcccagagcagagcaaacaggcagatgcgaatacatgcctatcccagcagcatctgtttatgccagtggggagaaaccatcccctccacacacggttaaacaagtcagtgtgcagcctacctccagggcccttctcgttttgcctgggaatgtcctgggtggcttgtaggagatgaggatgcagcttggggcagccaaacctggggcatttcagaggcagagtataattcatgtggcaatacctggctctttatggcccgtagttttacacctaccatcctctgcacacagaaaactttaggcagaaatggagcatgcacaaccaggtctgcatatccgagagtggtcatttccttgcaaggcgtgtcgcttgactgaggggactagggggctgcagaggggctggcagatgtttggcttttggtgcagatatgagccaaataaattgaaaataggaagaaggagtacatgacctcacccaaattttaattcccatagaatagttttttgtttgtttgtttttagcgttgtatgcctaatagggtaaatgttattcaaaaaatagcccaggtgttagaaagacaaaatagttgttacctttagggaaatggttgtgaacaaaaggggcacacagggggtgtctgggccactaataatgttctgtttcttgatgtggattcgagttacatgggtgtgtcactttatgaaaattcatcaagggccatcaagggctcggtggctcatgcctgtaatcccagcattttgggaggccaaggtaggcggatcacttgaggtcaggaattcgagaccaacctggccaatgtgatgaaacccaatctctaccaaaaaaataaaaaataaaaattagctgggcgtggtggtacactgctgtagtcccagctgcttgggaggctgaggtgggagaatcacttgaacccaagacgtggaggttgcagtaagtggagatcatgccactgaactccagcatgggtgacagagtgagaccccatctcaaaaagaaaacaaaaacaaaaggtctggcacggtggctcacacctataatcccagcacttttggaggctgagcagactaggatcacctgaggtcaggagttcgagaccagcctgaccaacatggtgaaaccccttctctactaaaaatacaaaattatccgggtgtggtggtgcatgcctgtaatcccagctactctggctgaggcaggaaaatcgcttgaacccgggagagggaggttgcagtgagctgagacggtgccccattgcactccagcctgggcagcaagagcaaaactctgtctcaaaaaaaaaaaaaaaaagaaagaaagaaagaaaattcatcatgctgtatacttataatctgagtatttttcttcatgtaggttattaaaaaacagcagaaatattcttctctcaaaagaaatttctatattttaaaatatgcatatttatactatacatatatttatatttaaattatatatatatatttagtaaggaggggaatacatataacttgatacaaagtctgcactaagttagaatatatctaatgcaaattaatacttgagtgcatattaagatatatcaaaatttaaaaattggtcaaggtttttaagtgctttgacagttacagtaaggtaaggttctacataaaataacatgagtattgtcagcttccaccttacatttccaggaatagtcatttttcatgcattcattatattcttttcagcatcatttgcagagtttttgaacttctaagctgtaccacacagaaatgccataacactcattttgactatttcaacaaagtattataactaagccattaattgatccactagctttgctgttgggaaaatttacttattttgtaaatacagccacattgacttttaaagtcatctaaataagcttgttattaaataaaaatgttttgaaccttaaaactgctttaaatgattttaaataaatggtttatatttttttctcagtagtaataatttttctgaagtatttgcttattgtttttaagtgatttctttatacatatatatgtatatttacatactatgtgtatatattaggcaatattaaatgacctgaagcttttgatcaattctaatagaacagacaattgcaattctaaattagctctcataaaatggaacattttgcaagtagctaataaatatttgttgatcaatagttataccttgaatcctttatctattagaattttccagacaacaaactcatattgtttctcctttaggttcatttggatgtatcaacatagtaactcttgttacaaaaatattttaagtttaaaatcaattatttggttaaattctgtatgcatattttaatagttaatagacaaggtaaaatcagctcacttccatgtgttcaatatttattgcttgaaaattaaggcttataaattagagtatgctaactatgcctttttgttatagatcctcagcgctgttggttgtattatggaatagttaagtataggctctgctctccagacaccaaaggtttaactcagctctgtctttcaccaggcttgagcaccaaaggggaagtcagagaaaaagtaacagcaagtgaaataaaaatagaattctcaaaagcaatagttgaaagacaagaccacagaatggtatgatcaaagtgttgagagaaagagaaacagaaattgagagtttgagaccaaaaggtttttcattaaagcaatctctaaaggatttacttaatttttttaaataaaagaaacccagaagaaatgtctgaggtgtaagaagtattgatcaaagacattaatgaagatataggttaaaggtttttaaaactgtgtaataaaatattaacatcaaaattaatgtgttttaaaaaggagtaaatgaaacaattaaaaatgaagtctgttagaaagagaataatcaaaattacagttttttaagatccttgtattttaagaggatttaaaagagtgattaactttagactttcttaagtatgtaagatagaattccaaagtgcccactttttaaattttttattatttattttttgagacagactgtcattctgtcacccatgctgtagtgcagtggcatgatcttggctcagtgcaacctccacctcccaggttcaagtgagtctcctgcctcagtttcccaagtagctgggactacaggtgcacgccatcacgcctggctaattttttgtatttttagtagagacgaggtttcaccatgtcggccaggcctatctcaaagtcctgatctcaagtgatccacctgcctcgccctcccaaaatactgtgattacaggtgtgagccaccacacccagccttcaaagtgcccacttaatattaaataatatataacttcaaaaccagaatgggggaggaaatggattaagaaaacaaatataaatcatctattcagaaagactaaacaatataagacaataggaacaagtctgtctttcttgcttttacatgtgtgcatgtgtgtgtgtagtctagatacctagatagttagataaatagatatagatagatagataaacagatatagatagatagatagatagatagatagatagataaacagatatagatagatagatagatagatagataaacagatatagatagatagatagatagatagatagatagatagatagatagatagatagatgatagagagagagagagagagtgtgtgtgtgtgtgtgtgtgtgtgtgtgtgtgtgtgtgtgtgtgtgtttagtccatggcagtggactaaatatactagctaaaagatcttgtcaaattagtttaaaaagaagctaagtggtttttttaagacacatctgaaataagaggactcagaaagcctgaatggaaaataatgaaaagagacataatatgcaaataataattaaaggaaaaaccgggtaactataatagcaggtaacaaagacttcaaaaacctttttagaaggtagaaaggatactgaattatggcaagcgattcattttgccagaagaacttagcaattttaaacttgaattcgcaaaatactctcaaaatatataaagcaaaaattgacagaagtgcagggagaaattgataactcaaatatcatagaagaaaatgtggcatattaatttcagaactgatcatttaggcacacgacaataagtaaaaatagaggtttccaccaatataatttaaaaacttgattgacataaagtctaaacaaaataaagaacacacattcttctaagatataaatgaaatgtttaaaacatttatgactttctaggggaaggtatcttaaaaatacttagaactgaaggacaataaataatcctataaataaatattcatgagatgcaagacaaagatagttgtagttattttacactttaaatgcttaagtaaaaaatgagttaaggctagaaactcatagctaaattcaaataaagtaaaagtatgtgatgatgtaagagcagagcttaatgaaataaaacttgaagttatagtagggaggatcaacatagtcacaagttagtttcttgaaaacagaaaatcctccagcaaaattggttaagaaaaaaggagaacaccacaaataatcaatacaagaaatgaaaatggagataattataggtagcagacactttaaatgacaataagagaataccatgaacaaagctggccaaagcatttgaaaatttaggcaaaatggatgaattccatctatagtatatatgtatcagaatattatttttattgaaagatattgtcactgggtatcgagttctaggttgacagttcattatttttttctttcttattttaaaggtgtggtcctactgtcttctggattgcattatttcctgtgagaaatctgtcattgatatgtttgctcctttatgggcaattgtgtcctttttctctggctgcttttaagaatggccttatgatatacctcagtgtagtttcttccattcatgttttaatttaaagccattatctcttcaaatattttcatcactctcccaacccccacttttggaaattcccattatacatattgtaccacttgactttgccccacagctcattggtgctctttccttttttcttttttcttttctagtagcttttttttcctctgttttttattttggatagtttctatcactgtcttcaagttatctaatcttttcttctgtagtgtctaatctgctgttagccctttccagatattttttctttttttaatttttttttttatttcagtaggtttttggggaacaggtagtgtttagttacatggaaaacttctgtagtgggtgacaacccactctttgggttgtctgtttactctgctgattacttcttttgaggtacagaagctttttagtttaattaggtctcatctatttatctttgtttttgttgcatttgcttttgggttcttggtcatgaagtctttgcctaagccaatgtctagaagggtttttctgatgttatcctctagaatttttaggatttcaggtcttagatttcagtcttcgatccatcttgagttaatttttatataaggtgagagatgaggattcagtttcattcctttgcatgttgcttgccaatcatcccagcaccatttgttgaaaagggtgtccttttcccactttatgtttttgtttgctttgtcgaagatcagttggctgtaagtatttgactttttttctgggttctctattctgttccattggtctgtatacctatttttataccagtaccatgccatttggttgactgtagccttatagtatagcttgaagtcacgtaatgtaatgcctccagatttgttatttttgcttagtcttgctttggccatgtgggctcttttttagttctgtatgaatttaggattttttttctagttctgtgaataatgatggtggtattttgatgggaattgcattgaatttatagattgcttttggcagtatggtcattttgacaatatttattctacctatccacaaggatgagatgtgtttccatttgtttgtgctatctatgatttctttcagtcctagccagagcaatcagataagagaaagaaataaagggcatcaaaatcagtaaagaggaagtcaaactgttgccgttcactaaggatatgattgtatacctagaaaaccctaaagactcatccaaaaaacctcctaaatctgataaatgaattcagcaaagtttcaggatacaaaattaacatacacaaatcagtagttctgctatacaccaactgcaagcaagctaagaatcagatcaagaactcagcctcttttataatagctgttaaaaaaaaaaaaaaaaaaaactcaagaatatacctaaccaaagaagtgaaagatctctacaaggaaaactacaaaacactactatcttttgtatttttgtttcagtttcattgagttttactccgatctttgttatttcttttcttctgctgggtttgggtttgctttgtacttgtttctctagttccttgaggttttaccttacattgtctgtttgggctctttcagactttttgatgtaagcatttaatgctatgaactttcctcttagcaccaactttgctgtatcccagaggttttgataggttgtgtcattattatcattcggttcgaagaattttttaatttccatcttgatttcattgttgaccaaatggtcattcaggaacaggttatttaatttccatgtatttgcatggttttgaggattccttttcaagttgatttccaattttattccactgtagtctgagaaagtacttgatataatttcaattttcttaaacttactgagacttgttttgtggcctatcatatggtctatcttggagaacgttccatgtgctgatgagtagaatgtctattctgtggttgttgggtggaatgttctgtaaatatctgttaagtccatttgttctaggatatagtttaagtccattgcttctttgttgactttctgtcttgatatccagtgctgtcagtggaatattgaagccccccaatattgttgtgttgttgtctatctcatttcttaggtctagtagtaattattgtccaaatttgggatccccagtgttaggtgcatatatatttaatattgtgatattttcctgttggactagtccttttatcattacataatgtacctcttcgtcttttttaactgatgttgctttaacatctgttttgtctgatatatgaatagctactcctgctcacttttggtgtccatttgcatggaatatctttttccactcctttaccttacatttatgtgagtccttatgttaggtgagtctcttgaagactgcagatacttggttgaattcttatccattctgcaattctgtgtcttttaagtggagcatttaagtcatttacattcaacattagtattgagacatgaggtactcttctatttatcatgctagttgttgcctgaataccttgttttttgtcaccgtgttattgtattgtatgccctgtgagatttatgctttaaggaggttctattttggtgtatttcaaggttttgtttcaagatttagagctccttgtagcaattcttgtagtgctggctttgtagtggtgaattatctcagcatttgtttgtctgtaaaagaccatctttctttcatttgtgaagcttagtttcactggatacaaaattcttggcttttaattattttgtttaaggaggctaaagatagggccccaatcctatctggcttgtagggtttctgccgagaaatctgctgttaatctgataggttttcctttacaggttacctgatgtttttgcctcacagctcgtaagattctttcctttgtcttgactttagataacctaatgactatgtgctaggtgatgatctttttgtgatgaatttcccaggtgttctttgagcttcttgtatttggatgtctagatctctaacaaggccagggaagttttcctcaattattttctcaagtaagttttccaaacatttagatttctcttcttccttgggaacaccagttattcttaggtttggtcatttaacataagctcaaacttctttgaggctttgttcattttttaaattcttttttctttttttctttttttttagtttgagatggagtctcactctttcgcccaggccggagtgcagtggtgctatctcggctcactgcaagctccacctcctggattcacgccattctcctgcctcagcctcccgagtagctgggactacaggcgcccaccaccacacccagctaatttttttgtatttttagtagagatggggtttcaccgtgttagccaggatggtctcgatctcctgacctcatgatccgcctgcctcaacctcccaaagtgctaggattacaggcgtgagccaccgcgcccagccttaaattcttttttctttgtctttgttggattgggttaattcaaaagcctcgtctttgatctctgaagttctttcttctacttgttccattgtactgaaactttccagcgtatttttcatttctctaagtgtgtctttcatttccagaagttttgattgtcttttatttatgttatgtatttctctagagatttttttgtccatatcctgtattattttttaaatttctttaagttggttttcacctttctctggtgcctccttgagtatcttaataatcaacctaccgaattatttttctggcaatttgaagatttcttattggtttgaacccattgctggcgagctagtgtgatcttttggggtgttaaagaaacttgctttgtcatattaccagaattgtttttctggttccttctcatttgggtagaccatttcagaggaaagagctggggtttaagtcctgctgttcattctttggtgccatggggtgatgccttgatgtggtgctctccccctttccctagggatggggctcactgagagctggactgcagtgattgttattgcttttctaggtctagccacccagtggagctactggactctgacctggtactggggagtatctgcaaagagtcctgtgacatgatctgtcttcaggtctctcagccatggatcccagcacttgctctggtcgaggtagtagggaagtgaggtagactgtgtgagggtctttagttgtagttttgtttagtgcatgggttttcttgaatgttggttgtgctagcagttagttggcctccagccaagaggtggcacttttaagagagcatcagctgaaacaagcttgtcctaagtttgcctgaataggtatttgggcttctcaggtgatgggttggaccatagcgctcccaagagattgtattttctgtcttcagctgccagggcaggtagggaaagaccactgggtggagccaggattaggcgtgtctgagctcagcctccccttgggcagggcttgctgcagccactttgaggatggcggtgtggttctcaggccaatggagttatgttcccagggggattatggctgctctgcagtgtcatataggtttccagggaagtgggggaaagtcgtcagtgactggcctcactcacttcccacacagccagcaaggccagtctcactcccactgcaccccaccgatagcactgagtttatatccaggtgccggtgagcagagctgaggtcttgtcccagactacaagcctcccagctgagaaagcaagcaggactttcaggccccacctctccccacctgctgtagcttctttgctcatatctacactttctgttcaccccctaccccacccctgccccagattgtgcccagaaaaattcatatttggtcaaaattattacaaagttcagctagaagtttccttttccctgttgtctttccccagttccactggcagccctccccaagaacctctatgaggtaaagtcagaaacggcttccctgggcaccaggaatgcctacagggctctttctgctgcttcttctagttttatatttcactgggctctctaaattcatttcagctctaggtaaggttaaattcttctcctgtgatctgaatttacatgttccccagtgagggtatgtgttcagaagtggactttccctcctcacgctttgggcactcacagtgtgaatttcactttgttgagtgtagatatttttatatcctatattatgcttaagctttgttctgggatgaaattaacttattgaaaacagttgatcctttggagacttgcttttagacttcatgaggtgagaccagcacagcccttttctagggctgattttttcccaataatgttataatttccttttgagtactgtacctaataccctgagttacaaggttttgcactcagactggtgggaacatgaattattcttaatctgtgtgagtaggttgttccctcagctcctttcaggtgagttttctctgacccaggttgttttattacacacatgaatttattggtaccttgctgaagacttaagggacacttctgcagatcacttaagttttctctctgtacagctctctcctgtctggtattctgttctgaagaccctagactaccaactctgtctcctcaagtaaggagctcaccaggttcctaagtttcccttccctgcactgagacccagaaaattttatcaggcagtaggctgaagcaattgtggggttcacattgtttgtgtctgtctctcagacataactgccctgccctgcctgatctctatgactgttttatatattttgtccagtcttttagttgtttcagacaagagtaagtcaaatcctgctactccttctcggctggaagtagaagtttctagtcttatgatttttaactgttgtcagctaattaaaatgtaaagttttataaggacttcataagtgtatgcaaatgctcctaaggctttcctggatgtcagtttaggcccccaggcttcaggattaatctttaattaatactctgagtggagacagggaaaagaagggtgaatgaagtttctgtggtctaagaaatcccaatagacaacttctggagaaatgacaagagagggacataagcaatcaaaaagaagggcgaggccgggcacggtggctcacacctgtaattccagcactttgggaggccgaggcaggcggatcacgaggtcaggagattgagaccatcttggctaacacggtgaaaccccgtctctactaaaaacacaaaattagccgggcatggtggcgggcgcctgtagtcccagctactcgggaggctgagacaggagaatggcgtgaacctgggaggcagagcttgcagtgagccaagattgcgccactgcactccagcctgggtgacagacaaagactccgtctcaaaaaaaaaaaaaaaaagaaagaaagaaagaatggggaggggacatatgcatctccatctcaactctctaaaactaagactcagacagagattttggtgaaaaatgtgtgcctaataaaatacttgctctaaaaattagattctagatattatctgaatatgtgccagtcactattctaagcattttacatatgtggatgtatttaattctctgacaactgcataagtaagctattatcatctccagtttatggataaagaagcaggctaagcaaattccccaagatcccatagttaaaaaatggcatggctcagatttcaatccaggctctgtaactaatatattatctgctaagaatatcagtcttatcatgtttagttctctggcttaaagtccacaacataataaaagtgaattgtagatgctgagatgaagatattaaatgtaaatacaacaaatacaaggaaaaataaaaactgacaatttgtttaaaagggcaaggacatagaatcctctgaaatagacattgcactgagaagtctatcactagcatattaaggaatgaagactcagataatgaacttgctgttaaaaaagcaaacctctgttaataacttttaattaaacctttgattatatttttaaatgttttttatttcttaaaaaacagttttgggctgggcaccgtggctcatgcctgtaatcccagcactcgggaggccgaggcaggtggatcacctgaggtcaggagtttgagaccagcctggccaatatggcaaaaccctgtttctactaaaaatacaaaaattagccaggcatggtggtgcacacctggtagtcccagctacttgggaggctgaggcagaagaattgcttgaacccaggaggcaaaggttgcagtgagccgagatcacaccactgcactccagcctgggtgacagagcgagactccttctaaaataaataaattaattaattaaattaaataagaaacagttttgcatttgaataattctgacaccaaaataatttttatcctggaatacactattcaatagtggtaaactttgttatatggaaaacatttcttatttctgagcaatatcaggtaaatgaatcaggaattatttgaattagaaggtattgttactaaccccctcatacctccaatgtactaaaactaatacatcttaaaattccttttaatcatttaatttttcttttttccaaaattttccccacataaataaagtagaatttagcctcttctacttcaaaaataaagtattttctaacaatgtttatcattataagtttctcagggctcaaatgtagaacatctttttgatagcttttcactctttccccaaacatatcccagttttatgagaccaagtacaaatatcttcctgtcacacatcatcaggagaatcttgccaggtgcagtggctcacgcctgtaatcccagcactttcagaggccgagacgggcggattgcctgaggtcaggagttcgagaccagtctggccaacatggtgagaccccgtctctactaaaaatacaaaaaaaaattgctgggcatagcagcaggtgcatgtaatcccagctactctggaggctgaggcaggggaattgcttgaaccaggaggtggaggttgcagtgagccaagattgtgccactgcactccagcctgggtgacagagcgagactccatctcacacacacacacacatacacacacaaaatatggataaaatatctagtgtgagaggaacagcagaaggagaaagtaatgtcttgaggaaggtgcgaatcatctgtaaatactttttagagtaatggaattcctagacagacagcttcgcaggcagtattgccattcagtatcattggcaaccttcctaaaaggaaaagagtaatgttaatgccatttctgaaggtatgaattgaggattttgattctttttccataaatacttaccttgtgaaaactcctctgcaatctctactgtcagtaagttttataaatgctgtatacaagtcttcaattcaccattgcctgcttgaggcttatttattttttgagaaagaagctggagaagtcatttgaaaattcatgggtagttcactcttcaaggttgtggtgtgctcttcaaatagctataaaaatttccaagagacaggaccactgaccctgcgcttcgtagcaaatagctttacttactcattatctgactagcgtattagttaatcatgtaaacaattatctttcttttcaggtggcaataattcatggcatctcctcccccttccaccccacacatatacttatttattgtcacagcctgatttataattgttttttaggatttcttcatatcctccctcctacctttacccctgagttcagaaaataataaacactctaaatctccaagcaatggaactcttctaagagttaagctaaagtctatcctaccaccttgctatattaatgtcagctcatttgatgtgtctgtagagcaggatttgtttggcaagctttttctgtaaaggaccagatagtatttcaggctttttgagccatgtggtgtcggtcacaacttttcaactctgccatcatattgtgagagcagaagtagacaaggtatgtttaaaaaaaaatgggtatggttgtgctccaataaaatcttttttatagacactaaaaacttgaatttcatgcaaattttatgtgtaaggaaataattttttaaaaatctcttctttaaccttttaaaaagacaaaagccattcttagcctgtgggtcgcacaaaaacaggcagcaggccatgggccatagtttgccaacccattatctaaacggttaacagaatgcttactacaggttttctgaccctcagcactagtaatactttgggacagataattctttgttgtggactgtcttttgtttttgttttgagacagcatctcactctgtagcccagactggagtgcagtagtgcgatcttggctcgctgcaacctccacctcccaggttcaagcgattctcctgcctcagcctccccagtagctgggattacaggtacccaccaccatacctggctaatttttgtatttttagtagagatggggttttgccatattggccaggcttgtctcagactcctgacctcaggtgatctgcccgcctcggccccccaaagtactgggattacaggtgtgagccaccgtgcctggcctgtcttttgtattttaagatgtgtcatatcatctctggcctctgcctactaaatgccattaacaccctacatcccccaattgcaacaactagaaaatctacagacattgacaaatgacctttggggacaaaattgcccccagttgaaaatcactggtctaatacactgaaaacttagaatacaccgcataaaatatgagctggtaggctgcgtagtataagatagcgtcatgtgtcacctgagagatagccattggattctcatgcttctaatgtagaaaccataataccgtggtcttccccttacctacagtttcattttctgtggtttcagttaccagagatcaaccaaagtctaaaaatattaaatggaaaatttgaaaaataattcatcagttttaaattgtgtgctcttccaagtagtatgatgaaatcttacaccatcccaccagagacttgaaccagccatttgtccagcatatccacgcggtagctgctacctgttcctgagtcacttagtagacttctggattattggctcaacagtagaggtattgcagtgcttccattcaaaaattccttactttacttttattatggtatattattgtaattgttctatcttattagttactgctgttaatattctattgtgcctcatttataaattaaactttacatagatgtgtatgtattggaaaaaaatatggtacagctgacccttgaacaacacagatttgatctgtgtagtcttcttttatgtgttttttttttcaataaatacagcaggccctccatatcaatgggttctgaacctgcaaccaaggcaagacacaaatatagtattcacaagatttgaaacccatgtatatagagagctgactgacttttcatctgggagggttctggatggctcacttccatacttgaatgtgctcggattttggtatagaagggggtcctggaaccaatcccccatagatagcgagagatgacggtatacatagggtccagtattatctgaagtttcagacattcactggggctctgggaatgtataacctgcacataaaagagaatttccgtactacctccaagttaataaccactgaagaaatcctaggcttaagagagcccgttattggaacttagatggtggcgttagagtgcttatgctttggacttaggagtcagtatcccttccccccagctttgtctctttctatattcctttcccatttttcctctttccacctccttacactcaaaccatacagtgtgcacctgacagtggactacaaagattaatattcgatgaaaggactttgtccatttgaccagaccacttgaatgatgaggtgggagccacagaatacatagttgatattaaattaagaatctaggccagacccggtggctcacacctgtaatcccagcactttgggaggccgaggcgggttgatcacttgaggtcaggagttcaagaccagcctggccaacatggtgaaacccgtctctactaaaaatacaaaaattgctgggcgtggtggcaggtgcctgtaatcccagctacttgggagtctgatgcaggcgaatcgcttgaactcggaggtggaggttgcagtgagccgagattgcgccactgcactccagccggggcaaaagagcaagactgtctcaaaaaaaaaaaaaattgagaatctaaattaatttatagaaatcctttttccataaatttatcttttctccaagttttcttctgatatgcaaagtgtgagacacctactcttagcttttagatagtttacaggccaatgacacacagtagatgatgttctgccatgatgtctcaaaggcagagaaacattcttatttttatcaacactttctcatccccatctttaaattattggtataaacaaacttctgcttctcactttagattataattttatcattttttacaattcatcaaagaaagtttttctaaattgcacggaaagttctatagaatgctgagttatgtattctaaagaatatttctccttcccattttttcatagctaaactgtcaatatttttaccttaacttcctacaaagtcctatagctatttgattacttgatgtttcagtataaaaaaaaattaggtcaggtgtggtggctcatgcctgtcatcccagcactttgggaggccaaggcaggtggatcacctgacgttaggagttcaagatcagcctggccaacatggtgaaaccccgtctctactaaaattacaaaaattagccaagcctggtggcaggcactggtaatcccagctcctcagatggctgaggcaagagaatcgcttgaacccgggagacagagattgcagtgagctgagatcgtgccactgcactccagcctgggtgacacagcaaaacttaatctcaaaaaaaaaaaaaattaataatgctgcttctgcctgaaatacatgatttccagtgagtgaaggaccacttgctctactgaagtaaagctactttactcaagtctctgaaggagtaagagagtcctgcagggcacatttgaacagctcactttcagatacaagtgataaaaaatggagcctcagcaacaacaacaaaaattataacttttaaagagatagaacaacatggtttgaaaaggaatctggatttttgcctctggttgctgtcattgacagggaaagtcttatattttctgaacttgtttttaaatccccccaaatagagggattagactgtgtaattccacaaatccgttgattttatgacctggctatagcttgggaaagcaaccacatagtaccgttgttacactccagagctattcaaatattgttatcaaagtggtgccaaaaatttctaatcaaatatttggaagagtttggtgatgagtcgaaagtagcctgtatgtctctgaattctgtgatgtttctcatttttcctccccgtacagtcttcataggtatttagacaagtaaacacctgtaaaggaagaatgtgggcaataagaatgaatataaatgataaatcacataatctgatgtaatgaaagacttaagttattacagaaaacctagaattaaatgaaatatttaaaaagtgatgtcttcaggaagtctacagttcagattcaagggtggcaaatactgtccatggagaccagtagttctcaggagggtgactttttttctccaggagacatttggcaatgactggagatatttttacttgggcatgttgttgatatctagagagtagaggccacggatgctgctgaacacctccaatgtgtaggacaatgccccgcaacaaagaatgatctcgcccaaaatgtcaagaatgccaaaatggagacaccctggtgtagacctatgatagctctgacttctttttttttttttttttttttttttttttttgagacagagtctcactctttcacccaggctggagtgcagtggcccgatctcggctcactgcaggctcgatctcccaggttcatgccattctcctgcctcagcctcccgagcagctgggactacaggagcccgccaccatgcccggctaattttttgtatttttagtacagacggggtttcaccgtgttagccaggatggtctcgatctcctgacctcgtgatccacccatctctgcctcccaaagtgctggagtgctgggattacaggtgtgagccaccgtgcccggccgatagctctgacttctaagtcaactgtgttcatcagtttcatatctcccctcttactttccaccatcacaaaagcctctgcctcctaccaaatgttagtaaatgcagtgaatgttagcaatctatttgaaacaaggtttcttggcattcatctagctgtatggataaagttttaccagcacaaactctgtatgcatggggtagactggatcagacagagcaatctgaaccacaatgttggatttccttcaagcttgagaaatattaatactaccatatatacaggcggggcatggtgggtcacgtctgtaatcccagcactttgggaggccaaggcgggtggctcacctgaggtcgggagttcgatactagcctgaccaacatggagaaaccccttctctactaaaaatacaaaattagccaggtgtgggggtacatgcctgtaatcccagctactcaggaggctgaggcaggagaatcgcttgaacctgggaggtggattttgtggtgagccgagatcacgccattgcactccagcctgggcaacacagcaagacttcatctcaaaaaaaaaaaaaattaccacacatactaacaatatgaaagttctaattcatatttaaggaaacatctgcttctacatgtgtttctatctgtggttctgaaaagcaaatcctaatttttatgaatgataatttctgggcctctttttgtctttccccagatgttccctgctttgttgcttaagagctgcatggcacagaccataaaggttgtgagctcttcccatttcaagaaaccctggggagattcaaataaacaaattcaaaatgccccttagagtctttaacagaccagaattagtacgttgtttgtttgaaaatctttctttttttcggatataaaactatacactcaagactaaatggaggcagtacaattacacattttgactgaattgtctcatcagtaaaagtatcacctggctaattgtaactctttagaattggcctaaactagaaaataaacaaggaccttattcaagtatttcctattatgttacatacatacaagttaccaattagaagttgatatacactattttgtttaaaaataaaattcagcaagcttctgatgatttattctgttcttgtttttcttaccagttttactgccaaaataaactccttctcatacaaagtctgggattataccacagagttactataattggattcaactttaatagaatattacaatattaattttaatagagtatggtttcagatattaaaaagattaatgtacccaaaaacataatcattgttttgttttttttttagacagaatcttgctctgtcacccaggctggagtgcagtggtgtgatctcagctcactgcaacctccacctcctgggttcaagcgattctcatgcctcagcctctcaagtagctgggattacaggtgcatgccagcatgccaggctcatttttgtatttttagtagagatggcattttgccatgttggccaggcttgtctcaaacttctggcatcaagtgatctgcctgccttgaccttccaaagttctgcgattacaggcgttgagcaaggcattgagccaccccacctggccacttcttttaaattgcataattttcctgttctctatttcatccaatctaaaataataatgagttttaaatacttatttttaacattttttttacacctatgatttgagaatatatatatattaggccgagtttcatttttgttgcccaggctggagtgcaatggtgccatctcggctcactgcaacttccacctcccaggttcaaacgattctcctgcctcagcctcctgagtagttgggattacaggtgcccaccaccatgcccagctaatctttgtatttttagtagagacagggtttcaccatgttgtccaggctggtctctaacccctgacctcagatgatccaccagcctcggcctcctgaagtgctgggattataggcataagccatcatgcccagcctgagaatagatttttgacatttttaacttgattttccgagaagaaaaaattacatatttttaaaaataataaatacattgaaatctagattttaaaacatgtttactttctctcaaatttgttagaaatgtcacaacaaatagctttttcaacctatgaacagtatttgtagaagggaaaaatgaggaagaaatgggcacatttttctagtgattgaatggtggtgtctacatcttgaataattctcactgcatatcgttgcttgaattgtagatctgtatggcatgtgacttgcctgggtctatgatgttgtcaacagaaagagtcaaattctgtaaaatatttgaagagatttcttctgagccaaatatgagtgaccaatggtcccgggaaatcctgaaaacatgtgcccaaggtggtcgggctacagcttggttttatacattttagggggacataagacatcactcgatacatgtaagatatactttggttttgtctggaaaagcaggacaactggaagccaagggtagaagggggccttccaggtcataggcagattctcatgatgttgcccagatgtcctattgtaatttcaattggttgagtttatctaaagatctggaatccatagaagggagtgtctggattaagataagtggttgtagagaccaaggctcttattatacaaagcctacaggtagccggctttggagagaatagattgtaaatgtttcttatcagacttaaaaaggtgccagactcagtgaattctctcctggattagggaaaagacctggaaatggaaagggattctctacagaagttagatttttccccacaagagacagctttgcagggccatttcaaaaattgccaaagaaatatattttaagacaaaatacttggatttctttcaggacctgctatctgtcatgtaatgctatactagagtcaggctggatttgggtgtcttattgctacagaaagtcttaagatctctattaatgttaatgctggtcagctgtgcctggattccaaagggaggagggtataatgaggcatgtgcaacccccactccccatcatgacctgaactagtttttcaggttaactttggaatgcccttggctgagaggagaggccaattcagatggctgtggggcttaaaatgttatttttggcttatgatgtggaggcagaagtaacctgtatcactgttgtgccaaagtctctaagagctaatgtgcagttcaccaagttgtctccctatgagagtcagccatcactgcaaacagcaacactccaggttgattgtggttctgtcagcttcatcctgcaccccagagtaaagatgacatagtggggagcctgtcttacaatgagcatatagcagatgcaagaaataaacatttgccttgttaagccactaagatgtcagggttgtttgtcctgcagcaaagcccagctcatcctgactgataaacttatccattcaagtgatcagcttttggtgtaaatgcccctaagaaaactgataaagcggccgggcacggtggctcaagcctgtaatcccagcactttgggaggctgaggcaggcggatcacgaggtcaggagatcgagaccgtcctggctaacacggtgaagccccatctctactaaaaatacaacaaaattagcctggcgtggtggcggcgcctgtagtcccagctactcaggagactgaggcaggagaatggcataaacctgggagacagagcttgcagcgagccgagattgcaccactgcactccagcctgggcaacagagcaagactccatctcaaaaaaaaaaaaaaaaaaagaaaagaaaagaaaactgataaagcctgatgcactacctacctatgccttgccaaagaatggtaataatccaaaaactgtttaatttagaccttcactatgcaatgcatattttatctaggaacacttttactggtatcagtgatcaaaattatagagcagggggggaaatgtgaggaaacaaatctcaaatgtcaacatacgtggggatcttgtttgcagatgaggaagtgcattctcaaagctgtgtgaattgtcctcatcatacagctattttcattgtattctttcacaaaaatatgtatgtggatggattcttaggtgttagagacggggaggaaagaataaaggagactcaaggcataggtggaaaccgtgcatacagatggtatatctttatgtgttgagcatttatatcatgcatctgctaagtactgcaatggaaacaaggataagacgcacagacttccctaaagaaatgtaaaatctcaatgacaaagaaacatgtgaagaagttagtatcttaagcaaaatgatgcaattcatagtaggccactgtgtactggaaaagtaagggctattctattccaaagtgtgatttttttattgggtgagggggacctgagaaagcttcatggagggtgtgatagttaatactgagtgtcaacgtgattggattgaaggatgcaaagtattgatcttgggtgtgtatgtgagagtgttgccaaaggagattaacatttgagtccgtgggctgcaaaaggccgacccacccttaatctgggtgggcaccatctaatcggctgccagcacggctagaatataaagcaggcagaaaaaccttgaaaagactagactggcctagcctcccagcctacctctttctcccatgcttgatgcttcctgccctcaaacattggacccctggttcttcagttttgggattggactggctctctttgctcttcagcttgcggatggcctattgtaatcatgtgagttaatatttaataaatttccatatatatatctattttattagttctgtccctctagagaaccctgactaacagagaggagaggatatctgaactaagcctcagaggaggatgaatggcaaggagaagaaacatgtctccaggaaactgaggcctgagggggtagtaatttttcccgagcatatgataaatgacagtgatttgggaagacttcatggcatgaatgtatgtgagaaagtgggcttgcgagagcaagattggaggagttggttatggaaaggcgagtaaccagatataggctgatagatggagtaagcatagagaagggcattgttttgtttgcttgttttttttaattttttaaatgttttatagatatgggagtcttactacattgctcaggccggtcttgaacttctgggctcaagggattctcctgccttggcctcccaaagcactgggattacaggtgggagtcatcaggccggcttttaaagaagggcattgcagtaggaatagaatgaaaggaagagatgaatgaatggaagagatatatgagccatttcaaaataagaatcacaacagtggaactgagtggctgtggataaaagctaaaagggttaagtcagggttgggaccaacagaactagaacaatacttgtattttggcccagatgacaagggctgaagggcatccagtgaacacccagaaactgaggacgctagactgaagcccaggggaaaatccaagctagtgaggtttttctcttatgagttatgggaggagcaacttggagggaacacttattgattgcatctcttgtaatatccacagcaaaggcatatgaggcgaggctagggaaggagatagaggaggagtgtggtcagagacgcaaaaggcatcaaataaagctgatgtggaagagaaccaggacgctcattgtggtatgaaagtcaagagagagagcttcagggaggtgggggattcgcaggtttaaggagaaagcaaagagaatgaggaccaaggaaaggccattggatttgaagtttgagattttctttctttttttttgttttgtgacagagtctcactctgtcaccagcgtggagtgcaatggcaccatctcagcttattgcaacctccacctcctgcgttcaagcaattctcctgcctcagcctcccaaatagctgggactacaggtgtgtgccaccacgcccagctaatttttgtatttttagtagagatgaggtttcaccatgttggccaggctggtgtcgatctcttgacctcgtgatccacctgcctctgcctcccaaagtgctgagattacaggcgtgacccactgcacccggcctgaactttgggattctcttggtggttgtagagaatgcacttcattagctttagattctgggacagtcacattataaaagacaaggggaaataaagagggtatacaggacactggtgtatactgtccactccagatcagtggatgaagaggatctgcaccctaaggggacagcagatttatcccattgctttgttgtgttgctttgtcgagatgggagatacctgaaagcagaaggaaagcaacataggaagacgctcaaaaataatgattttcttaaatgcacatgataatttatggctgacactgacattttctcagttacctttcataataacattagagaaatgacataaggttgcagagtggggggcagtgggtttcttctgactccacttcggttcccttcatagcatgaacacatttgtaagggagaaaacgaggcaggaatgatgcacattccgagggtgggagtgaagaattaggagtcacaggtaggttagcatgtggaagagaaggtgactgaaaccagaggcagagaggagaaagtggactgagatttacatgttttactccctgaagagactagcagtccctatttccaccaagggcagaaacattcaaacattctgcatacctttccttttatgcatgaaataaaatactggcatttgaaggaagaggttgataatgtttatttcttagaacattcaagcttggcagttatgtgacttatctctagagcctctcagaagtctctggggacgcaggagtctttggagactcacactttctgcaaaagtgcagaaagaaatacaattacttaatgaatacctactgtgtactcagcaaatcctttatctgtcacttgtgttaatttctagaaattacataactaagagtctccatgaattgcacttgttttcttaagagggaaagagaaaaaaataccttctttccttaccatttaagccagtgctttttaaaccaggatctgacactccgtaggtgaccatagatgtagtatcacagatccgtctgtttccaaaatgttacattctgattttaagatcccctgaaagttgaaatttctcttttgctgcaacaactcacacttgagaaaaattttcacaggagactttattttcttaaagcagagtttgttaatatgaattctcacaggactgtggcaattcatttttcttttaatgcgttcattactctagaccaagacatcaatttttgtgcaaaccttgtttcctgctgccacctggtggaagccacataagagttttacagaggctttggtggtgctaggagaggggccagggctcttcctcagtcacagaatcccacacagtgatcaaagagcagatctttctattaaactccctggcagcaaaacagtagaggcttggctctctgccccgggactgtgcagaatgtcacaggtcggaagcccagagcatttttctcttcttttatctttagactcttgtggctctcagaccttgaatataattctttgctgaaaattctttaaaatcattatcttttctttcttccttttttctttctttcttttttctttcctcttttttgctatgctagacaggaagaaagaagggaatggcattttaatgtaaagaagattgcactgaaattatattacttgcttaattgtattaattcactgcaataacaatttaataatatgacaggtcatttacatgctaatcatttgggtctcttgtccagagaaatcatgaggaagggctgggaagtgctcttattatgatcaaaataatccacactctcctagaggagtgcataggtatagaactgacattgtttgtttaataaagtttcattcaaggcaatttggctggttcttttatcaagtgtaatgggaaaacaagccagtcctgatgttaaacactccaatgatccctcaagctttttattctgtaataagttttacagcattatgtgttacccacgacagtcatttagtcggtcaatttcaggctagtgataaaagtttgagtaatgggaaagctgtgttgatgttccatattctttgtgagatgtctatgaattaatgctcccaggtacacactcaatttatatttaacagccattactaaatgtaatatctaagtaaaacccagttatgacctatatatatggaaaactaattaaagctgttggaaacaacctatttccctttggattatttatgtaaatacatcgaggtctaaaaattcagtacaagtcagatgtgttcctgcctagggctattatataaagctcagaaaattttatgagaaaaatgatgattcttaaggattgagcttcaaatgtgaatttttctattttataaggatatagcttgggttgttaagcatcaacatagcttttcaaaatagttttttattctcacaagtttaaaggccttgtaaaatctcttctattaaatatacatatatacatacatattacatatacaccaattgactaacccctctaagtgctgtatctgaactaattttaaaagaatacccgtgtttttcagctcccaaattgaaaagattattagttagtaccgtgatttctgaacttttaatcaaattttcattcattttataattttgaaattttgacaatctgagaatcttctatgattaaatatattctttcttcctttcttttttctctttcccttccttccttccttccttccttccttccctccttccttcctgtcagtctgtcttgctctgttgcccaggctggagtgcagtggcatgaacatggcacacttcagcctcgaactcctgggtgatcctcccaccttggcctcccaagtgttgggatagcaggtgtgagccaccaagcctggccttataaccaattaaatgaaggaaatgatactatgacacagacaaccatttttcaatcaagttattctgccatattaaattttcagtcacctttctattgcatttattgaatttctactttttaccagttctaagcctagatctgtctctcttaaattattaaatgtcttattttcttatgaaacaaccttcagatgtaatacacagaagaaaaaggagtctcaggaagtttagtttgcccaactagaaattgagcacaattacttggtgtgttgagggggatttgaaactatgtccttatgataattgatagttatgataattgatgacaaaggggttttagaaagacctcttttgcttttagaaacacttctctttgcactttctttaatgcccattttttagttttatgaattaaataatatacatttatttaaacaaaagtatcaacatttctcaagtatctataggttacttatctactcaatgcaactaacaatcaaaaactagtgctccaacaaattaaattttccaaacactgaaatattgatcacaatgtctctaagcatttcattgaaataaaaattttgatgtatctaattttcctaaatattttaaatgcatttcaatatgcaaaactctcacaaaattgttgtaaatacaaaggtaatcagtatttttagattaaaatcagttataaatgtgctaatatagtgaatgtgacccttgtccggactcacatttttcttcttagtcttttcctgggttatattcttaacatatcagctatttttctatttttatagcttcttagggttcaaaaatattaccatatccaaatgaaaactaactacctgagagcagccaactgcaggatctgtgtcaggatccagctgattcttggtgaggacacagatccaggtgtctaaggagattcagacactagccagtcatcatcagattaagctgcacttaaatccacatatatcaaattgtttttttttatttttacaatggtgcgttactaccatgatgtcttcacaactgatttgagcagtgttgcaaatcccatttcattatcccatcgttgtgatatatagacttggcctgttggaataccttcttggaaatttaaaaaaatagtttattaagattattagggccattgaagaatttcctcctaggagataatgcattgagtctacctttcagtcctcctcctcagaacacgtgcccgaactatcatttttgagatcaccattgatttctttctacagcgtggtcactggtaccaataaaatgctagtcttcattcctatccagttattatgtggggccccatgttgttagtctttctgatttcattatgatactaagttttaagggaaacttgacttcctatttttgtgtctattgtactacccactatagcgactatatagtaaggaatataaatttgttttcataggaaataaaatacccacatatattaaatccccattaaacataccctatttcatttacccttctttaaattataactatctttttatatggcttatattaacttttctctctcaagcatcattttaagctaatgacctttcagactagacccaacttctttcagtcaaccataattcatgctcactttctccctctctctcatcaaatcatcgaaatttgatcagcaggaatctctttaacttgactccattgattttttagtgttttagtacagtctccaacattcttaaaaacatatttgttttctagcaataacaagatgtcccagactcattccaatttgttttgttttactgccccaaaacatggaatcagcttccctaccataagtagtaaagagtagtagagaatactattaaagtccaaaatctgggaactagggataaacaggagagttgatggtaagtaaaaccagtgctgctgcttaactatatttactaatgtcagagatggaaaatacaagttattttaatgtcataagctcacagtaattttttccaaataagattatatattgctatgctctacttttctcaaattatgtgattttattgaaaatgaaaacttttattttggaattgaaatatttgaccctcttctttctgcttaggggaattatttggaaagatttcttatgcctagttctgtagggttccaaaccatgtatactttcacaaaatgcatgtgtgcaatagcacacatgctatttccagcagcaagttgaatccttgtatctagcactgatggtcaatatgttttgcattttgctttcccacctccaatgaattagtataaactatgaccttcattgatatttctttagtttttatatttgtatgaatcagctacttcaaacccttaataaaatctacaacctctccaataaacccaaagttactagatggaaggaaacaaagattagagcagcaatcaatgaaatagaaacttaaaaacagaaaagatcaacaaaactacaagttggttttctggaaaaaaataaacaaaatcaataaaattttggctagactaagaaaaaaaaagagaagactcaaataaatgaaaccagaaatgaaagaggagacatcataacctataccacagaaatccaaaggatcacaagaaactgttatgaacaattacacagcacacattgaataagctaaaaaaagaataaattcttagtctcatagaacccaccaaaactgaatcatgatgaaacagaaaatctaaacaaaccattaatgagtgaggaaattaaatcaataaaaagcctcctatcaaagaaaatcccaagacctgatagctttactgctgaattctaccaaacatttaaaggataaaataccaattttttgcaaacttttaccaaaaaatgaagatgaagaaacattctcaaactcattttaccaggccagcattaccctgataacaaagccagaaaaagcaccacaagaaaaaaaattacatgcccatattcctaatgaatatagatgcaaaaaccctcaacaaaatactagcaaactgaattcaacagcatactaaaagaatcattcatcatggtcaggtgggatttatcccagagatgcaaggatggttcaatatacaataattaatatgatgcaccacattagcagaatgaaggacaaaacccatatgatcatctcaatagatgcagaaaagtcatttgacaaaatttaactttctttcatgaaacaaacactcagcaaattaggtacagaataaatgtatctcaacacaataaagagcacatacaacaagcccatagctgacatcatattcaattgagaaaagttgaaagctcttcctctaagattaggaagaagacaaggatgcccactcttgccatgtttattcaacatagtactagaagtactagccagaacagttaggcaagagaaagaaataaaggcatccaaattggaaaggaaaaagttaaattgtctctgtttgcagatgacatgatcttatatgtagtaaatcataaagactccatgaaaaaactgttagaactaaaaatgaattcactaaagttgtaggatacaaaatcaacatacaaaaatcaacagcatttctatatattaacatgaattatccaaaaaggaaataaagaaaacaatttcatttacaatactaaaaaagaaatacttaagaaaaatttaaccaaggaggtaaaagtttataatgaaatttataaaacattgaggaaagaaattgaagaacacaagtaagtggaaagatatcccattttcatgaatttgaagaatattgttaagaattcagtactacccaaagtgatctacagatttaacataatgcctataaaaattccaataacattttttacagcaataggaaaagtaatcctaaaattcgtatggaaccacaaaagaccctaaatagctaaagcaattttaagcaacagagagatatcacatgacctgattttaaaacctaccacaaagctatagtaataaaaacagcatagactagcataaatacagacacatataccaatggaacagaataaagaccccagaaataaattaatgcatttatggtaaataggtttttgacaaaggtgccaaaattatggggaaaggacagtctcttcaagaatgtatatccatacatagaagtgtgaaactaggctctcattttacaccatatacaaaaatcaattccaaatgaattaaagacttaaatgtgacacctgaaactgtaaagctactagaacaaaacatagggaaaatgctctatgatactggtctgggaaaagattttttggctatgaccccaaaagcacaagcagcaaaagccaaaatagacaaatggaatgacatcaaactaaaaagcttctgcacaacaaaggaaacaatccaacagactgaagagacaacctatggaatgagaggatgtattcacaaaccatacctctgataagggattagtgtccaaaaggtataaggaattcaaataattcagtagtaagaaaacaaataacttgatttaaaaatggacaaaggacctgagtagatgtttctcaaaagaaggcatacatgtgccaacaaatatatttaaaaggtttaatatcactaatcagggaaatgcaaattaaaaccataagataccacctcaaacctcttagaatggccattatcaaaatgataaaagacaacaagtgttggtgagaatgtgaagagggaaccattacacattgttggtagaaatgtaaattagtacaaccattagggtaaacagtatggaggttcctcaaaaaattaaaaatagagctaccatatgatccagcaatcccactattggctacatatccaaaggaaatgaaattagtatgtagaagagataagtgcactcctatgtttaccgcagcattattcacaatcgctaagatctggactcaagtgcccatcaacagatgaacaggtaaagaaaatatggtatatatacatgatggaagcttcaaaaagaaggaaatccagccatatggatgtacctggagaccattatgttacataaaataaactaggcacaaatcaagtatcctatgatcccacttacatgtggagggtaaaaaagttgaagtaattggaacaaagagtaaaatagtggttaccacagagactgggaggtggtgggattaggtagatcttagccaaaggacacaacatttcaattagacaaaaggagtaatttcaagagatctattgtacatcatagtgactacagctaatgacaacatattgtgtatatgaaaattgctatgagagtggattttatgtttccattacaaaaaaagataaatttttcagataacgcatgtgttaaatacctttatttagccattctacaatgtgtactgtgtatgtacatgtgtatatgtatataatctcaaaacatcatgttgtacaccatacatatatacaatttttacttgtcaatcaaatagtttttaatttttaaaaatttacaccttccttttggaataaatatcccagctctcaaagctgataagtaatgaagtaaggatgaagctacctgatttggctgatgtatggtccagagaaggcgatgcatatgggacaaaatcatgaattaaaaaggcaatttttctttagattaaaaaatgtcaacaaatagcaatgtttgttattctaaggaaaaattatttatgatacatgaaaacataaagaacatccaaagctgagaagtattctttcttcattctttttatagtcttcatcttaagtgacttcaatacataccatttatcagcatgtctgttacatcttatattgaactgtttccatggaacatctccatgggtcagactgtagcctcaaagatactacaagcaaaagagaatccagcagtgtagtgggagaaggaggaaaaccttccctgactgcttggaaattgatgtatttatgacatgaagaagttaaaagactaggccaagaggcacaggatccagataaaacaacttccctcgggttccagagacatgaaaataaagaatttatagttatcaggaaggaggtaatttgctgaaattcccatcacagatccaaaaacgaggaaggaggcagacatgtgttaatagctccgaagtggcctggaagtcttattttgccagtgatttaactgaagatcaaatacactcatgtaaggaaagcagagaaagcttgcataagtctctggcctggacctggaaacccagtctgctttatttccttgggggagcaggtttcctaattcttccacgacatttgttggttaaatgttgaccaacaaaagcagaatgttacattgtgtttgatgggaggggaaagtccttgttttctatctagtctggggaatcatacatcaatccacacaggaatatgcatcaagtgtttccatcttaatgagtggcatgattccagaagggcaacaggccaggagagctctaaagcttccctgaaaaaatggagaggctggttgtgttttgttcttgccttggatggatgaagaaatggaagcaggtgccccattgggaccatggatcaaatgcacttaggaacttaaaggaaagtctaggggctctgagtgaaccagcacctcctgccctgctgggggttagaggcttcactggctagtccgaagcctagtggttttgagtaagaaaagaacttcaaaacattttactgtgatttaaaaatcctccatggtgagcatgcccagcttttgttctctcgatgtacctccaatctctcaagaagacataatttagtaacgctggggttgctgctactataaatgctttgattaacattagaggaagaggacgacagaaagcagcttctgtcccagccaattaaagagcttgtttaaagtatgaaaatgatttattagacatgcaaagagggttgcaaagaagaaagacacacagtctcaatttaaaaaaaaaaaaaaaaaaaacaaccacaaagctttggtccaggtgcctgccttctgacaacacagataaacagtttagttgataatcccccacatcttcttcttcagcacagcaatttgttccagttatcatactttctaaatagaataaaagaaaatgatgctcctttataatatatatagggtttagataaaaataaatagcacagtccacatgctttaaaccaaagattgagtctgtgtgaacagaaataccagatagctgtttgatacagcatttcccaaatagatatatctgagagctctgctaaaaaaaaaaaaaattaaatttttttaaaaaggaaagctagaaaaaataataataaatagagccttgtgatcatatatgtgcatcaacaccggctatatactcctttcggaaaatcacaatgtacgtgactcttgcagtaaagaaatgtgtttaacatttttacatttttaatacagcatttctcatacatatttgactgtagaaaccttctctgatatgacgactattgtcattccctagaattagtattctgttcaacatacttggaaaatacttaactagccaatctatttacaatgggaagagctataaagtccctcagtcattaacagctaatacacttgaaagattgttagcagaaaaaggaaaacatgacgtcaggaagctggggccatggattttgtcccttacacataccttcgttttacagacatcacaatgacaaattcaccctgacccaactgaggtcacatcagcaactgaatgtaggtggattgtctgaaacccattaccgttgtccacccaccatcatagaaaattattttaaatgtatgtattatagtaagagtactcttgatagtattattttttctttctttcttttgagagagagtctcactctgtcacccaggctggggtgcagtggtacaatcacagctcactgcagcctcaacctcgcaggctcaacctcccaagatgctgtaactacaggccagtgccaccgtacctggctgattttttgtattttttgtagagacaggatttcgcaatgttgcccaggctggtctcaaactcctgagctcaagcgatctgcctgccttggcctcccaaagtgctgggattgcaggtgtaagccaccacacccagtggctaatattacttaaaccatataaaactaggcagtggagaaagggagtaagagtacaggctccagattcagacggactttctctgaagtccctcctactgcccatggggacttgaacaagttacttaatttctctataagcctcaatggcttcatctgcaaaggagaataatgacagcatctattttttaatgttttgtgaaacatatggaataatgcatagtaagtgcatagcacagtaaatgacacatattaaacatagacaaatattagctgtaatattttatcatcattttctttacaaataatagtgtttttggtaactaagactaagaagaaaagaaggaagacagaagttgaatgtccttgcagatggggggcaaatctgctggcaagatttgtgatgtgtgttgctaattatctgtgattaactggttaatagattagttaaatcatcctgttggctctgcggaggatgatctggaaggggtggtactagagtcagggagacaaaagcagtgggaaaagataacagaggatgactggagagactttggagctggaattgacagaatttggcacctgattttgcatgggcatgagatttctggcttagaagagaccctgaagtttcataatatggacggtgatattactaagatgaagaccacaagagaagccactcttggctgagcgcaatgagtttggttttagacttgctcttgcaagcttctggtaggaaatcttaatagttaagcacgttctgatagaattttggcacttggctctaggaaggaccctgattagacatagatggagctatcaatgggaagatagttgagatcacatagataaatgatacacagagagaagagcacagtggcatagtggagctcagaggaatgtaaatatttaagagataataagaggcagtggaaccaatgaaatgatgaaccgagagtaaagtagaaagatgatgagagagaataacgtcctgaaagttaaatgagcttgagtcaacaagcacagaaatcagggctacaggctacatgccaagcctctgaacttcctccgtcctggaccatggaccaagctcagtcctgttttccccagagacccacagaaacgccagtttgcctcctagtgtaaccctgcaaagaaagcaatgtcgttctgcatcaatgctgatgagcctgcgctgttcagtatctgtggggcttgccaagctactcctgctcatggaaacctcagtcaggagcgaggattccttggcagatcgtccctgtgttctctgcatgaggtctctgatctggctgcaccaataacaagaactaatgtcatgtttacccttcacaaagttcaaaataacggtacttcgaaattagccaggcttctaataagcagtctgagaagtacacagactccaaaacagtgtttgcagagcttctgtagaaaagatcatctgcatcagaggcagctgagatcctaatgaaaaagaactgcaagactgagtgattggaaatagctagggttatggctcagcaagctgccttttcagcaagccttgcagatgattctgatgctcaccaaagtttgtgagccactgatgactacagaaatagaatatcaggctgaaacacacaaaaagagcaccatcggggaaaaataatatgaagaaaatactacatttttagtcctggtccctaatccttcaaagagttgttatgctttgtggaaactaatcaggtctagtctcccacctttcaaattatttctgttaaaatgttctcccctcctgcccagaattttctaatacacagtggaatgctttattgctctctttaagcatgtcaactagagcaggagaaaagtttcccatgtattttcttcaaagaaaaagatgtttaaagtttaatattaaaagaaagagtcatgaagtagtttaacatttttttcacagggcgcagagagttgcttctgcatggttatttttactaagtactttccaatttatactttatttttctcaagtataaaaatggatcttcctacttaaaaacaccaatgtccaacttcatggtcaaatgtaaactttggaaattattacttgatttctgttagtggaggaattagaagagtttttgttccactatgttattccaacctcatctcctcgtttgtcaagattcttaagctgaacgtttttctgcgtgcatgcatgcatgtgtgtgtgtgtgtgtgtgtgtgtgtgtgtgtgtggtcacagtgaaacatagattaaggctgagaagtaacaaccagctaattattataagtatagatataggccatggatattaaagtacccccattttgtgttgatacatgaaatcatagaaatttcatgtatcatagagattaatcacatagagattaatttagaccataaaaacatttcaattttcaggaatcccttattaaaataatttttgaaaaaacaggggtgaatattcatgaagccaccacgtcataaaggtttggttgatgaatagtgagagtaggggtgaatagaggtaaagcaggagacacattggcaaggtcagggctgcaagagacaggagagcatcgaaaccaaaccccaccttcccacactcctaaagactgtccagtgagtaattttcccatttatacaagagcctggtctatgaaggcaaataaaatggaaggatttaccctcactgggcattgaagcacaaaccttgcccaaggccctgtcccgagcaaaagagcttccctactgggaaagatcaagatcttaatatcccttaatataactcaaataatcattagccaacctgagagaagaggacaggctctgagtctgaggagaagggttggaagggtctggttagtgcctgaccttcctataatataaagctacttggagatattagagctagtgaatgccttctcccagccaaatccatgctccaggaatgggcacagagttgcaaactaaagatcaattgttcatcgtggtacatgtctttgtgaggtattatgggacaaacttcagttcatatgggaaaaccgaacccttcccacgtggtccgtgaaaacccagttgcacattttcagacaacttctttatgagtacagggcattaggaagttgaaccagcccggccaatttagaacaactggtctctttaacatgagcattccccgtcagtgctaccaaactcctttccatgtgtcccatgcaaccagaaaatgtgttgtttaaattcagctcgtgtcatttgtaaaaaaaaaaaaaaaaaaaaaaccataaaaaataaaaataaaaataaaaaaattaaatagtttgacaagataaatcagggactttggaataaagagttagtaatatgttgagtagtttgtcacatgatatcatttttaagctactcttttttgggggggcggggcacggagtcttgctctgtcgcccaggctggagtgcagtggcgcgatcttggctcactgcaagctctgcctcccgggttcacaccaatctcctgcctcagcctcctgagtagctggaagctactctttctaaataacttcaacaaatattactgatgtgataacaaggcttgatttcatcaagcagtaactctgtctccatgtggatagcggtcttttgaagccctcctcggctgttagagtgcataacccacagctctcaaactggtggagacaaggtggtatgtttgactaattcagtgacgttcggtaagcacctactatgtgcccagcaaggtgtcaaaaacagagcaaagaacaaaataggcaaagtgattgtatatatcactttttatcctaggtcaggataagcaagcagtacataaatttttaaaacaggtattttaggtagtgatacatgctataaaaattacatggatagagaatgaccaaagatgactagattgaatttaccacttctttgagtaggtggcagtggttcaagttggtgactgagttctaaacgatgggaaaaagacagccctgcagtggtatgtgggaagtgttctgggcagaaaacatgttctgaagctggaacaagcttggtactttaaagaaaagaggctgggcgcagtggctcacgcctgtagtcccagcactttgggaggctgaggagggcagatcatgaggtcaggagatcgagaccatcctggcaaacatggtgaaaccccacctctactaaaaatacaaaaattagctgagtgtggtggcacacgcctgtagtcccagctactcgggaggctgaggcaggagaatcgcttgaatccaggaggcagaggttgctttgagccaagatcacgccactgcactccagcttggtgacagagcgagactctgtctcagaaaaaaaaaaaaaaaaaaaaaaaaagcatgcttgtgtgactggagcctaataagcaagtgagagaatagaattggatgatttcagaggcagagacaaaatataaggaggtcctagctgggcacagtggtgtgcatcatagttccagcaactcaggaggctgagcaaggaggatcacttgagcccaggagtttgagtccagcctaggtaagatagaccccatctctttaaaaaaattttttaaattttcattaaaataaatataaggtctttacgtgctatgtattccatgaagtccagagctatgaatgccatagagtaggttctcagtaaacatatgagacaaaatatggctgagggtgaccttagatcaggctttctgaatcttacagaaaaatcttcttttgaatctcttttagctgaactttgaagagaaggataaagtagcatctgtttcaggtgccagggaagcccagaataaaaggctcaggatgacacagccgcatcaacatccagtgtttattggccatctgtcccctaggaatgtcttaagagctcatgctctatttacgagaacagccggggacagtgagaggaaggaagaaattgctttataaaaaagagtagctgcattcttttgtgtgtggaaagagcactattgtggaagcgacgaaacccaggtgtgtaaaaatagaaccgagtgttcacattaaactttccgtgcctcagtttccccacatgaaaagtggacataataacagcacttgagtgagaattaattgagataaaacctgtgttgaaatactgcttagaacatgggaagggtctgagctactatttattaataatgccattatcatagattttagctacatttattaataactccatgaatttagaatgttaatggaataaggattggagaagaaaaatttgctatggccagtgagaattccttgcaagaaaaaagcattgcaattgtgtgtgtgtgtgtgtgtgtgtgtgtgtgtgtgtgtgttggatatgggcagttgtagtgtggaacacctcagcagcacccaggcctcacttgtggatggtacaacctcaggaaacttactcttcctcagtataaatgagaaggtccccttttcccccaatggctgcagtgttggtctaggatgaggtcttctctaccctcatctgcgtagttccaggatggactttctcctcaaaatcacagtccaataaacaaaagtaatgaaaagggtctaacttccgtttgtatctcatgaggagcatcaaaaaccagttagttcctagcatagcacacagcactcttgaattctttcagccattcccagggccctcgcttctctaccctgcccctcccatccctgtcaggtcctgagctcctccttgctcctccctccttttttttttttggttttttttttttttttttttttgagacggagtctcactctgtcacccagacttgagtgcaatgtcacagtcttgggtcactgcaacctctgcctcctgggtttaagcaattctctgcctcagccttctgaatagctgggattacagacatatgccaccatgcctggctaatttttgtatttttagtagagacggggtttcaccatcttggccaggctggtcttgaactccttccctcatgatccactcgcctcagcctcccaaagtgctgggattacaggtgtgagacaccgcgcccggccacgctcctccctcttttgaagacttgttggactcttgtctttccttctccttcctctttccttttccttttgttctgtctaaactcctacagaacaaataaatcaatgaacgaaacacctaggtccttcccagtgtgaatcctttccattaccatccacaaaggtgaccaccattaaagctgtgtgtgaaggcttctagacattagtcctttattctgagtttaagcaaatacacacacatacagatgcatgtatgcatatgcgtgtatgtgcatattatatatgtggggtatatacacatatctttgtatcaggcacataaacaatgcacacatacttaataggtttgtgcaaaaaaactgcaattacttttgcaccaacctaatattactataataaaatggagctgtgatatacattttattctgaaaatagcttgtcccttaacaacatacaatggacaatttacatagatcgattttatggtttatgccacattatgtcacattttttgtccaaatgaatgcatgtttcttcaaatacatacagtaataaatgtatacattgtggttacttccattttttgctatttgaaactctttataaacatttatatacccaaaggattataaatcatgctgctataaagacacatgcacacgtatgtttatagcggcactattcacaacagcaaagacttggaaccaacctaaatgtccaacaatgatagactggattaagaaaatgtggcacatatacaccatggaatactatgcagtcataaaaaatgaagagttcatgtcctttgtagggacatggatgaaactggaaaccatcattctcagcaaactattgcaaggactaaaaaccaaacaccaccgcatgttctcactcataggtgggaattgaacaatgagaacacatggacacaggaaagggaacatcacacaccggggactgttgtggggtggggggaggggggagggatagcattaggagtaatacctaatgctaaatgacgagttcatgggtgcagcacaccagcatggcacatgtatacatatgtaactaacctgaacattgtacacatgtactctaaaacttgaagtattataataataaaattaaaaaacaaacaaacaaatcactcacaccatggaagcacaaaactaaaaagttcagtgtgtgtgtgtgtgtgtgtgtgtgtgtgtgtgtgtgtgtgtggtgttctacttgaggtagaaggtaaaagattaaggagaaaaccaagtggattgaaatctgcaataaagcgaccattctccagtactaaatgcacttgaaatttattcccctgcatctgtaggtaaatgtccttctgttcttgaaacaataaatccccataaacttcccataaagttctgcagaagtgaaatgtgagattggttcccttggaatccattcagtgctttgtttgtgcatcttccaatcttaattttagagcccttgttcttcgtccagagcccctagactgggaaaaggtcagaatgcaacatgtttcaaagctgctgtgctctgggtggctgtcagactgttggagagaattgctttcaaaacccagagtatgccaccatctactcagtttcagattagcgtaacccacagcaccatgctatggcaggggaagctataatctttgctttttgttatcatttaaattcacttttaaaaatattaagattctcaaacagccagattctgaacatgcagtcttccccattgctatcaattatgtctaaggcaaaaaaagaggaccaaaacttctattttttctaacttttattttaggttcaggggtacaggtgcaggtttgttatatagttaaactcgtgtgacggggggttgttgtacagattattttgtcacccaggtactaagcctaatacccaatagttattttttctgctcctctcccttcttccagcctccaccctcaagtaggcccctgggtctgttgtttccttctttgtgtccctgtgttctcatcatttaactcccacttataagtgagaacatgtggtatttgattttctgtgtcagtttgctggggatgatggccttcagccccatgcatgttccctcaaaagacatgatctcattcttttttatggctgcatagtattccatggtgtatatgtaccacattttctttatccagtctgctactgatggacatttaggttgattccatgtcattgctgttgtgaatagtcctgtgatgcacatttgtgtgcaggtgtctttataatacaaagatttctacgcctttggatatatacccagtaatgggattgctgggttgaatgcaaaacctcaattttacaacttgaaatattgaagcgggaaatgtaagtgaaatcccaaattggcatgccatactaaatgttattgtaataacttatttaatatttgattatccaagcacgtacttttgtaccacattctgctcaataaatgtagaaggaagtgccgccattttggattgcagcagtacctcttcgtgcagtgaaaatcttttatgttgtggcccagccagaccctcagtgcagtttgcatatagctttggggcctgtagtgctgtggtaaccattgttgaaccccaaatatccaagacaggtctcagtcaatttaggaagtttattttgccaaagttaaggttgcgggcccatgacacagcctcaggaggtcctgatgacatgtgcccaaggtggtcagggcatagcttggttttatacattttagggagacatgagacatcaatcaacatatgtaagatatacattggttctgtccagaaaggcaggacaactcgaaatggggagggggcttccaggtcataggtaggtaagagacaaatgcttgcattcttttgagtttctgattagcctttccaaaggaggcaaacaggtatgcgtttatctcagtgagcagaggagtgattttgagttgtgtctgtcctttgtccacaaggatattccttgtgagggaggtatgtagctttttttttttttttatcttagtagctatcgtttttaggaatacagtggaggcaggtttgccctaagcagtacccagcttgacttttccctttggcttagtaattttgggggtctcctttcacatcatccacgcagcagcaacttctggtgaacacactgttcattattccaggcaccacttatgcagtctgtctttccctgatacaaattctcagatttctttgaaattaaaactgttctaaatctgcatactggatattacttcattcacattatatttattttaattatgtaacacaaagttgtaaaacttctgttagtcttaatatagactcatatatgtcctgtgtcatcaatgtgaattccattttcaatcctcacctcaggatgattacgagcaaagcacagtgtgtctaagctccaatgcttcacactaaaaacagcaacaaaggccaccagttgcaaaacagaatcgttctcgctctcagatgtgttctttttatccttaaaatcagagcattcatttccgtttggatgcactatttatttttatatcagaaattattttcacttagcagttgaatggaatttgtttgcaggctttctttcaatagtatttccttcttcttgaggatatatgaattctaaggaaactgcagcacattttgtaaaaatccaaaccaattatctcacccctgcctacaaagaagtctttgttatttttctattattattaaaatatatcagcaagattttttggcctttatagttctttggtatttcaaaatgcttctgtatgatgttattgctttaaatcatcacaaaccctgtgaagaaagaattatttttctaatttacaaataaagaaactgaggtcttagaagactgaattcatttcctcgtctctctttctttgcactatgggttatcttgatgctttactgatcctgctctcccctgagacatgtggactctgttactgttttcagcaggaaaatcatggttctattaataggacatgtgaatctttttatttcctgtaatgaaaagagcacaaaaaggaaactttgatttgtgtaacgtaatcgtatggatcatatcaacccattaccctgggtatagagcagtttcccagtttcacatccgtcattctgctgaaatgggtggcttttttccacattttactcacctgatggatttgatataaaacctgtttttctatggatgtgaggctctggaggttttgtagtctatcaacacataaaggctgcctggcattacagcactcctgctctgcacagtggtggagtgtagctaaatgcagctcagtctttttacagctcagctatgaccatccttcattacaacagggcagatgataaaatggaaacttaatgctattagatcatgaattccaattatatgaagagagatggaggtaagagaaattagatgccaaaaggagatacaataaagacagaagtgacgttcacagggctggcagttctcagaaccattgtcacccatcattgtcagtaccacctgaggacccggtgaagatgactagcatatcagatatctgagaagggaaatgctgagtgtgtccaaacatccaaacaaataatgccaaacctagaaaagcttctgtccatatgggttaaatagctcttcaattctgaaactgtcaaaagtaggctttgcagatggtcatgtcaagcaatgataataactggtagtggaattcccatggttcaaatttattaaaaaaaacacactattttcatttattcaagaaacacatattgaatacctgtgtgtcaagctagatattacagttagaaatatatagaaagcacaatctctgctctctgaaatttgcagcctagcagaggagaggaacacatgaaagtaattataataacaagttagatgcaatgatagatacaagatatcctaggaggacagggaaatagtaccatgcccagtccggggatacgtcagaaagactgtctggaggaggtggcatctgaactgagtcttaaagaatgagtagaaatcaagtccaatgtggtatatgaactgagagagagaaggggaggatgttgtagaaaaagacaatccaaaaagaggaaacagtgcaaataaagctggaatccacacacaccattgtcatggtgggaacaatggtagctgcatgttgctgaaatatacattctgaggctaggagtagaaagagataaggctggcaaagcaggcctatgcttactatgccatgtcaccgagcttgcaatactatatattctgcaagctatttggaaccgttgggatttgatgcatgagagtgaaatggtcggttttgcattttattttattttttattttttttttttatttttttgtgatggagtcttgctctgttgcccaggctggagcgcaatggcacactcttggctcaccacaacctccacctcccaggttcaagtgattctcctgcctcatctcccaagtagctgggactacaggcacctgccaccacactcagctaatttttgtatttttagtagagacagggtttcaccatgttggccaggctcgtcttgaactcctgacctcaggtgatccacccacctcggcctcccaaagtgctgggattacaggcatgtgccaccatgcccggccttgttttgcattttagatggatttctctgttggctttatcaaggatgaatttgagatgagcagcagcaggaacagaaccaagttaggaggctgctgccacatccaggcaagagacaatgcagagccaaggcagcagaaggaatggagaggaggagacacagcacagactatttagaaggtgtggctatcaggccttggggattgactggatgctaaggaagggctcccaggttcctgccttgaatggcagagtgggaaaagctctaccttctgagatggagaatactgtggatatagttaatttggaagaaaaatgcttgctttcagatatttagagttagatctctactatgagtttaaggctaaaataggcatttcttactggacagctttaccttgatgatttatactgaagatctaacttatgcacaaatttgggaatcgttaacatatgattagtacttgaaatcatgaaatgggtgaaaattactcaggaaaagaaaaaaagcataaatattcatccctgggacacaggaacattttgaagttgtcattccccagagtcacccccacccccatggcacttcagtgtactgcacactttgagatatatatatatatatatatatatatacatatttttttttcctaataaatagagacgaggtctcactatgtcgcccaggctggtctcaaactcctgggctcaagcaatccaccggcttcagcctcccaaagtgctgggattatagacctgagccactatggccagcctgatagtctactccttaacctacaggaagcagacatcaatttgttttacaacctctacatgcaaaaaatactacatagtcttatttttactaaatcaaaactttgtttcttgctaaatcttcttcccctctttgccagggtgtaaaagattcagtcttgttattccccgctttctggaatcaatcacatagcaacctttagggcttacccaggacagaaattggagtgaggacaggaaggccacaagttcccatgacacacctagctattcacgtctccgcttctagttattaactttgagccccggtagacctaggattactcaggcataaataatagccccccaaatgaaaagtgggaaattgtagagccctaatgtggagagcctgaagagcttcataaaaaaatcttagacttgttcccaccctccaaacatgtgaaacacacaactgtttcaaacattttaaatgtaccgaaattacctcataagtaccctttatatttaaatgcactaataatgggattgacatgtaagaatttccatgactaggaacaagcccgttttaccacaagccccagaacctggctataggtcagctcacagcagtgcaggaagcacctcaactgctttcaccagcatattctttttctctgtgggaccccatccccattctagcccaaaggacccgaatcacagagacacacagggtgaaatatttatgttgttgactcctcccgcaaacttgtcctctgatcattttgtgttgcagccgtgaaacaggcttgctggacgggaagaaatgctgcagagagagtggctgactcaaacccatggacagcattttattaataacttgcagcccttcattctaagtgaagcttgcccaataaaatgaggcctagagctgaacaaagctcctcttacctaacctgaatgtacaaaaaaggtttaattaaggaagtaatttttttctcccgtaaggaaatcttgacaaatagactcaaatttgcatgcaaatgaagccatctggttgattgttgtccacagtccccagctcacaggaaacaatagaaggccctttgcataactcagagaatctgcaaatctctaacatttgggtcactaataattttcagagtaattagtctcttcagagctgctatttacattggaaggtgtttgccatttacagcagaagctatagatattcttctaggtgcagccccagtgtgagccatttggtgacctgaggaaatcactcaatctgggaggggaatgacaagaccattggccactggagccagcctggcagcgacactcctcaccaaactgcagcccagagtgccttcacgcagtcttctccatgcgagccaaacgcagactcttctagccaccatctcttcccccttcctaattccccatctcccctctggggagggaggagacagggcaggggcaggcacaccaggcagggcctctacttctcatcacctgtctctgctactctgcagttatctcccgtaaacatttgttcaaatgcaatcatgtccattgcttgggtaactctaccttcttagtcgtcaggtccctcctcctttcatcagatttttacttaatggctactctacaaagcgtaacacagggctggtgctcaaggatgatagctctgattcatgtgtcctgaatggaattaccaaaaaattaaaaaaaaaaaaatcagtggagatgaagagatagggagtacagagttttggaagctagtgagggagcagaggaaggaaagagatgacgaggacaaaagggcagacatgggtgaggttgagaggagtaaaccagctgaggaagtgaccgctgcaggcttagctgtcaatcctggggtttgctgctccccgtggttggaactggaggacataatgctctgtgaaataagccaggcaccgaaaacaaatactgcaagctctcatgcatgagtggaatctaaaacaacagactcagagaagcagagaggaagatggtgggtacagaggctggaaggtgcagggaatggggagatggtcaaagagtgcagttaggaggaacatgcttggttggttaagttgtattgcacagcttggtgaatgtagttagtaatagaatatgtatatttcacaattgctaaggatgaatttcaaatgttcttatcccccaaaatgttaagtatttgaggtgatggatatgttaagtaccttgatttaattatttcacttcatattcataaatcataacatcactttgtaccccatgaatttatacaattatacattgtcaatttatgatttctaaaaaagcattagtacctgtggtaaatcaggctcaggggaaaagcctcagggtttgtcgtcttactgttcacacattgaaggaaaagaggctcctcttccatctttccccattccttggccaagcccttgcacaggctgactgtaagtgaaattaaagaatatcagtgtagtagtaagtaatcacatttgttgatcttttgttttgtgcctagcactctgctaaatgtatttcatgggttatctcctgagattcttaccataccctataaaagaggttccactgttattctgttcctggaccaaatagggtcgagctgcttattctcaccacccaataagagatgcagatgaactgggaaagaagagaggtgttttgttttgttttgttttgttttgttttgttttgttttgttttgtttgagatggagtttcgctcttgttgcccaggctggagtacaatggtgcgatctcggctcaccgcaacctccgcttcccaggttcaagtgattctcctgcctcagcctcccaagtagctgggattacaggcatgcaccatcatgcctggctaactttgtatttttagtagagacagggtttctccatgttggtcaggctggtttcaaactcccgacctcaggtgatctgcccgccttggcctcccaaagtgctgggattacaggcgttgagattctatttctgtaactgggtacagggagaacacctggaaattatcgccagatcaactcaaacttacaaagttttccagagcttacataccttgtaagctatatgtctatgagtaagtgtgcatttatctaaagacataagtgactcacttcttttaatttataactaagatctgagtcctgaagaccttcctctggagcctcagtaaatttacttaatctaaatgggttcagatgctggactaatgacccttgtctcctgctaaatcatggaggtttggggagttccttcagacccccattaaacttgtttgtggaggcctggggagtttcttcagacccccaatgaaacttgtttaatcctaaacaggtcctgttaagaattccttcattatcttgccatgtttcaaggtccagaaaaggcctaggcaaactctcggtgggcttttgttacatcctaacctttgtataagggcactgcttctttcagcttttaatatttaacttaaccattcagtcagtgctgaaacagttgttatggaggcctgcattagtaagacctggtctgccacaattccactgtacacatgaggatttaggaaggccaaatgatctgcctcacgttgcccagtaggtggagatggtagagccagaatgggaacctggaggtcggcttcctcagcctgcacacggaaacagtgcagggaagcttcaccaggtgacagcccagagcagcccagggactcacttcctgtcatcactcccaccccccaccacctcatcctggtagtaccacccgcgccaatgcttctagggctcttgctggacccacaggtggactgtgacttcagtctgttacctccttctcttcattctccacgaaagaacttcagcacatcacaagttcagttacttcactactggcagtaaaggaaaatctgtaagtccaggctgttgacaggcaggtgggaagcaagctgtggagctccaagaggcccaggaaccggaggcaggcaagggccgggctcagagccggaggaatggcggaacgtctatgtgagggtcagtcacaccccagctccccgctatgaccctgccagtgactgtcctactctacccatgcaggaagtgggggttcacactccagacaccaggcaccaaaaaatgggggtaaagctccttaataaaaacagaggaaattgacttaataaggttgacccctctccttagccttcttcctgtcagcttcccaagcactgagcaacagacatatattcctcatgaggaaagtagcggattcttctctcaagatattgaacattcagtgaccaaaacaagtcacagatactgacattcggagtcccttcaatgggacaggggactctccatgtgatcatgaagcccaaacatcaaatccaccaccatcccagacacacacactccagattgcagtcagctgtctagtacttgactgttcggtataaacagacaggtgagagtcaccaactatgtaggataatgtcagagatgtcataaaagaagggacccccaaactcacaatccagggtaggggtgggtggcaggaggtctgggaagaaacagaggcgacagagaaagcagaagaaaacttttgataattaaattaatattctcagagagacaagagaagatattgagatattgcctccaaaaaaattagaatggggtgctatgaaaaaggggactatcagagaacgagaaataatacttggaaatttaaaatatgatagctgaaattaaaacacaatgacagtattgaaaataaagctgaggaaatttccaaagaagtagaacacaaaggaaaaagatcaaaatgtggaacaaaattagaaaaaaaaaaatctaaaataaataggtgtttgagaaaagggatcagagaaattattaaagtctcagacctcatatgggagaaaaatctatatcaaggcaatcatgaagttccaattaaaagagttaaagaaaagatcctgaaagtttccagaaaggaaaaaaatgtaggttgcatataaggcttcgtaaacagaaagcagttgctttcccggtagcagccctgacagcctgacaattttctttctggagtttctcaattaagtgcgaaagtagaataatgactcatcagaggaacatgggtttagaaagttaacctcgagtatctcttttctcaaggagctacctgagaatgtgtttcaggaaaatgagagtgtagacctaggaagtggatgtcatgagatcctgaaacttggggatgtaataccaaagtgtggcaaaaggaagtccctgcactaatggcagagggaggtcccaggacaagggctgtgcaggaaccctgagaagaccccgtccaggtgggaacagaggaaagagagccatagaagatgcctccaggggacaaaaacgtgactgcagatggcctgatgtgtgcaatgttggaaaatgtttgagaagagttttactgctgtgttagagaatctggagagaattcgtggcagatacatagaaaaataagcaaatgaaaaaaataattatggattttaaagaaactaaatacaagaaaatacaattgcaacaaacaaaaatataagaaaatacaattacatacaacaaaatgcaagaaaatacaatttaaagaaaatacaagtagattttattggttggcttttaaataatattacatagtcctaaaatatgaatactgtgctaaattttagtattattattattattattattattattatagtgtcttactgttgcccaggttgaaatgcagtgacatgatcacaattcactgcaacctcgaactcctgagcacaagggatcctcctgcttcagccacccaagtagctagaactacacagctattttttttcagagacaggatctcactgtgttgcccaggctggtcttgaactcctggcctcaagcaatcctcccacttcagcctccccagtcactgcaattacaggtgtgaggcaccatgccaagcttgaatttcaatataaccaaaaatctgtgatttagctatttggggagaatatagagaaaggggctggggaagcaggcttataaaagtgctaaattctcatcttatattcaggaaaatcagtagagaatatctaaaaggtataaatcaataagtagctccagaggtttttttttttaaaaaaaaatacagctgtttaattgaaagagttaaaagtgtgagaaggtgtctctaaggaattgggaaggggcgggaagcagggaactgctttttgctttagtcctagcaccactagacttttataactatgtacatgtaatactttgttagaaacaaaaattaggttgaaaatgaaatgctgtccatcagaaaatgtgctcagaaagcttgaagttggaatcctatactatcttagtctgttcttgcactgctgtaaaaaaatacctgagactgggtaatttataaagaaaagaggtttaattggttcacagttcccgcaggctgtacaggaagcatgatgctggcatctgctccgcttcttgggaggcctcaggaaacttacaatcatggcagaaggcaaaggggatgtacacataccccgtggatggagcaggagcaagagagagaagggaaggtgctgcacactttaaacaaccacatctcataagcactcaatcactatcacaaagacagcaccaagggcaatggtgctaaactattcatgagaaaccgcccccaggatccaatcacctcccaccaggccccacaacattgggggttacaattagacatgagatttgggtgggaacacagatttaaaccatatccaataccaaataatcactggtcggattcaagtaagtggctgctatgaaatttgtgtgaagatatgatagtgcattttctattgatgcttaattggggtttaaaatgatgtgatgatggagaccagcaagcctgctttgcaggctcagccccgctctcctgcactagctagaggtgcctccctggttcctcttgccacacgtgatgagccctggccttgcctaacatgcagtcacaaagcttctcatgtgattgactcacttccaagctgcagagccttcagtgtcatctcgatcattctgtaaagcttttgactccagccccgggctgggtctccagtccctctctacctgcctcattattctgttactgttgactgacccttccagtctcagacactaatttctgttctgtctcacatctttcatatcttccctctcagtttccagccttgcctcctccacttatccgtgctggcctggtccctgccacctcctttggcactctctttgccatatagtgaatctcttattcccagcttggcattctcacccattgtcactttacctccatagcactgaccttggtagcaagtacaaattgcagtgatttcaataaccttaaggttatgataccatcagtcttgcaaatgcatggtattgttcaatgaagtctatagggagttatagaaataaagccatggataaggagaattatggtgtgctagtggaagcagtatccagttatcagtaggtgctaaagcagcattagtttttatttatatttatttagcatctttaacacccaggttaccaaaaagaacattctgtctcatgaggactttgtaaaaggagtgaaaatggatataaatgagaggggcaatgagttacttatgtattgattgaataattatttatgaatggtgactatattctgaggctgaagattactgagaggaaatgttttcatgccggctttcatggagtctatgatcagttgggagcagtatcaacaaacaataataactctttgcatccagaagcgctatcagcactggaaaaggcacgcatataatcttgttataataaaaaaatcccagagattgggcaacagattcctcagaacaggactcagagatggtgaccatgggctggagcagaagcatccatgatttattatttgtaccacactcactgaaagcctgtaagtccacatcccattaagcatgtttacttacaaatcccatccatgtgccactgcatttatatagtgtacattataaagtataactaaaatcgatattaaaggataacatttttaaaataagtaaaagcagaagttctaacatcatctgcctgagccccagtgatcacccttggcacctcctgagccgcactcctactttgataccatcagtctaatccagagtggagtcctccctgttgcttctgaagaatctggatttaataagctcatccagagatttgagataactcacaattgacaactccaagggcatcatgtgataatccagatgtttccaggatagtgggaaaaaccatttgtacaaggcatgacttccccgtgaatgagtctattcaagagatcaaattagattgaagttgcttagtgagcatagaattagaataaatggaattgtggtctatagagatatttcatcacacttgaataactgatggaactacttttctcctctctgcggatatttctgtctgaataaccagtgctgggcctcaaataaatactgacatgttttacttttagctttcctttttctagaatcattttagacaactgcccttctgttaatacatcaccacctcagaaaataagaaggtacttgattggattgaaattttaaaatgttaattgcattcgtatcctggggatacagcctaaagagacagaattgctttgcttaaggctgaagtctggctggggactttgatctctgcaggctctcgggtccttaaagggctctcacccaattaggatgagctgaatccttctggccctgggcctcatctttattccctcccagcttcaggactctctgatgagcgagagcgtagatttaggttttctcacagaggtgcacctgaacgcctcttgctgtgtagtaaggcagatgttgaggggggaggaaggcttacccttgataactagcaacttgagctttgcaaagcgcctttctgttcctgttaccagtagcctacactacatcatacaatattctcctccccaagaagaaagcaacctatttgcctattttctcctactgaaatctatgattttatactttgtttaaaaaaaaaatagcagccgagcatggtggctcatgcctgtaatcgcagcactttgggaggctgaggcaggtggatcacttgaggtcaggagttcgagaccagcctgaccaatatggtgaaaccccgtctctactaaaaatacaaaaattagcctggcatggtggtgtgtgcctgtaatcccagctactcaggaggctgagacaggagaatcgcttgcacctgggagggggaggttgcagtgagcctagatcgtgccactgcactccatcctgggccacagagcgagactctgtctaaaaaaaaaaaaaaagaagaagcttaagactgcactaagattaggaacacattaagaacagtttttaccctaatgaagatatttacaaacatattttgcactagttccctgtttatgtattacctgcgacagtaattaataggaatgccattggctgagacagcttcagagccctagatacctagggaagcaagccaaatcctcttcaatgtaaatactgaaacgaaactaagcttatcagcaatcagaaaccaccacctaacctctaactaaagactttccacattaaccaatcaaacggtttctttgtcttgcatccacaaacacatttctctctctccaaccccgcaccccagtagacaacttgaattctggtgctgcccaattcacgaatcactgaatgtccaaataaacatgttaagattttaatatgcctaagtttatcttttaacatgcctggggacttatctagatgttgctatattctagacatttctaaaaacaaaaacaaacagcattaattaaataagaccatattttaatatttcataatttaaaattatgacttaagcatggcagaaccaacacaaagtaacttttatttgaaaatagtagctcaatttaatattgcatatgtgtataatttgcataaaaggaaggaaaaatatcatttgtgtatgaatagaaactaatggagtgcacttagttgattcattgtgccttttggagaaaagatatagcaaataccgtgttttttaaaaagcatacatttggagtttagtatcagagctcaaggctttagtaactgctttaaatcacacccatatattttagtctttagctgtgacagtaagtgtactcagaaatgtgcacattaaaaaggaatttctcccctgaagatgaagttgagagccaactcttgatcccatattaaattcttagtccatctgtcctaatggagtctgagtaacgcagtttggtgtttttattgcatcctgcgagctgcttttctcctggaaacactggctgctctgtcaggcaatgagtggggagaggcagctggtacaatcacatcttctccaagagctcaaggacagaggctggctgagagccatttggtgggctcactgcctcatccccatactatacaacaatcccacaggccagagcctcacctgcagtccccaggaggaagtaggaagggaagagaaggcaactcacctctgagagtttggcgcaggagaggtgaggaaactgccctagcctagtctggtcacttctgcctcgttcccggctcctcacctcctccaggctccgtcagttgtattcctgaagcacctgcaccaggtgtctgggtggccgttgacacaggagtgagcactggctcttccaaggcagaggtggatgaaaagcaagagcaaactaccaaaaactttgttcttactttgtcatcctgaggtttatctcagatgctgcttgcaccagaccaaagctaccagtacatatgcaggagttcaaaacagcccccacccacccacagagtaaccccaggggcttctcccaattgttgtgtctattggcatttacttcttagagtcccataggactccttggtaggaaccccaactatatcaatctttattgttatataattataaaatattgtttatcataaatattataaaatattttattgtacaatttatagaaattctatattaatatttaattttatatagattgtatatattaatactttaaatatctttatatgtaaatgaatattatatagacacacatataacttttggaaagtcaaaaatatatttgtgaggatttggtccaatgttgttcaacagaatgagagaaaataatgactattgctaatggtacttattaaactcaagcaatgggtatctgttacatgactaggctgatcagggtgtgagttaacctgatttttttgttttcttcccacagggaattattggaatgccgcctctttcccaaacccatcctcctacctgcacttctctactttccaaggggaaactagcgctgacatttctttctacttcaaaacattaaccccctggggagtgtttcttgaaaatatgggaaaggaagatttcatcaagctggagctgaagtgtgagtataagttgcttgtcaactcatggggagccactttcgtcacctcagggtggtccgggtcctgattgtggaaggccttttgattcaaacgtggaaggtttcctttgttccaggagcaggactagaggtggacacacaagcctgagtttgggctccaacctcagtccctgtccttgggatgctctcagggaagcaggcacatccagattctcaagcaattagtcaagaagatgagagagaacacaccgccctgagaatgtgggagaggaatgtttatcttcagcttcatgtcttgtgtggctgttttccaaagagacagggtcaaaaataggtgaggggtgtgtgcattgacccgaggagcagggagtgaggaaaatcatgtcaaggtcaaggaagacaggaatgataactagtgacatccgtgtgagttcaggaggccacggagaccacaggactgggcaattccatgacacagagtctgcaggattcctacagaggacccacacctgcccaccctctgcaagtgagttctggatgtcatgtacttagccaaagatacagagacaataagaggcagagcaagagaggatgctgcttagctcagctcagctggccttggagcaaacatcctaagggggcgttcaggcttggggagctccgtcagtggaaggtgggggttagctgcacaagacttgagaagcgcaatgcttgccctacctggaccctttaaacatcagggccccaattcagctttaggaagttacaatcccctgacttccaggccagttgattatttgcaaatgttgaactccgttggctgtgagagtcagggagactccactggctgtgagagtcggggagatcaaccacaaggacgaggccaggctatgtcccctgtccctttacaaaacctcagccttacactcagcatatcaaaaagtctcccttccggccaggcacggtggctcacgcctgtaatcccaccactttgggaggctgatttgggtggatcacgaggtcaggagttcgagaccatcctggctaacacagtgaaaccccatctctactaaaaatacaaaaaaaaaaaaattagccaggtgtggtggcgggggcgcctgtagtcccagctacttgggaggctgaggcaggagaatggcgtaagtaaacccgggaggcggagcttgcagtgagcctagattgcgccactgcactcaagcctgggtgacagagcgagactccgtctcagaaaaaaaagtctccctttgccaagtctgtcccctttaaatgagtgcttatgttcctgggtctggtctgagaatgatcccaaatccatttcccatttctgctgaaatgctattggattcacagtagcattcttaggttcaattccacaccgtcaggtaaattgctcaatctctttgaatcctaattttctgatttataaaaaggaaatgttaatttgtgggattgtgatgagaatagaatttaaatactcataaggcatttattttggtatctagtagttattgtaattatcatcttctgaggatgcccatggcagatctgatctgagccaggtctgattgaaagggaggctaaggctatcctggtcctagaattaaaattaactaattaattaaaatcccccctttactgaattctggataagaataattgaaaggggattcttgcttccctcagttaaaattaactaactgaatcaaactattttctgacttctacataagttggatcaaattttagaaagattttatggccacaaaagaaaattgccagttctatatttgagtggttctgtaagtttctataaaagtgcttggattcccccatctttattttatgtcctcaagttttgtaaagccacgcctgggtaagaaggaacacatactagatagagggagagcaggtgtttctactcagccctcggggtcaaagaatttctctactttcttctacttttttctttttttttgagacagggtgtcactctgtcacccaggctggagtgcaatggtgcaatcatggttcactgcagcctcgaattcccaggctcaggtgatcctcccacctcagcctcccaagtagctgggactacaggtgcgtggcactgcacctggctaattgttgtggtttttgtcactgcgggatctcgccatgtcggccaggctggtctcaaacccctgggctcaggcagtgtgcctgccttgacctcccaaagtgctgggattacaggcatgagccactgcacccagccactaatttctaattatgaaaaatctttagagctgtcttcagagttttccaggtctttccacagtatgaaaaccatgtggcccatggttcacagtatgaattacagcctccttttgtcaaatacctttactttcactgtatcctttactctgggcaaaaacatgtgaaacgttcaagacccagattcgagcctctaatcttccctcagagccccctgtatctactaataaccagagagggtggaaagacattttcacgatccccaaaatgtcacatattagatgcccatcattatatgtcatctccatcagggttcaaaggagcctcatggagagggaggcagacttctgtatttaagaaaaactacaaagcaaaccaaaagtggtgctttcatgaagaacatggagaaaaaaatggccatgatggaggcttgttgctgtcgctgtctcatcaatcacactttttctttaatttttttttatttttttttatggtgtctcgctctgtcgcccaggctggagtgcagtggtgcaatctcagctcactgcaacctctgcctcccaggttcaagtgattctcctgcctcagcctcccgagtagctgggattacaggggcccgccaccgcgcctggctaatttttgtatttttagtagagacgggctttcaccatcttggccaggctggtctcgaactcctgacctcgtgatccacccgcgtcggcctcccaaagccctaggattacaggcgtgagccaccacgcctggccgctgatcatactttttcagtcagacacttcgccatcaggattcctgagacattgggtagagaattctctcaggcccacttccttgtgtgaggaatcactctgcaaacctaattgttttcacaacagtggcgggctaccagaggggcctcaggaaacgttgattctgaagttaaactctttagaactgtctctatgtttttcccatttagcttgttaggccttctgatctctttctgataggaattcacattttttttctctaagcgtgtctcagaggaatttggtcacagttcatgactacatattgctttccagaatgacagttctgttaattaattacattgtgcccttctgtcaagagtggaagattctcgactcagaaaacaatgagtcagtgtacactaagttaatgagataccatcagcatcttatgcacaagtagaaaaacacagagataaaattagggcaatctcactcattagcatgctttaatggtaacattttaaccctatacttcatgtatttactattcatatttattcattcatttaatgagtatttactgagtatctactatgtcccaggtacagtgctagtgctgaggtaatttagtcaaatcaagtgtgatttctttccctcaaagatctttctgtttgttttagaaagcaggcaagtaactcaggagttatgataataacaaaaatagctcagcttcattcagactttcaggcctcgttccaggcgttttacgtgaatcatctcacactcctaaccaccctgtgaagtgcatactagcattcacatctccattttacaaacgaggaaactgaggcacagggtgagcaagttgcctggccaaggtcatacagccaggaagtggcagagctggtgtttgaccccaaacattatgtgtctgtcccaaagtcattgctgctaaccttaaagcacactgcctcacagaacagatagcaagaaagaggccgggagcactgaggggaatttttaaacctgactggcttgacaaggagcgcctcccagggatggaatgctttaattaaattttgatggataagtagaagccagtaaggtgaagaagtgggggaagaacaggagccagggaaaaaaggaagtttcaggataacaccaaatgaacgaaggtgtcggagactgaaccgaaggacccaggaggggacaggtgcagtggggaggggcaggggccagcaatagcaaggtgggcacagatgagcacccaatgcactctgccagggggagcatctgactcaacatgaccctgaaggctatggagagccagggcgtaacttgatcaggtttgcattcaccagagaaaagactggaagccagacaaccagccatgggagcctctgttaagacagaggcagaatgcatagaaagagaggaagacagtgatgaagcattgtagatatgaaagatccttcaatgagccgagatcacaccactgcactccagcctgggtgacagagcacagagcaagaatacatctcaaaaaaaaaagaaaaaaaaagaaagatccttaacagatagattccacagacattcaacaaatactcgtgagggttaagtggacgggaagatcctagaatgaaaccagtgtttctagttttgatgttgtgtgagtggggcacctttcatgaaggagtctgacattcaagagcaaaatacaaactgcattctggatattttgagactgagtctctgtgggctataggaggatctaatcaagtggacacatctagaggatgctgaatggacaagtccagaacccaacagagaggtctcagaaactcagtttgggagtcatcatcacttagaggatcaggaaataagcattcagtaccctcagcatggatgagattgcccaaaacaaatgtgtagagagaggaagcaagatgtacaagaaagacaaccagctcacacctgtcatcccagtactttgggagtagcagtaggtcacacctgtcatcccagcactttaggaggctgaagggggagtatcacttgagcccaaaagtttaagaccagcctgggcaacatggtgaaaccctatctctacaaaactaaaaataaaacattagccaggcatggttggctgcacctgtagtcccttagcctcctgcccagaggctgaggcaggagaatccctcgagcccaagaatttgaggcagcagtgagctatgatcacacagctgtaccccctagcctgagtgacagagcgagacctcgaggaagggagagaaggaagggagacaaggaagggagagcaggaaggaaggaaggaaggaaggaaggaaggaaggaaggaaggaaggaaggaaaaagaaagagaaagagagaaacagagaaagaaagaaaagaaaaaggaagaaagaaagaaaagaaaaccacattcaaggaatagaaggaagaaaactagtttgcagaaaactaacagagaagtaggaagacagtggtacccagaaaccaaatgaaaaagacatttcaaaaaggaaaaaaagagggttagatattgctgagaggtccctaaaacaaggacataaagtgaccatcagatttaacatgtagaggtcacggtcaaaaagtcaggtatcactagggtgagtggaagtggatttggagatcaagagagggtggttttgttcattctagtttgaggatggtagagactttagcattcatatagttgaaggagaaaactatggtagagaagggggattggtaatacaggagataaagggactggctgaaggagcaaggtccccatggctgtgggcatgaggtagacccagcatcgcagcacctcacaggggtgagaggaagaggcggaagtaaagagaacagcgtaaaccgcccactaggaagtgcctttccaaatcagaatttgttgttgttgttgtgtgtggacgtttgtttgttagtatttttgagatggcaaagaaatattgttcaaaaaaaatttatggagcagatatcagaaaacccagactctaaacttttcttcatcactaacaaccatggatctgtccatgtattttttcagttacccctaagggattagcttgactgctctagatcctttttctgactgagagggccatcataaccagggtcccaacctcgggccaccacctcctgagcacctgccctactgctggtgctgggaggcgctggggaagctgaggtggaaacaggagaacccagcatccacctcctagtgaaggagacaaacacattagtgacagtgtggatacataatttcattgagagctttgcaagtgccaggccctgttctaaagcttttgtaggttattaacttttgtagtttacacagcaagttttatacacattttacagctaaggaaatgagagcatagagttgacactgccgaatccagatatggtgcatttaatcgttaaaataagtaaattacaatgataggcacaaagtattatgaacaatcggtggagaggtatgtgacctatcctgggaatgaaggggaagatgagggaatgcttcagttgggtcataaaaatcaggcaaaaaagttaaaggaatggggaaaagaattctaggaggaagaggcaatgcgaacaaaaacacaggaatggggagtgtgatgggcgtttgggaaactacaagcattttgtattgttagagtgtgaagtatgacacaggcagtgaagatttggggtcaagtctcagatctcattctaaatatatggtcatctaaatatttatctagtatttattgagtacctgctatgtgtgtacctaaaatgaacgtaagaagaagacatggccccatcccagaggcacacaccatctagtgggaaagactagtaatcttaatctctctctgtctctttctctctttctctctctctccctctctctctgtctctcttttaggttcaggggtacatgtgcaggtttgttatattggtaaattgcatgtcacggggatttgatgtacagattattttgtcacccaagtaataagcatagtacctgataggtagtttttccatcctctccctcctcccgccctccacgcttagtacacgtatccatgcgtactcaatgtttagcttccagttataggtgagaatatgcaatatttggttttctgttcctgtgttagtttgcttaggataatggtccccagcttcatctatgttgctgcaaaggacattatctcattcttatttatggctgtgtagtattccatgatgtatatgtaccacattttctttatttgagactagtaatctctgttattataaaactgtgtgtgtgtgtgtgtgtgtgtgtgtgtgtgtgtatatatatatagttttttttttttttggacagattctcactcactctgccagctgggctagagtgcagtggcacaatcttggctcactgcaacctctgcctcccgggttcaagtgattctcctgcctcagcctcccaagtagctgggatcacagacatgtgccactatgcctggctaattttttatatttttagtagagacagggtttcatcatgttggccaggctggtctcgaactcctgacctcaagtgatctgcctgcctccacctcccaaagaactgggattataggtataagctaccacctacagccagcctataaaataatattttggataggataatattagaggtacgaacaatatgctgtggttacttagatgaggcaatatttacttctgactggagaaggagaaaagtttccttgaagatgctaacattttaaaagagccacaaagtaaatggaaaaggaagtttcaggtttagaatgccaaaggaaaaaagcacagcatcatagatggcatgaacacatcaaaaaggtgtggctccgtcatacacccatgctgcgagggttacggaacattagttaccattatatctccagggtcaccacaatgcctggcatgtggtaggaactaaataagcatttgttgaatgaatgaaatgaatgaatgaggtgctagtctgaatggagagccccagaaaatctaggtggagaagcagatcaccacgactgaggtgctggcgatccaaatatagacaaggaataatatgtggaaaggtggaaggacaggtcacggttagtgaaattttggaactcacgatttcacaggaaagcagtttgggcggtaagaagaatgaaaattgaaatggaattttgtaggttgtatcaaaaggctgcggagaaagtcagggcactgggaggccagagtagtgttggttggtcacctatgtcactgttgaggtcatcaatggtgaagacaagaggtgaaatggacagggaatccatgacccaaactttactgtcctggggttcaaacagtgaccacaatatgaacggggagaggacgagtcacaggtggacgcgaagccgtttgaagactctggagccatagagtggaagaagtacggagaagggaagaataggccaactgttcgcctggccccaagatatgggccactcagaaaaggggttacaattctaagggttgtaagttagggtccccttagggtggactgcaatcagaggaaggaagtgtttgaaagtgtttaatgatacaacaaatagtgaccatagagtctatttttgtttaacaatttaaaagagattttagtctgggcacggtggctcatgcctataatcccagcactttgggaggccgaggtgggcagattgcttgaactcaggagttcgagaccagcatagccaacatggcgaaaccccatttctactaaaaatacaaaaattagctgggcgtggtggcacacccctgtgatcccagctactcgggaggctgaggaacaaggatcacttgaatccaggaggctgagattgtaccactgcactccagcccaggtgacagagcaagaccctatctcaaaataaataaataaataagattttagaggacatttgtgaaggggatttttggagggaaattttgaaggaaaagctcactgagtaggtaacattcaggaaaagcaaccagaaactgttgtaatactttaacataagcttccatgttgcccaagtttgagatttttaaggtatcaggataacttggagggaatatttgcatttagcagacatatctccacaaaaatgtgcaggcagcggcctaatgtcctactaatcttaggaaataatatgaggaaaaactttcatgttcaagatgcagccttatgcaatatacatgctcaagaaagtcagaagaaaatattctgcaatatacagaaactgatgagtcagaagaagtaaactaatggcaatttatcttccagtatttcaaaattggaacaactttttatttttaaatagtttcactcttgtagatgtgaagaatgtctaattccacttaactgggctgttgttctgttggggtgttatttaggatgttttaaaaaatattgtgttttttattagtacaaatcaggtgttagcacctggatttttcacacatatattatatttatttatttagaggcagggcctctctgtcgcccagcctggagtgcagtggtgcaatcttggctcaccataacctccaccttctagacttaagtgatcctctcacctcagcctcccgagtagctggtaccacaggtgcacgccaccacactcggttaatttttgtattttttgtggagacggggtttcgccatattgcccaggctgatcttgaaacctggactcaagcgatccacccgcctcagcctcccaaaatgctgggattacaatcgtcagccaccatgccgggcctctggatttttctttttaattatccaagccaacttgggttatcaacatggatttaggaagaattttagtgtttctactactttgcaagtctaattatggtttcaatttatattcaacatttggaatctgaaaagtgattctgacttggtcattactatacataagaaaaaaaactattctctccccaaaaataaaatttgaagacctgaatatttaataacaacacttgtgattaaaaagaaattctctaacttctcgatttaaacctttgatttgaattacagaccaaaaagaagtttggaagtgtaaactaaaatgaaatttgtgctatattaaagcttttcatataatagctttttgttcttaataaatattaaaagatatataaatagttggtaaatcaatttagattaaatttatccagatttctttgccaattacactgaagggacagttatttgaatgtacagtagaggtatcctagagttatgaagatggattttagaatagaatgtcttctggatataaaaatatttcaagttactttagagtttactggtccactcatgtcctgatctggaaatttccagagaagattgggaattcctcctaagctggccagacagagtgacatctctctacagattctagagttctgcctctctcccactacacttcagaggtggctttgaaagaccacccaggcctcctgaccagccctctcacgtggcagctcctatgggtgccacataaccgcagtctctccacatcgcctttcctccccatcgtggagggtaccttcctggtaccaggaaggatcttccatttgaagatacaactgccttcttggtaataattcctttgccttgggcccacatcctggattccaagtaaccaagggcaggctacttccagtcacacccaaagagatggcttgtccctcggctggggctcaacttctgctttggaaaccagctgaagtccaggacacaggctccccaagacctcactagagatctggtgtccttagactctccctattaaactccagcttatttacatagtcacgggcattttaggacaataaaaagaaagtaaacatcagaggcaggatttcctcaaagacattacattgtacatacatgacggtatgtcctgatttctttcatgcgatgctcgaaaataacctaagtaatccacatcgattactgcagagaagccagaagagtaactattcctggggatagctgatgtcaactaggagggggtgcaaaggaactttctgggtggtagaaatagtctttatcttaatgcaaggaatgattgcatatgtaaaaatgtatccagctgtgcattaagatatgcacattttaccgtgtataaattacagctgaatggaaaagtagaaaaagagaaaaactctgctctgagaaaatcttgaatgacaaaaaagttaataaatcactcaatttttcaactacacttagagagaccaggattctaagctgactgaccagagaccagtccttgaacctctccagactttatcatatccacttgtaaaacaagaaggttgaacaagatggtatttaaggtctcgtctaccatgaacaattcggcaaacctgccggagaccatcagccatccagtgtggcttaccacctcccaacctaagtgaactcacagccaagcagcaccttaacttttcatgccagggttctcagttctcctaaggatgatggggggagggatgtgccacaataaaacacatctgcttccagtaattccagtcagcatatatgctttcaccaaacgtagtcaggagatctcctaacattattgccacctaattgtaaatgctaactaaggagccatcagaatggcccacgatacctcaagctcaacatatcgaaactgaaatccatcattttcactcaaaagcccccttctgtgctcccacttagttaatgtcatggccatcttcttcattattcaaattagaaaactcaatgtcctatttaaagttttactaacctccccataggggatagactgttttatcttgatagaacactgcatttttaatataaagaaatgctattcttcctgtaagccatcataccagaacaatgccacagaaagcatcaattcctactagtcataaaaggcagctggaacatagatgtgaacataatgaaatcataccaaatgtctctacctcccaggatggctttgctagttgaaatccctggattctggattcagacaggctcataatttgactccctcactccagtccctctatcctgataaccaccctccctagtgaggccaaatttctacagatctggtccagttactcctttccttacagaccaccatgattccccctgtgccttataagacaaagtacaatcccaagcttggtaagtgatttacggcctaacttaattttcaagtttttttcccctactccatacaagctttgcccctcacccaccagcaccatgtgccacagcctcagctatgtccagctactgatattccctggacaccactacagtttcctaagactgactatgtgtctgcctgttccggaattgcttccccttcattgaaatcctgcccacacaaaattttttttatcattttgcatcttgatttataatataaaaaataagacagaagacttcatttccccaaaaataccaaaatttttacaagacaattcattaggtgcattgcctggaaagtagcaggaatcctcattagtcagcatcttcacatagcatttgtctgaatggagtagtttatcattactccaaagacatactgaagtttcattaaaattttttgatgtaatttttcttctatctcactctcttggattctaacgttttcttttctcttttcttcttcttttttttttttttttttttttttttgagacagagtctctctctgttgcccaggccagagtgcagtggtgcaatctcagcagctcaccacaacctccgcctcccgggttcaagcaattctcctgccttggcctcccgagtagctgggaccacaggctcacgccaccacgcctcgctaatttttgtatttttagtagagacaggttttcactgtgttggccaggatggtctcaaactcctgaccttgtgatctgcctgccttgacctaccaaagtgctgggattacaggcataagccaccacgccctgccaacactttccatattatttactctatgtggtagttcatgaaacctttcccttctaaaagatggcctgttaaagtgtcaaaaagaccaacaactagaattggcctgcctatgaccatctgtaagacaacagaccctctaagagaagaaatcaaagaagtttgaattcacacattctgagacagacggaagaaagatatgctattattgctggataatgaacacatggatttatgagaaaagcagaaatatatatgaaaaatttaaattataataaggttagagactttccatctgccattctaggagctaacagtatctccataggcttgatatttttataaaaacaagtgcttcaagaaaagagttaacagtcagtcagtgtgtgttgctaatgctggagaattgattcaactagggatgacacttgggaccaattaattcaaagctggctttaaaaaaaaaaagtagatacaataaatcagggagtagagcttcatttaaatatagtgagggactgggatagattacttgaaaaagctcagaaccaaagattgtctcaaaaggccaaagacaactataagtaaaacaagtgctaggtttctataagctatcaaacactgaaatcaaaaccatgaaagaaaatactggccaactggatgtcaactggaaaatttatacaaagtttgttaatttgtacttgtatcccctcaatctataaaaattttaaaacatgttttaaagcaacaagaaataaaaacagtttgttataaatgaaaattttcaggaagttatcgttctcaagatgcattttactgaaattacaagacaatttttaatagcaatcaagtaggaaccttgaggagaaatggggaaacgtaaagacttacatgaaatcttatacgggagtgtggtcacagtaaaaatatatcttctttaaaaagatgtttctatttcttttgtattgctgttttacctttaattttttaattttttttttttttttagtttaggtacttctcaatttttaaggggattgtgctctagaagtttctgatctagttgttcagaacctgaaatgtattttaatgtagacaccgcattgtatatagcactcacattccatagctaaccgtaaagagctctgctgttgctgtagttgagtgttgattcaaggtacacaggacaggctgagatctgggtcctggcttctggaggccatgagatgtagaatagaaatgttgaagaacaaaaagaattgtttcttgtatttctgaaggtcaagcttgagcatgacaaacttctccacagggaaagtttttatttgcctttttgatagtcaaatcacggtcctgcctctccttttgttgggagcctcattttggtgggttagtaaagggaacatctccaacattcataggagcatttgtttaaagggctcccacgtggcttccagccacttctctccactctgaaacttctatgaattagagaatccccctaattcattcaaatatattacggcctatatttttttaatattacaatgatctgacacagttgggtattgaaaatagagtaaaaccattacaccacaattatcccttcatccctgatgaacatcctcttgtccatttttttaatcatacgaataaatgaaaaaaatgtgataaggtcataagagagttaggaacattatgtaatcttctttaaaaataagataagctgctctacccagtaaaaccctaggtttctgcagccatatgacagtctgatatgcatgctatggtcggtcacggtggctcacgcctgtagtccagtactttggaaggccgaggcaggcagatagcctgaggccacgagatctagaccagcctggccaacacggtgaaaccctgcctctactaaaaatacaaaaattagctgggcatggtggcgtgcgcctgtaaccccaactactcaggaggctgaggcaggagaatcgcttgaacctgggaggtggaggttgcagtaagctgagatcgcgccactgcactccagcctgggtgacagaatgagaatctgtctcaaataaagtaataataataataatatgcatgctatgctctggtccatgaagaccttccacacagtgatttagaggttcagactccttttctctgtggctccaccatcgtctagagcccgggaagtctagctggcaaagagagaaagggaggatagagaagcattctctcttcttgaccacactgaaccagcgtgaacacattccttgccctcctccctttggtaagagctagtcacatgtctccacctggatgcacagggaccaggaaggcagttactggctgggtagcagctttgcgggagtgatgatgaaaaggggaaagaaaccttctgtgaatggttagtggtctcttttacaggtactatgacaccaaaaaggagtaaactttaaagacaccaaggtaagtttccaggagatgcagcatttgatttgcattgaaggatgacaggcaaaaatgagataagggcatttttctggagagaaaacagcataggcaaatgcaggtgggggaggaagaccgtgcaacatagaagcaattgaaaggaataaagccgaagcccaaggaccacttcaaagatacctctctctagagaaatgacccaccgcctatctgttaagagtttgacaaatgaaatctggctgaacctcaggccttgtcggaaattagtcattttgcttgcctttgcggatggtgttaaaatgatcaaatttggttttctgcatctctgagtttgattcctctgatgagaactgatgcgaatgccaactgactttttatgaagagtggttgatatttagtattctacagagtctttctgggtaagtgtaaccagagccagtgaataatagaagcagtgtatatctgtcaagtgtaattataacactgaattatgctcatcctgcattccggttcctgtatacattagtttaaacatcagaacatgctggcatttcagacctgtgaggattttactttgaaaaatagcatgcccttgtttttagccatttttaacaggaaaaaagaacttatatcttgttcaaaattattttatggtaaagtttgaccactctgttttttaaaaaaatcttctcaagtttctaaaaatagggaagaaatgaggaatatttcagtctagttttaaatgccctctaattttctgtatttaaataaaatcgtatacaataaaataatatcttattttgataaactgaactttctgattaaatagttgttaaagttacagaatagagttgcttataaagtcaccaatctttgccagagaaagtggaaattatcagattgtaactttaaaattatgcaagtattgtttatcgttgaatgatttaaaaattcagagcagcaaaaaggacaaaacaaaaattcagctataatcccatattccaatatatttaaattatcattttggtgtctatatttctaaacatttttctatgcatttatatatactttttttttacaaaaatgagatcatagggtacatactgttttgtaacctacttttttatgtaataatattttaagaacacattttcatgtcatttttcttaagactccataacaatatttttttttcaactgagaacaaggaccataccagaatctccaagagggcatgtgtagtttgaaaacttataattttatatttagaaagaaaacccaaaaatagctattgttttggtaatataacctacagaatataaagcatagaaatttccaattggctggtcggatgtttatctgggatcttctgaggtttgttatattaccattagcctcctacatggggcatgattagattactatgtcaacaaatgggagcacagattttgaaagattgtgaaatacagtgcctcaactgccaagcattccatttaacccacagtcccttgctgttgggcttaacttttgaaagataaatttccacacattctgatccactggcttctggttgctcattcccaatcataacatatgatagcatactatctattttaagtatgtgatatgcgattgctttttatcacatactcacatatcacagcctcaagctgcagggcagctcaaatgatgaaagtggaagacaggccgggtgcggtggctcatgcctgtaatcccagcactttgagaggccgaggcaggtggatcacctgaggtcaggagctccagaaaaacctggtcaacatggcaaaaccctgtctccactaaaaattgaaaaaatagctgggtgtggtggcaggtgcgtgtaatcccagctactcgggaggctgaggcaggagaatagtttgaacctgggagggggaggttgcagtgagccaagatagtgccactgcactccagcctgggtggctgagtgagaagaagagaagagagcagaggggaggggagggggggaagggagggatggggaaggaaggagggagggagggaggaaacaaggaaaccacactggaaggaggaaggaaggaaacaaaccacattgggaagagagggaggaaggaaggaaggaaggaaggaaggaaggaaggaaggaaggaagggagggagggagggagggagggagggaggggaagggaagggaggggaagggagagggagggggaggtggaaggaatggagggaacggagggaggaagggagggaagggagggagggaggaaggaaagaaggaaggaaagaaataaacaaacaaggaaaccacattgggaaatccaagcaaagatgggctcagcaggtcacatggtttggatatttgtccctccaaatttcatgttgaagtgtgactcccgatgttggaggtgggaacctagtggacagtatttgggtcatgggggcggatccttcatgaatggcttggtgctcttcccatggtaatgagttcatatgagatctggttgttttaaagagcttggcacctcctcctcctctctctcgcttcctctcttgccatgtgatgtgctgctgttccttcaccttccgtcatgagcataagcttctgaggccctctctagaagtcgatgccagcactatgctcatatagcctgcagagccaagagtcaaataaacctcttttctttataaattacccagccctaagtatttctttatagcaaggcaaaatggactagaacagctggatagtactgctaaccgatgaccctatccccaaagctgtttccattcattctctttgttgagagtatgtcaaaccatcccaggatggaggctggagatgagtttaaccccacctgcaactgttctctcgatggagctactctacagaaaaatcatgttccattagttcactaaatcgtaacaaaagtaaatgtacttgtttgaacattgtacaaactagtcctaaaagggttctcacgtattttatatgcgcagtctttagggaggcaaaaatgttttatgcaatctatacaagaaagttatattttcagctgttatccaaaacaaaggaagcgtactctgtgaaaaattggtattattgtttaacaatatccatttccagaggaatgcttttcttaagtagaagttggctgacacaaccataagggatgctgtgaagtgatttctgtcatttttcatacatggaaacatatgaactcaagggtctactaactcttctacaactttaaaggagcacttatcctgggatactttcaaacctgagattctgagattctatatttttaatgttcaacccttagtttcctcatttctaatattcattactaagtagacgataaagatcaagttaagcatagcttcagaaaaactaataaaataatttaaattggttatgcatctcttgtgacgattctaaggcaaaaggcacttttatagaagtctttcacactttaagaaagcttgctatatagaaaatgattcagttgggcacagtggctcacgcctgtaatcccagcactttgggaggctgaggcgggtggatcacctgagttcaggagttcgagaccagcctggccaacatggcaaaaccccatctctactaaaaatacaaaagaattagccagatgtggtggcgcgtgcctgcggtcccagccactcgggaggttgaggcaggagaataatttaaacctgggaggtggaggttgcagtgagctgagatcacaccattgcactccagcctgggcaacagagcaaaagtctatctcagaaaaaaaaggaaggaaggaaggaaggaaggaaggaaggaaggaaggaaggaaggaaggaaggaaggaaggaaggttctcctttcctctctaatgtctctccattcccatttaaagtctctgttgatctgcagcataattttacttttttctccactatttgtccaatactgcaaatgcactgtagttgaagagaatctgttgttgtaatggaaaacagaatcaatctctttttatactctgagcctatagcatgtagtatatatgtcctcatttggcactttttaattttcattacagagatcttctctgaagtcatatcaaggtgacactgaaaggatttgatagaaaggaaacaatttgtggcaaaacagagagagaaaaatactacctgtgatacaacctatcggcagagtcacaagtcagtccacagaaaccagaaaacagacgtccccttggctgctttccttctgatagacttatctaaagctctcactagcaagcatgctccttccaaagccatagcctttcatcctcagagttcatctttggcttttcctcattatcagtgtccctatcaagatagccatgcatagcacagttatttagaaggcacaattaattgacttgtatgctgtctccttgtaagcttcagcttggtctgtgttgaaacttgtcagcttttcccccaattcatgttgtttcaacctgcagttttattacctcctttggatgccaaattctcctttctccttgcactctccaaagccatgtattttgatgaactggctctctctgacatcacctcaaaccaacttaataaatcacccctagtcttctaccaaagcacatttccttaaatgagttttctcattttgccgcacaacctgaatatggtcggaagaaacacttctttgaagtccatcccctcctcaatctgctctcctcttcatctctaggggatccttaggtatgagtttcagagtttctctaaagcagcttctgggtttccctttattacaacactctatccccagagtaaccatctgggacctttatctattcttccaaaatgggtactgtctgcccaatgaacagctgtgctctttccaaacaagagggtatttaaaacccaactgcaagtcctacatggggtacaggggattgttgccagccacatatcattttggaactatttttgccttctttctttttaaatcatataggcctattaatattcaaggagttattctcaaaaggtggttaaatgcatagaaaaactaaaattagaagagctttgcattttaaagacagctttctgtttttgtatggccaatggtatctcccttttgcttccttttctctgtggatgtctttgtttgtgaagttattttttaaccataataaaaagcttaaaggccaaaatacataaagagaaatacttcttatactcaagaggttatcgagataccagagattttaaaatgagttcgtaacattgattcctaagctccaggcatttccttgaagaatttccagaagacttcaaataaatttttcttgccaatgttcattttcagatgtgtttaacaccaagttttctggtgtgaatatgcatatatgactctaaaaatctctacattcagaaactaaaactatactaaaagaaaaataggtcattttttatttccttcataatatgacaggcaatacagtagttaggaaaactaaagctctatatctagtcattactggattttagtgtctctcagcctcagtttcctgactaatcagtgagggtgggctcaggggtcgaagtctattcactgaagcttttaggtcttaacattattggattcaatcacatacttcttttttttgagacagagtctcacactgttgcctggtctggagtgcagtggcgtgatctcggctcactgcaacctctggctcactgcaacctccgcctcctgggtcaagtgattctcctgcctcagcctcccgagtagctgggattacaggcaccctctatcatgcccagctaattttttgtatttctagtagagatggggtttcactatgttggccaggctggtctcaaactcctgacctcataagccacccgcctcggcctcccaaagtgctgggattacaggcatgagccatcgtgctcagcctcaatcacatacttctaagctgatgtgattgtttctgtttttgtggagttacaaccagttgcaaatttagagagaccacattccccataagactgcatatgcttctgacaccaattgcaagttcagaagttccccaaaccacccccaggtttgatagttctgtagaaggactcacagaattcactgaattctgctgccgaaggctgctatactcatgctgcattatgggtgaagaatgcacgtgaaaatcagacaggggtagaagcacagatggcagagtccaggaacagtaccagatgctgagtttacagtcaacctctctatatagattcaggagcacatttctttcctggaacgggtgtgtaacaatttgcatggggtattgccaatgagggaagcttcctgagcctccatgttcagagtctttactgagactccgttatataggaatgattgattgcccacatggctgacctcagtttccagcccctcagaaggctggagaatataagccaaagccccacacccttcatcacattgttggtcaatctggcatggtaaggccccatcttttttctttttctttttttttttttttttgagacagagtttcgctcttgttgcccaggctggagtgtgcaatggcaccatctcggctcaccacaacctccacctcccaggttcatgtgattctcttgcctcagcctcccaagtagccagattacaggcatctgccaccacgcccagctaattttgtatttttaatagggatggcatttctccatgttggtcaggctggtctcgaactcctgacctcaggtgatccacccgcctcagcatcccaaagtgctgggattacaggcatgagccaccacacccagcccaggccccatcttaaatgccatctggtgtggccctacccctaaaacacaatgttagactatctggaataacccaaggctcccaggcaaatgaagacatgcttaccaggcaggacatcccaagggcttagatattaccttcccaaagccaaaggcaagggccagacctcttgagggcaaggctaaattctctattacacagttctgaaaatctctctgttgaggacaagaaagcaaagattcctaggacttactactagaaggaaacctgaaactcctaatgtttcttaaagtaagattccaggaccacttgcgtcagaatcacctggcattaacaaaatgcagactccaaagccccaccccaaacctactgaatcagattctctgtaacagaagcattggaatatgcattttaagcattttcctttagcagttttttatgtaggccaaaacttgagaattgtaattaagatccaaggtccctgttcctacaagtagagtgaaactagcatgcaataaagcaaagggagaaaattctgcttcttattccactggtgagtttatcttgggcaagccattagtcctcaaacatcatatgtttgaaaataacgtttagctacatttgttttaaacagacataactaatgtagcatgctcttagactgagaaaatattcattgagttactttgtgctcttgggaaagatgcttgtggaatacaagatggaactccatctagttcggctggccttgggaaaatgagtggatttctcttttcagagtatccatgtgatcactgttgccttcctaggcaggagtagtttctattcatcctttcattcattcacaaattggtatctactgtgtggcaggcaatgttctcagtgctgaggagagaacaatgaacaaaacagaaaatgcctctgccttcctgaggccaggaccacatatatattattccagatagtgatacatgctatgcagactttttaaaaatcaggattaaaggggaaaggacagctgagagcgaagtttgttatttaacatagaatgtttagggatggagtttctaatatgatgacttgtgagcagagaagtaaacgctcagccacagagttatttgggtaaagtgaacagcaagttctaaggccctggggcaggagcagtttcaaatgttgtgaaggagaaagtcctatgtggtggaattagaggaagactaagaggagtggaaatagatatggggagtacagacatctctttcaaggaatttggaaacaaaagggtgcatagaaatgaaatggtaacttttgggatagataaggtcaaaagaaaggttttatagtgccagtggttgttaagagtagagatatgtctctgtgtgtgtgtgtgtgtgtgtgtgtgtgtgtgtgtgtgtgtttgtataacaacccagttgtagagggaggggagaattgtcagagtggtgtccttgagctggtaggaaggatggcatcccgtgtataggtgcagcagttggccttgaattaggaacatagatgaactctttacttctttctccttatctctctgattcccatggcgaccttattttcagccttcctgcctcttctcatgaccctttcgtgttaaataaatccttttatcttctgatgtacagttagtacttcattcagaaaaaaaatacaggaaacaaaaaaagatattgataacactgttcaccatagagtgaggctgaaatatctgttctaccaattaccagttttgttgtatgactcaaatgagatttattgtacagaagatcccccaggaagctgccacccctcgaaccttattttagaatggaaaaaacgtatcattaccaaaactaaacagtgttagctggtctgcccatcatgctcatgctatataactttccttctcttttctcttatcctgttctgtactgaatggccaaattttttctgctacttcaactgaaactgtggtctaatatctaaatgctccctcacctgctgagaaaacttagagccaaaaacacctggtattggtcagttgttaaatttatcgctcaatatactaagcttggagtgatttgttgagttagaatgagagcaaatagtgccacctgctggaattacacttggaaggggaagcgtgaacatgccaagagctctccatggttttgtcccaatcattactttaagcctttcagatgaagtcatgagcctgctttattagaaagtaatttcttccacctatattcttttctgatggcaatatgccaccttatgtatttctcttttagtatttctcttttctccctgtaatgattcagtatctaaaattaccattaagaccagctgtatttcattttatttctcttagaatctcttgaaaaattatagaatgttgccatttgaaagaaccttagaggttctccgtagtttcaaacacattttggacacaggaacttttgggaaactatggatataatcctcactttggacctcaaactgaggcctgaagcgtgaaaagtgaaaagaccaaacagctgaggctctatatcagttaagatgctttcagttacaataaaaatggcttgagcaataacataacagcatatctcacataagaaatcctaaggtagatggctctgggattaatttaaaagttgagtagaccaggtgtggtggctcatgcctgtaatcctagcacactgggagtctgagatgggtggatagcttgagcccacgatttcgagatgagcctgggcaacatggcaaaaccccatctctacaaaaaatacaaaaattatctaggtgtggtggtgtactcctgtagtctcagctacttgagaggctgaggtgggagaatcatctgagcccaggaggtcaaggctgcagtcagctatgatcacactgccacactgcagcctgggtgacagaacaagaccctgtctcaaaaaatacaaataaagaatttttaaaagttgaacaatgtcagccatgacccaggctcatcctctgtcctctctgtcctctgtatctctgacatttgtgaggcagctccagcaacattaagaaccacagcttcccacccaatattaaggggcagaaaagggactgtcttttccttataactcaccaaaagactccactcatgtttcattggctagaagggaattatgtgtctcatccaaagtgggtagctggcaaggagcctggaattgccatctttgccttcattaaatccagatccatcctgtgggccttgggtagggctgtccttatgcaaagtgcaagactctggaaacacagagattccagggcaaaatccggttagctcacaaagaaaaaagggaaagtgactaattattgggagaaaaatctccatgggtctcttccacttttgcctgccttctgagcaagaagcattgacagctttgtttataccttttttaaggatgtgtgtatagctaacagccttggaagatacagatagtgtcttcctctgggacagagggtagatttatttcatggccagagtaagaaatataatgtcactctccggggcagaaattgagcaagtttgctagtagctactgtaaaaagattggggtttcctaagtccagggtccctcagctgtgaagcaaacttattgcatgtgcagcatccacctgggatgccctgcattcccctgcaagggaaagcaatgtgaacgggaagctcaggctgcctgctgtgttgtgagtaaagaagtcctttgtctctgacccaggagtttcatgtcttctgccagcatcatcagactgtggccatgttaaactatggttctgccagcatcatcaaaccatggctaacttgttagcctgcaagtggggtaaagtctcagacccttcccagttcttgatactcatggaaaggcaaccattcatgtttggcacagtgttctttccaatgagccaggctatatgcatccaattctcaaatacttatttctggaaatgagaatttgttcggtatataagaaattcctttttcacaggcagaaacagggcaacacttcagtctccaactggagacacacattaagcgaggacagtgtcattggctcaagtgtcttttatgctgtctcccttttattcgctcactctctctataattatctcttttaaaatgtcagttgctctcacccagaagaccaagagcaatcagccacaaactgaacttagaagcttttaaaacacactggctgtctgactgggggatgggatttctcaaaggcttcccgcagcaatgtcagggaagctgacattgagtggctgagaaaaaagagccctttccttggctctcacagtgggtctttcagatccttcctgaggaagcaacggaaggggtgtggaatgtgctgacttcataaatatttctccagcagagcctgaatggaggctgtttgggaagaaagttgctcgtggggtcctttggccttgagtccctcttactgtatcccattagggtgagaggctctgagctacggcatcgtcctggcaactttcttcccttctccagaataaaatattgatgttaaggtgacggtgaagaaataggggatctattgggacaagcaaaaagtatagatattttctagcgacttctggcactcagagtttttccaagtagtgacagtttgaagacctggacacgaattcatcatagcagtaggagaatcacagaggaaattagaacagcatttatccctacgagtcaaaccttagggttaaactcaatttatccctaaattctatttccttgatggcagttgatgcctttaaaatgaaacaatctttcctacttagcccaggaaccctcgttctcttgctgttctgacaacttacatttaaaaaatgctcctgctaaaatacagtgttatgagaacagaacagatttaatctgaaaccaaggctactttttcctcatctgctgtatcagaactacagagaaagatcacacagcctgtgggtcatattatcatcttcctgcattctgatcatacttccatggaaaccttgatggaggtcactggcctgcaagttcaatccagtcccaatgacccctggaggcaggggcttctaatttagatgagatatttttctgaagtgtgtgtccaatgaccacaggtgttgaaatgaaagttctctcgctaacgacatgaaggatcaaaattccttggtacaattaggttgattaaattgagctctgtgtctaatatccctgtagctcaataaagttaatgcagctttccaaggggcccaacacagaggcagggaacagtctaggtcctgagagaatctggcccaccatggtttctaaattagaagtttgattgcttgtgacatcgtcttaaaatggtaccagccaaaagaagctgaattttccattagcccaggaaaaaaaaatgacagatatttaattaaactgcttagagattaggtggaaagcttattgatggacagaggggctgaatatctttataagcaaagttaggcactggtgtgccacatctttaatgttgagaagaattcacccagcctaagggagctgaagacgtgtgtgctgcttcagcctgaggctgcctctcctgtcaatcacaagaaaaaatatacatttaaaaagcttgtttataaagcactaggtggtcactgaggaacttaacataaaatataaaatgtgaaattagaaagctacttatagctaaagttaataaagcaaccacccaatccatttgccaattgttgagaggtgactaattgcagaggaaggttgatttggaggtgatctctaaaaaaaagaatttgtggtcagtgctagagggtaggttatgagaaggagcctacaacccagatggggaataaccaaggtttgcaacagacgatgtacgacagggattattctccagaaatgttgtgctacctttcaggtaggcacaggtggtcataaaatgtaggtcaccctcattacaccaacaataggtcaccctcattacaccaacaataggttaccctcattacaccaacaataggtcaccgtcattacaccaacaataggttaccctcattacaccaacaattcaagggtccccaactttcaaaagagtataaagatcaatgaaatcaagtttcataaattcccccaaagcagtagctctcaactctagctatgtgttaacatttcctggggagtttttttaaaataccagtgccaactcttgaccaactgagtccaaatctctggacacaggtgtttcaagagatctccaggtgactatgaatcacttcccaaggagctacttactgaaaaggtaaattgtatgtggaattagaagatatcaggctctgaaatctgacaaaccttggttcagttcgtgactccactaacttactgaatctaagacactcaacatgcgctaacttctccagacttcagtctccttatctggagagggtcaatgatggtcacatcttggaaggcttctaaaattaaataaggaaataaatatatacctgacacatagaccccccaaaacacccttggttattaatggttaatgattgacattttatccttcttccattgattttgccatcgacctttgtaggacgtgacaggcttagatgatttttcctctccctgctttgtttgtcgtctagaatttactgctatttggtatctgggagaaaaatactcatgtttttcatgctttctgctcctccagctgccacagaagtgtccttttcatttgatgtgggaaatgggccagtagagattgtagtgaggtcaccaacccctctcaacgatgaccagtggcaccgggtcactgcagagaggaatgtcaagcaggccagcctacaggtggaccggctaccgcagcagatccgcaaggccccaacagaaggccacacccgcctggagctctacagccagttatttgtgggtaagtaatggaaaggtaaccatggcttccctctgttgatttttaagagcctgcacaatacaaaaaaaaaaaaaaatcagcctatgcaaggtttgatatagagatccttccaaaagtaaaggtgttggcctcttgtagtctccttcaagacagaatggaataaggaagaagtttcaggagacctagatctcgttccacttccactcttgggagctcactgtcctcagctataaaatcagagtgcaggctgagacatctctcaggtctctctaatatctgcaattttaggtttatggttttagaagtgtataaagttatttgatcatttggggcacttgtaactgtgtggaaggaaaggaaggaaggaaggaaggaagggagagagggagggagggagggaggaaatgggctaagttcagatttttttgaaatgataaatataaagccattcctttcttgcctattctcaaggttctaggcagagaaagatttagacttttcctgacataggaaaaaagatcagtacaaaaaagaaatttaaacagatcaaaaagttaaactacctatgcaagaagtggatccagacacccagtctaatctttttcacctgtctttctgctactgacatatttcagatgaacctaaaattacttcaaattcatacctgcttcccatggctagttgaattttaaattttgtttttgagaatattcatatgttaggaaattagcaacttttcctctgttgaatgaaataaagaagtgagtttgaaggactttgtggatgcatcatcttagacccctctctagggggtcaattgatcagtgcagtcaactgtggaagtctcagacaaagcaagataagaatgtgacttggttgctgttcatattcataacacctgccacttgggctccaccctacgttacagcctcactgagagccagttaattttaacaaggggcagagtccccacagtgtctttcatagttgtgttgggaagcttgaagagcggtagaatgtcattaaaggaaaggtaaaattagatctccattcattttgtgtgatgtcggccaactacaaaacaaaggtgtgggtcaatgagctttgaaagtgagactgacttttaacaaccacatcagctggggctataaaagagttatagatttagaaataaagtatttcctaattacaactggaaatcagccctttccaaatccttccctcaagttatagatcacaaaattacacattattttttaattagctaaatatcaggtccattgatccctgctgagcacagtgaagaaatttcacttcatcaacatgtgtggcccagattagctaggacaagtttcttcctaaatactgttaattctgaacatgctgggtagattctatctggttttcatcataacaggtgaccctacttgactcaacttctcgtttttttgaccctgcccctggatatagaagtccaactttagttttgttcctttctgttggctaactgtggctgtgtgtaagaattttgaagacctagtaaggttgtaaaatgaagagatggaagagtatttattatggtcttggaaggaacatcaattcacttaaagaaggtgacccaataataacttaagaaaagagcaagggcctgagatcagaattctacagaaccatggaatataagggataaacagaaaaagaatatctcaggaagaatgaagaggaatagaaataaggaaaattaggagagagtaatgtcacaagaggaggaggatttgattaaaaaggtaatggcaaataatatcaagcaccatgagtaaaataaggctagaaatgtgcgtgtgtgtgtgttttgagatggagtctcatcctgtggccaggctggagtgcaatggtgtgttctcaactcacgactcactgcaacctccacctcctgggttcaggtgattctcctgcctcagcctcctgagcagctgggactacaggtgcatgccagtatgcccagcaaatttttgtatttttagtagagaaggggtttcaccatgttggccaggctggtctcaaactcctgacctcaggtgatccacccacctcagcctcccaaaatgctgggattacaggcatgagccaccactcctggcctgtgttgttttaatttagcaattgtaaaaccattgatgaccgcagaaacagaaatttcagaacaggaggctgacgtgatgagtcagcaatttcttttgactagaaaatagtctctagtcccagtttctaattcctgtcaccttaaagggaggcacaaggcacatctctcagatatgagctactttagccaatttgtgaaatattgttcggcaatagaagtctacctcaggtgaagtgagaggggttgttacaaaaaaaaaaaaaaaaaaaaaaaaaaaaggacggccacggtggctcacgcctataatcccagcaatttgggaggccgaggcaggcggatcatgagttcaggagttcaagaccatcctggccaacatagtgaaaccctgtctctatttaaaaatacaaaaattagggctgggcgcagtggctcacgcccgtaatcccagcactttgggaggctgaggcaggcggatcacgaggtcaggagatcctgaccatcctggctaacacggtgaaaccccatctctactaaaaatacaaaaaattagccaggcatggtggtgggtgcctgtagtcccagctactcaggaggctgaggcaggagaatggtgtgaacccgggaggcagagcttgcagtgagccgagatcgcgccactgtactccagcgtgggagatagagtgagactctgtctcagaaaaaaaaaacaagactctaaaactaacacctagttcaacagctatgaatttctggagccacttatctccaaactattcagttagaatttagggacttaggtgttagtctcagttcacctctaatataaaagcattttcttgaccaactattaccatcttccctctctgagtatcttctatttctatgttttgtttgtttgtttgtttgttttacatggagtcttgttctgttgcccaggctggagtacagtggcatgatcgtggcttactgcagcctcaacctcccaggctcaagggatcctcccacctcagtccccaagtcgctgggactataggctcatgccaccatgcctggcatgaggtctccctatgttgcccaggctgatctcaaactcctgggatcaagtgatccttccacctcagcctcccaaagggccggaattacaggcatgagccaccatgcctggcctcttccaatattagacattttttattacatgcttggtaatgattgaacaataccagggttgccaagtggtcagtcttctcacaatggtgtgtggttaacaatatggtctttgactaccacctctgcctcttgccaattgagaaaccactgacaaattgcttaatatttctgtgttaattaggaatacagctcctacaccacagtattaaatgagatattccatgctaagcactcaggagagtgcctcgcctagggcccataattattatcattattattaataatagtagtagtagtagtatttgagacagggtctttctctgtcatccaggctggagtaaagtggcgtgatctcagctcactgcaacctctgcctcccaggttcaagtgattctcctctctcggcctcctgtgtagctgggattacaggcatgtgccaccgtgactggctaattttgtacagaaagggtttcaccatgttggccaggctggtctcagacccctgacctcaagtgatctgcccgcctcagcctctcaaagtgctgggattacaggcatgagccactatgcccagcaggtccattctcattaaatgtgagtttctttttcctttactatcctttaccttttattccctttattttcttcttcctccatgtaatagttacccttctcttaaagaagcctctttcaatgggctcattacttctttcttgaaatattgacttgaaatgtgatcacttccactcaccaaccctacaggaaagctcacatgcagagatgtccctcaatattcagaattattctgctagtcctcagcttacctgcagaggccacagagcagcaaactaaggcccaaggattttttcacagtcagccaagaaatcagaagttcatctgaaaacatcacaccagcatccctgcaacagctaagatatgtgacagaatggcccaagagctccacctaggttccggaaggaagggctttcatacaaattaaagctgaaacagactgcaaatagttcttggctttgcacacagagctctacagaaggccaccttccacccactaacctgtgttaatgtaattgcctgaagggtttttcttgcccgctacacaggtaaaccaaattcactgagacaatgttattgcagtaaataaagcgtttaattaacacaaggacagccaagcagaaggactggagttattactcaaatcagcctctctgaggactcagaggctagggtttttaaggacaatttggtgggcagggggctagggaatgggtgttgctgattggttggagatggaatcataggggtgtggaaaattgtcctcatgtgctgagtctgcctcagggtgacagccacagaactggttgagttctgcgtcccaagtctggatggaggcaggtggtttccagaatgcaaaaatctgaaaaaaaaatctcaaaagaccaatcttaagttctacaatagtgatgttatctataaaagcaactgaggaagccacaaatcttgtgacctccggccacatgactcctgagcattaagggattctagaaactacacctacattttaacagagttcaggcctctcccataattctaatctcatggcctttcattggttttacaaaggcagtttcaatcttccagccaggagggaaccagttttaaggagggacaattatcatccttgctttaaagctaaactctagctgggcacggcggctcacgcctgtaatcccagcactttgggaggccgagatggggggatcacgaagtcaggagatcgagaccatcctggctagcacggtgaaaccccgtctctactaaaaatacaaaaaaattagccaggtgtagtggcaggcgcctgtagtcccagctactcgggaggctgaggcagaagaatggcatgaacccgggaggcggagcttgcagtgagccgagatcgcgccactgcactccagcctgggtgactgagcaagactccgtctcaaaaaaaaaaaaaaaaaaaaaaaaaaagctaaactctaaaccaaatacctcccatggttagtttagcctgacctatgcccaggaaggagcagggacagccaggctgtgaggctagaagcaggacggagtcagccatgctagacttttcttgctgtgtgatctttgcaaaggtggtgtcattagcgaggccaggctcacatgtccttttgcaaagtaaccgaaaaaaaaaaaaacagagaagacacagttcacctcactgcacatctaaaatataattagaagctgtcatcccaaaagggttaacacaggtcttttggaagttgtaagaatccagagattattctggtttaatcaaaaagtaacaaatacatttaaaaactaagagacacagaaagaaaaaaagcacttgctggtatttgtctgaaaagtgcaggaaacttttcccattttttgatccaaaatgagtgtccagcatatgacgagctccctggatggcccagcagaagcacttaagccacatgttgatctgaagcctcagccagcccaggtgttcggacctgggctgtccgtgggccagatttttcttaggcggtggagaaagcaaacaagctcatggtcattgtctaagcatgaacaatgccaggctggattgagcaaagccagctttggcagagacatacaaggagtttggagccctgacagctgatagcagcggcaggagtgggagaaggcaagatatctgctgggcccccagcctgggaggctggctgccagcccagggcatggccaggagctggcaagcaaacaccactgcggggagccaagcaggctgttcaggtcagggagctaggacagggttagcatgcagcaagctagacactagccagagcatgcaactgctcttggcagtcattaagggaggagatcagagttacaagatctggaggccatttcagacagcttcaggaagaagtcaagctcctaagtggctccttgacagaggctaggtcatcttaactcatgacaaatgtccgtgctcaatttacttggctctggcctcttctgatatctctctagaggttaaagggaaccatctcttttgtgcagtccaaaaaggagttgaaaaatcaccctcagtgcttcaagctcttttgcgttgggcagaaagcctgactgagactcagtggaaggcacgctgtcttcaggaggactcagagactacctgagagtggggaagcccgcagcctcttcttcctctgacagtttgtctatcaggagacttttttctcctgggtggcaacctgagtttatggaagagttgaggtttattaaatggacgtataagcaactacagactgaaatgttataaccattctctgagtccaacctccccaaattctaaaatacagcttgtttggtcagctgcttctcatactctctgtattccaaaattgcaaatggatcattccagtgccatctgaaatgcagtatcattgagagaccaaagagaaaatcgcatttgtgtgtgaaggagaaaaatagaattctaataatgaaattcacccaaatctatgtatgaataaaatggctgtttctcatatctaagaaattgataataaaagatgtacaactcaggccgggcatggtggctcacgcctgtaatttcagcactttggaatgctaaggcgggcagatcatctgaggtcaggagttcgagaccagtctgaccaacatggtgaatttctgtctttactaaagatacaaaaattactcaggcatgctggtgggtgcctgtaatcccagctacttgggaagctgaggcaggagaatagcttgaacccagtgggcagaggtcacagtgagccaagattgtgccactacactccagcctgggtgacagagtgagaccacatctcaaaaaaaaaaaaaatgtacatctcaaattgcaggaattataacctagagaatgtgtgcctgcccctgtttcctgcaaacctgcctcaaaagcaaccacgtgaatgctgactgagacaccccggtgaaccccagggccaagtgcttcccatgcttcccctcaatgagtccacacgagtctataacatagataacattgctaattcttgttttattctcacattaaagattagttgacttaccgaaggtcgtgcatttaggaagagacagagatgggatttggttccagacagtctgactccaaagactcagcgctttaatcattcctcttgtcaaagcaaaaattgcactgggcaaagttgaacaggcaaggaagatcttcattcagggctgttgcgacagggtagagaagccagaatgcagtcgagctcgcctccacttcagctaagggcaggagaattttgtttctttattttgattttttggttttttttatttcactaaaatacaatgggaaagtttttacaagctgggataggagggatcatagggtgtctgtgtttgctgattggctctacccaaaggaaaagtaaactttcacaacttggagttaggctcccaccctcccgtggaggggagacagggtgctattttccttgacaattaccatttcaaagagatgactcccaagtttttgaaaaagccattcctgggttgtaaaactggcaaacagctttttaaaaaatttatatctcaaaagggcagagaaagaattaacaataacaaattttctaaagtaagtgctcttaaaaagtgaggtcaggggtctagggtggaatggaggggtcctatgtaaagtttagtcaagctgaaggcaaagttcaggccctcttggtcagtctataccagcgtcccctgactgagatgaccctgtggcccagagggtatgtggaaaggtgcggtgacactgggtgctcccacagcttcccacaacgtgcaggagaatccatcccaaggaagatttgcaggccccacgtgcaataccggccccttgtggagcactctcccagttatggagtctatgggagagactgaagttgacaggcagtggtgaggctggacatcaggcagccctggctggtattatgcagattataaagtcgccatggcaaagatctaggcctgcagagggccactgtcaaacgcaaagggtttggtttaacgagaagttaatgcaaaagcactcttctcagggaatgagacttcttacttgacagtctctatgacatggaaataatgttttgtttttgttttgttttgttttgagttcctttggtaaagcttttataaagtcgtcaaagtcagcatggatctctaagtctcagacacattcttcggggctttgcagactctctcagcagcatgtctcctgcgctctttcctgaaatactttcttcccacagattccacagccgtgtgctgtcctgcttatttttcctaccaagctggccatcacttagtctctcctgcattccctccttcctccgcttgaccactaagcattgcagtgtcacagagccttcctgtcttctcatccgaatattgtcttggatgatctcattcagcccaccatccaatggcttctgataataatttgtgccaatgtctctcaaatttaaatctccaggcctctcttctctcaggaactctagatccacttatcctactttctactttgtgtttcaacttagatattaaatgggcatcttagaataaacatgatgggaaacaactcttgatgcctcctggaaatttgttcctccaaaagccctccccatctcagtaggtggcatcaccatctaatccacccatccaccctaaatttggagttacccttgatttccttcttccctttctttcttctctttccctcatcacttcctatccaatagtaagccctgtgagtctacctccagactgtccctcaaatgcagctgaggcaggagaatagggtctggaggcagggaagataggcagattcatgctgacttcttggaactaaatcaaatgggaacgcttcagcaatgacaggaaggtgaacggctgtgtagcttcacttcatcctctccatttacttatgccacacactgagtaacatccttgccatttacatagggtgcatactgagtaaatgactttgtcacttgacttcgtcttcttcatttacatagggcatataccaagtaaccaatgggaaacctctagagggtgttgaaaccccagaaaattattattattcagaaataaatgaatacgtttatttatgtgtcctccccctagaacgtaagctacatacagcatagacggaggatagggtccaataacaactggtcaatggttacccaataaatatttgctgagcaaacatctggatgaataaataagtgattgtgatttttctgggttaatatccatattcaaaattagatcatctcctttccaaagcaagaagggtttttccttataaactttctccagaattcttttctcaaaatgtgatgatatttaccatcttgggaaatatctttttactgggaaccacagactgaaatcaagcatgacagaagcagaagcagcaaaaaaaaaaaaaaagtcacagagaaagtcagcatattatggaagacagcatttcaaatcagtctagagcctgagcatagttttcagtcttcctgatatcaaattggggtcttgcctgtttggcggtagctgtgatgctggctgcaatcctaatgcagagtttctaccccaacctttgtaactagttcttggttctctctgggatagaaatagggagtgatgtcgtaattagaaaccattgccatacattaaagagtaaattaatttgctggacaaaatctagcaaaaaaaattactacattgaaatcaatcgaccatatgcaaagcaaaaatgcaaataaaatatagaagctcctccaagaaatgccttctccttcacagttgttcactacaagggttaccagccctctattcttttctgaacctgctgggccaccacgctcagtcggctgctatcttctcaatagaaccatctccacctacgacccccacaaagggcaaaggatagccccttcccacttacagttgccatgtatgttttctgccctttgccctttagggatcaaaactaattgacttttgcaattccagctacctttcagtcagagcattaccataggaagtgagtgatgataggtacaatgtttgcgctttttttttttttttttttgagacagagtctccctctgttaccaggctgaagtgcagtggcacaatctcggctcactgcaacctccgcctcccgggttcaagcaattctcctgccttggcctcccaggtagctgggactacaggcacacgtcaccacacccagctaatttttgtatttttagtagagataggatttcaccatgttggccaggatggcctcgatctctcgagctcatgatccgctggcctcagcttcccaaggtgctaggattagaggcatgagccaccaagcctggacaatttttgctttttttaaaatgtgctcccaaataatcaaatcaacagtgtacttttaatgtcttttgagctcccaactaactaaaagataatctgttaactatattatatgggtagaaactttacggtgaacattctgaacctaagaaactaaaggttcaccttctcatgtgtcacaagaccaaatgcttcaggaactctggtctttcttccaacatcctcatggcaattggaatggtctgatgcagagaagacattttaatgtaacggtaccacttttgcaatcaatatggaaaaatgtttttcaacaaataaataatttcttatacagattttttatctttccgataaggactgaactaaacttcatgataataaatggcaactgtcccacagaaaaagattgtaataaaataaattagtatcaatgacacaaatattgaagaagggatagatcctcgcagccccatagttcctcccacagtacactatgagcgtgagaaaaaagaggcccacttttagtattccgcattcagataaacagggtcgtttcccatcagacgcttccctctcatgtttttatctcacagtttggtttctgctccttcgtgttttcaaggccccctgatgtgcaggatattgcgtgggtctctcttcctttcatggtcctattgtcacatcctgacaatgttcctctttcattttaatttcattttattacgttttttcttcaccattgccagcttcaccctctcgccatcgccgacacccactgaaacgtattttatggatggtcttctagtcccaccctctatatatttgttcaaagtatacatatcattgtggaaattcgtgttgtctcttgtgtgccatgctttatatgggtggcattgtactacagatcccattctgtttcttactctcttccctctgccttacattgttaagatctatttgagtagttctctgaatactatgtgcatagtgctccattatgtgtatttaccacgcatcatttattctatcccctaatgatgaatacctaggttttctgcaactctgccaccacgaataaccctccagggaatatatttatgtgcattctctgccacctgtgtgaggacgtcttgtgtgtgtgtgtgcctctgtgtgtccccagaattactgagtcatagagtatgtgtgtacctaatttcactaagcactgcttgacctatcagtttctgagtataaattttaaactttatttactgaatttctatcaatagttctatcagtggtagcttcgggtaattgaagtctattttgctagttagatgtgttcatgatcttcttgatttattgttccttgtaccagtatataatttccatctttgttccttatgacatttttttttaaatctcacagttttgtctctgctcttaaaactaccacactgctgggcgcggtggctcacgcctgtaatcccagcactttggaaggctgaggtaggcaaatctcttgtgcccaggagttcaggaccagcccgggcaacatggtgaaaccccatctctaccaaaaaatacaaaaattggctggatgtggtggcacacacctgtaatatcagctacttgggaagctgaggtgagaggatcgcctgagcccaggaggtctaggctgcagtgagccgtaattgtgtcactgcattccagcctgggtaacagagtaagaccctgtctcaaaagaaagagaaaatgactacactagccaggcataatgatgtgcgcctatagtctcagctaccctggagctgaggcagaaggatggcttgaacccaggaggtcatagctgcagtgagccgtgatcacactactgtactacagcctggggacagagcgagaccctaactctaaaaaaaaaaaaaagaaaaaagataataaatgaacaaactactatgctagccttcttgttgttgctaatattcctgttataacctggtattttttgtacaggtgtttgtatccttttgtttaaatgttcctcttagatttcatattgctgaaccttttaaaaatccatttggaccaattactcctataattttgacttggcagtgaaaataaagatgcaatattttttccatctatgttctcaagacttgtgactcctgtacatggatcggaaggatccctggggctgggggtctctggttcagatccacagctattgatgaaggtgttgttttttggttttggtggtggttgttgttgtttttcttacctaccctgtttaaacacttcatgagtgccttccatttgaactctaatattgtttgttctggaaataccagatatttcttcagatagtttcttgcctgtgtttattcttttcttatgaagctactattgtgcagatgttgacacttctaccctccgtaattcttgacttttgttttattcttctaatctctttattcattcctattgtcttcatggaaggtttcttgacccaatatcccaacccacgaaaatgttcatcagctttatccgttctgccattcagcccctccaaggatatctttattttgacagttatagatttttcacttcaatatctccaactaattcttattcttatagtttgtcattgtcctgtgtctccaatatcaggaaggtgggattctgctaattttgctgccgcttcatgtcggcaccataacgcaggtgtcttttatgcaaatcctacagttttctgctgtcattggttctgtgtcttcagcgctgcttcttgcccttatttcgcagtgcttgctgtcctcagaggtcctgtcatttcgccttctgagttcaagcatattcccttgagatttccaaatgccacctttgttattgtcttcctacaatgaaaaacaaaagttcagggcctgcattgagctcctcctggaaagttgagggggcaaagaaaaactcctgcctcaggacaaacctctggcattgtcatccctctcaaccctttcttgtttccagtccatgtccctcacccacctcccatacacacacacaacttcagagtacctcactcccacctagacaggggacagccatcttccactgtcattgattcttaaaccagtggtgtatctataccactaaatctagcctctcactacccgttcctccactaataagcatcttattgctatattgaagtgtctgtctcaaaaataaccaaatccaatagcctgttactgttgtctgattttccttgacttcttgctcttatttaacaattgtcactgtgccctccttgaaatcttgacatcaaaacactccagtcttctgttttctcagcctctctgccaactcgcctcccttttcccttttcctcaatccccaagcttctcttctttttcctccacccctttgcttggatggctgacatacccatgaggcttggtcatcagagctacactaatccctcacggatccatcccaggcttgacctgggactagcatccgcaaaggcttgtatgtgaagtctgagagtgaagagaacagggtgccagcttggataataacaccagggattcttgactccggatttaaaaaaagactagatacaaatgtttaaatagagactttaaaagacagatggaagcaggagagggggagggggagatacatgaagatcagcagaaagaggatgcttattttacttcaaagatgacaaaactcaccagcaggacacttaatatgaacaataacctaaagatatttgcaaaaatgtatttagacaagagttctaggctgatatatttgacatctgggtttattaaagtttactaaaatagctgttaataattttgaaatttggatccaactagaaaatatccccactttcagatgcaacttggaactgtaggtcccacagtaaagcaatggcttctgaaatcagtgctgtcagactgagcttagggaaagtatccatcatccaccattttagcagtggccaaagcccataactgccttggtttcaaaactgtagtactgagcttttgcactaagaaataaatatgatcttaatgacagcatcaaaaaagtgtcttctctttgttggcttagagattaatttggacattgacattcctggctctgtgagtattgcatttcccctttcagcttcagccatccttgtagctttagagacaatggtctgcccaggtgcaggggctcacacctgtgatcctaacacttttggaggccaaggcaggaggagcccttccatccagtagttcaagatcagcctgagcaacatagcaagaccttgtctctacaaaaaaaaatttttttaattaaccaggcatggtgacatgtgcctgtaaccccagctactcaggaggctgagacaggaggattgcttgagctcaggaggtcaaggctgcagtgaaccatgattgcgtcactgcactcggcctgagccaaagagcaaaactgtgccaaaaaaaataaataaatataagacaatgttctggcaggtggtaaatgtcttgcctcaggtattaatcactctatcagcattttgtatacctaagtacaacaatgtctagaagcatatcagacgtaggagaagaaagtgccttatatgatgtaagcccaaaaatcaaacggtggccagagcatagtaagagtgcaggcttaaaagctatccagcctgggtgtgagttctggctacttactggctatatgacagcaaatgaattaactctcttattctcagttcactcgtctgtaaaatggagataataatatctagctctgagagtaaagttctggaatagtgcctgatacttctagtatttaattaatattagcttttgaaataaccaatagtttaccatgcttatcctgccaccatagcctctacaatgaatcagaccacttagctccacccccattgcataacatttcacatttggacacataggagtgctttatactatggaaacccagtgtcccttcagtctctattttgaagctttcttctagtttaatagtttggattcacatgttctgcatgtcctttactctgaggacacaagaaaatccatgcaataataatgaactgaaaaaaatccatcctattgatggagttatgaatgagcactcatgagtgtcatctgaaaaagcaattttccaaaccccagttctctcagtatgtgaaagcttttttcatacttgccctccaatatctagctgacagagaaactactgatcaatacttgtcaatcatgcagctctgcactaaagaatatggagcaatttcctttaactctctacaccactgaagactcttggccattctgctgttctcagttcaaccagataactgggtttatattttacacacctgcactgacaccacaggtattttgttttgttttgttttgtttttttgagacacagtcttgttctgttgcccaggctggagtgccgtggcacaatctcggctcactgtagcctctgcctcccaggttcaagtgattctcctgccacagcctcccaacaagctgggattacaggtgggcaccaccacacctggctaatttttgtatttttagtagaaatggggtttcaccatgttggccaggctggtctcgaactcctgacctcagtgatctgtctgcctgcctcggcctcccaaagtgctgggattgtaggcataagccaccacacccagcccaccacaggtttttttttaacgggttcaagttgatgcttcagacctaagaaacaatggtagcatatagaacaggagaaatagcaggtacagaattgcaacttgggaaggcccagcctgcccaaacacatagctgcttttgccccctgacctagccagggcagctgtggctgccatgccagagagccaaggtcagggtgggtcacctagacacagaggagtcctagctctttttcccaccagtcactcacaccattccagtggcgggctcaagacctctatgctaattcacagctctccagtccagacacagccctccacgaatgataagatagcaacgacacccatcctaactctgtgctttcttttctctctctttttttttttttttttttttttttttgagacggagtttcactctgtcacccaggctggagtgcaggggcacagtcttggctcattgcaagctccacctcctgggttcaagtcattctcctgcctcagcctcctgagtagctgggactacaggcagatgccaccacatctggctaatttttgtatttttttattttttattttttattttttttttagtacagacagggtttcaccatgttggccaggctggtctcaaactcctgacctcaggtgatccacctgcctcggtctcccaaactggtgggattacaggcatgagccaccatacctggctctaactctgtactttccatggaaacagtgcagtgagaagagggaccccaaggtcactttctcagggaggtctagatcagcccgagcctgataacccttcctcattgtcttggtctgcttgggctgccctaacagaataccatagtctggtggcttaaacaataaacattctcacagttctaaaagctggaagtccaagatcagtgtgtccgtagggttgctttcttctgaggcttctcttcttggttttcagactgctgtcttcttgccgtgtcttcacttgatcttttctctgtgcaagagcatccccagtgtctgtccctcttcttacaagaacaccagttctattggattaggtctcacctttatggcctcatttaatgttaagtacttctttaaaggtcccatcttcaaatgcagtcacattggaggttagggattcaacagacaaattttgaggggacacagttcagtccatagcactcctgatacctctagtatcagatttatatacacatcatctcagccatatttaatttattccaactatgtgcttctatagaatgtgcctatactcaataatagcaataatcgtaacagctaccagtaactagaattagtgcaaagaagtgcattatctgttattaacacactcctacgcggtgcatattgttatgccaatgccacacataaggagactgaggcccaaataggacctgggaagctcacatgccatgagcggcgaagccaacacatagaagtagatctttgtgaccacagttcatgctttcttcatccctgcttgctgcctcccatacatcaaattgtgcctggcatcatcgtgcagctatttgtgatcaccttgggattaacctgcaggcaagaagcacgtcctcatcatcattttacaaatggctttcctgacgcctttcactcatgaactgatcatgcaacagctttgctcttctgagcatcctgcaaccgctctcatctcatgcctccttcccttccaacaggcctcccctacttgcaggatggtacccccttacctttttcctgaagccctctctccatggacgagctcatgatcccctttctgtcacttcctcagtggggcctatcctaaccaccctacttgaaattgcagcctcccccaccccactccaactctggatcccagctaaccctgcttgacttttttctccatagtggctaccaccttctaacacacagtatattttattttcttattgagtttgttgttaaatttctctttctgcctgcaagaatataagctctacaagaacagagacttttgtgtgttttgcttcaatactatgaagcagacaaacaaaacatctaaaacaaggcctggctcatagtaggcgtgaaataaatattttttgaatgaataaattagattttatgtgtgtgggctttagtgtgattccttctatggtgaattagtggccagtctctttgggcaaaagtactcaggaacccaacttagctctttattaagttctgaatttgaggacagtgtttttttttttataattcctcttgatcattgtttttgccctttttgtttaatttaatagccgattattttgtcccagtcttctgtgcattttacagttgtattattcattatgggtagttccagcattttcataattaatctttaattgcaatacttgcaaagcatttcacaagaaaaaatgatttacaaattaaacccacatctcaccttggataattatcacaggtctgactaatgtgcgtgaagcccttgcatggcagggggctctctacaatgacaatgtgttgattttctaattaacaaaggttaagtagcgtttttgcttgaagacctataatttaaacttatgacgtttgtcaccaagaaagatttctacagagcgcagaagtggaactcaaataattttcactgattctagtgcattaatgtcttttacataatatataatgaccgttttcaggacagaagatttttcttcatattgactagatcaggaaaagtaccttctagctcactgtcccatttaaataaatcagggactacctaagcaagaaaagagcctaatttatttagttttcctttatagagcgagaaatggcatttcactcacctgctttataaattatgaagagggaggacaaaactttttatttatttatttatttagagacagagtttctttcttttttgcccaggctggagtgcaatggcatgatctcggctcactgcaacctctgcctcccaggttcatgccattcttctgcctcagcctcccaagcagctgggattacaggtgcatgccaccacgcctggctaattttgtattttcagtagagaagggatttcaccatgctggccaggctggtctcaaactcctgacctcagatgatctgcccgccttggcctcccaaagtgctgggattacaggagtgagcaaaactttacttaatgaacacaacaaatacaaactagactacagtcatatgttacacccagttaaaagagggagaaaaaaaaaagtcagacatcggtgcaaagaaagaaaaagcaagcaaggaagagatttaatagaatttgagagtgtttactgaaattcagaaaaaaagacacaggcccagagggagagcctgtgaaccgtgagccagagtaattcagagctggaaggagtcacagacaccatctagttcagcctcctttatctgtggatggggaaaccgacgctgagagagactatgtaatttgatgaaagccacacaactgagtagaaatagttgatgatcctgagaaggaaagatccacaaacacaagtgcaggaagagagatggatccatgtagaacctaagaagtccaaagacccaagaatcaagacagaagcagagggagaaaactccgccccactaaatcctttctgaaatgaaccctgtatatataaataattaagtatccatgaatagatctaaatatctgccttaatgatataataaaaatatgatttactctagatttatttgctctgccaattgaccctttgaaaaatatctccattctcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgcagcactattcacaatagcaaagacttggaaccaagccaaatgtccaacaatgatagactggattaagaaaatgtggcacatatacaccatggaatactacgcagccataaaaaatgatgatttcctgtcctttctagggacatggatgaagctggaaaccatcattctcagcaaactgttgcaaggacgaaaaaccaaacaccgcatgttctcactcataggtgggaattgaacaatgagaacacatggacacaggaaggggaacatcacacaccggggcctgttgtggggtggggggaggggggagggatagcattaggagatatacctaatgttaaatgacaagttaatgggtgcagcacaccaacaaggcacatgtatacatatgtaactaacctgcacgttgtgcacatgtaccctaaaacttaaagtataatttaaaaaaagaaaaatatctccattcttcatcatgttaacattcagagtcttttcaaactctcaatcattgctgaagatccatgaaataccaattgtttccaaattaaaatacatcccagatagacaaaaggttaacatgtggagagaagcaaaatcacaaacatgttagaagaaaatatggttgaataatcatattattttgtattgtagaaggtctttataagcctctgaccaaaggcaggaatcacacaaataagacaggtggatgtgactacaaaaacatgcaaaactttcatcgggaaaaagaaacaccatagagaagtcaaaagacacaaactggaaagatacagctgcaataaagagttatttataaccaagagttaaagctcatattgttattaatcaataagaaatatattctcttgtattcccagcaaaaagcgaagaacacaaagaaacaaaaaataagaaaagggaaaacattaaaattactcagctcacagtatttgaggtgatgcagatttaaacagtgaatcctttttgcccccgtcgagcagactggcatgaatacaaaaaggcactgaccaatattagaattgtgtggagaagatgaaaatctcataccctactggtgaattagaagttggtaaattcttcttagaagaaaacatatttaaagtgcctttaaaatgtatatgcccttcatcctagcaattagacttaaaagtatgattaactaattttaaagaatgaattctaaggaaaaactggacgacaagtgtgcaaaggttttcataaagattatattattatagtatcatataaaatggaaaattttaaaaacttaaaagtccactggtggtgcaagagcgaaataagtgatagtgcattcacagaataggatgctatgcagatactaagcaagatgttctcgttgtacatttattgcttggaaaatgttgcaaaggctgggcacggtggctcacacctgtaatcccagcactttgggaggccaaggcaggcagatcacgaggtcaggagttcgagaccagcctggttaacatggtgaaaccccatctctactaaaaatacaaaaattagctgggtgtggtggcgtgtgcctgtagtcccagctactggggaggctgaggcaagagaattgcttgaacccgggaggcggaggttgcagtgagctgagatcatgccactgcactccagcctaaacaatagagtgaaaatccgcctcaaaaaaaaaaagtttcatgatatgttaagtgcaaaaagcaagtttcaaaacaatgtgtatattatgattccatttcttcctttttatttacacatagtatgttcatagaaaaatgaaaaaggctgttccctaaaagtgaaagtagttaaatctgagtagcgtaacagaatctgttttgtattctgcttctcagtatgtttatagtgaccacaatgactattacattgatcaccaggcagaaagagatggggagatctaaaaatgatttctacattttagcatattttgatagaatataattgtcttaattgactagtgataaaaaatttttaaggccagacatttatttaataaaatgtcttttggaaagcccttattgcaaggacaaaagccataatggctaaaataatagaagccaaattgaaattctaacacacaaggtgtaactagagggttgaagttcttccaaatcaggcaaaggccctcattctcttcagcgtagaggtgtgaagcccagttgacaaacagatggcagaatgggaaatccttcaaagtagttgtttttaataacttcttttgccatctactctctcatagctttgatcaaaaaaggcactggactctcttcacttctctattccaatatgttagaagaaatcaaatactcccaagggagtcatgattaaaaccaatgagtcacccagtgagagaactgcaaggcttgggtttgcagagatggtacagcaactcatttgccacttcactgatggggttttgcaggcataagcagatgctaattcatctctgccactaaagcctttgatattccagtcctgtctgaccaatctactggagtttatgacttttcttaagataatagagtaagtgatcagaatcaatccccagcctactgatcttacctgaattccagtaaccctactgactactccatgtttaaagacctccaaatctacatctcagaaacatgtacatctatgagacccctgactggaaagttcttctcggtattaagtggtctacacagaacagggcttaagacaataaaccctgtttgttgccttaggaataagacagatctgatacagttgccactcaggaactatgagtccttgagtaaacttcttaacttctccaagcctcagtttctccatctgtacaatgggaataatgcaaataatatctactttgataagttgttgtgaggaccaggtgagtagcatatataaggtactgtatatagagtgcctagtatgtagccctcaatgaaggagaaacttgggttttatttttattaacagtattttcttttctaaatgctcatcacctatttctttcaacagttttacctactattcattttagattagtttccagaaaagttgttactctaagatgcaagcatgtatataaatttgagttcgtccttttataccagctgctttaaaaagattatagctaagaatactatagacacaattaaatccatttgtgatagaatgcctcaatgaatctttctgtgaaatttcttgggaatattttaatattttcatgctcatgaacctcagtccaactctataacttactccaaaaatcacagtgaacgtgcttattgtgctatatgtcgtgtaatgacatttagacaaaagcaatgaaatctgatctaacctagcaataaatgtggtatagctgatttctgtgtaaagttatcagttccagcttccagctaccccagacaaggagccttgggtagtcttgacatgaacttaaaagcaaagcctctcttgagacaagaaccaagatctacaatcacatttcaaacggatttatgtcttccaactaattgacttgttaactatgctaatacattcatgtctctgcctttatattttttcaataagtaatgctacagaactcgatgttgtgagattaaagagcaaagaatctagagatttctgtaaacgctttttctataggaaaccagattagacttccaaaacagctgatataatttttgtgcatctccaaatattttatttctgtaggaaacgtgttgcttctcagaagatggctcttttaattaggccttatagcctgcagggagaaaagcttcaactttctctatttagataggaccaacttgatagtgacaatactagatgtgctatgcagtgtcatctcctaccacagttgttcaaaatatgaagaattaagcaatagcagaggttattccctctgaactctgtgccttctgtcattcccaggtggtgctgggggccagcagggcttcctgggctgcatccgctccttgaggatgaatggggtgacacttgacctggaggaaagagcaaaggtcacatctgggttcatatccggatgctcgggccattgcaccagctatggaacaaactgtgaaaatggaggcaaatgcctagagagataccacggttactcctgcgattgctctaatactgcatatgatggaacattttgcaacaaaggtaaggtggaacccatttccagagccacttttgcgtgtctttttaagcccaaatcatctatttaatgatttttcatatgtaaacaagtgtaccttattctgaggttaagatgatcagaatttttctctcaacttaggtaggaattttccaaccaaaatcatttcctaatcatttttgtttgataaaatgagagaagctctgtgtatggtgcagaatttcttccagattctagcaaattattcactgcccgaaacactacaaaggcagtctcattacatcttaatggtgagtgataaaataggtggccttcaaaaggggaatcaggcctgaccctcccacgttaggatctccaatagatcaattgatcagtcaatttctgtagtgaatcagccagtgcaccccagtggtcttgatgcccccaccccctgcagttgctaagagactggattcaagctacactcaccagaaagctcctctggtcagtcattaacatcattattattactcttactcaggatgcctttgagtggctctcagcctaagctaaactgcagaaatgctgaaaaaccacatttaattggtcagcttagagcatctgttattacttggttattttagtcttgaataattcctttaatccccagtagattccgcagagccaatgagcagagtacaagagcccaatgcatatgcatgttatcatttgaactataccctgtgatcctgcttgaccagaagaagaaattgactcaactggtctgtggcttaatttcccatatataaatgagggatgaagagaggaggagctggtgcttttcctaagccacaattgaaatgcatgtaaatcactcctctctttctaaatgaatgtatagcatatgggtaaagttttctgtgagcggttggtgcatctcttaataagaagctttacataagtagcctgttcagactctgatgaatacatggagggttgtttacactggcattattcacacaagatgccacacacagaaggaggaattgttccataacattctctgtacctccaggctactgtttggcagcgctataatatgagcatacaaattaggccagacagggtatgaaaaatgagcatgagacaacaacaaaggtggaaaggaacaccattgcagaataataccaaagcacattaacagtgctattacagtgcatttttctgttcagaacaacatggttccatgattttcctgcggcacacaattgaatgggcctgcagaacacattaattttgcacttgtagaaatgacagtcttgcaattaccattcattgtgcttgatgctaatttaatgcagtcatttccttgccaaagtaatgtctgaatgcaatcaagtaagcactaatgcctgcgagattccactacataagtaccagtttaaagaaaatcaccatccctttatttttggagagttaggttaaacacagtagctcacgcaaaacctctggagattaataggcaatagtcatgaatagaaaggcaggggcatatcctctccaggttaggccacattgcagataaagtgaaatgacgcctgtgtgttgcctctgacattatttcaacatgtttacacaaaagacatctaaatatttccttattatctgtttagcagaatgagttttcatttgattcaattagtgactttaaccaaaaaatttaaatagaagactgcaaaacatatttggaaatcatttatgagcatccttctgagtcaagtacctccttgacttggtagaatgacagtggaactgtttcagaggaatcccacagctgtccaggaaagctttgtctgcactgaggcaagctccatcagggactggaaggatctcccagcctgatgctgtctctgctctggacctcactctccaggtagcctggtgcctgcacagcagttcctgtgaccgccccccacctcaggctggtgcttcagccaaacagctcagcctctacaaagagctttggcattggccgaagaatgagctccatgcaaggccttctctggccttcctttgggagtataggtctatgcttgcagatgtggaaaacatcgctaatattttgccaagtgaatgaagcaaggcccaacctaccacacacagccggactacgtgtttatacaaaataaaacatgcatacacgcagagatgaggcaaacaaactgtgagaatacacgccaaaatattaactgtggttattttttgcaggaggataaaaatactagtattttttcttattttattttgctttaagttctgcgatacatgtgcagaacatgcaggtttgttacataagcatacgtgtgccatggggtttgccgcacctatcaacccgtcatctaggttttaagccccatatacattaggtatttgtcctaatgctctctctccccttgccgccaaccccccaacagacccctgtgtgtgatgttcccctccctgtggccatgtgttctcactgttcagctaccaattatgagtgagaacatgtggtgtttggttttctgttcctgtgttagtttgctgagaatgatggcctgtagcttcatccatgaccctgcaaaagacatgaactcattctttttacagctgcatagtattccatgttgtatatgtgccacattttctttatccagtctatcattgatgggcatttgggatggttctaagtctttgctgtgtaaatagtgctgcaataaacatacatgtgcatgtttcttattttgtttttgcttagctacattttccagtctttgcacaatgatgtatttcctctaacatcattattttttcttctttggaaaaataatagtaggaagccaagttcttaccccagacatttgagggataactatctctggtcataaaatatctagctatttattagatattattggaccatctagttgtactttctggaatggagaagcatggtcaggtgaaaattttatgtaattatattgtccctgagaatctcaatacatttaacaatgcatttgttaaatctcaatacatttagcagaactcattttccacaagcagctgaagagatcacccttcagatgggcatcggaggaagggctgccttgttggggtcaggttgcatgaaaataaagacctcaagacactagtatcacactcagctatgtgagaggctcacactaggacaggcttgggacccaaaatagcccaggtcataaaatagcccagggggacagataagctaagtctcacccctgtatattattagcccatccaggagaatggtgggcagacagcccatactgtttgaattctgtttttccctcctctccttctccccctcctccccatcctccttatcatcctcctcttcttcccttctcttcctccttccttctccgttcaccataagcacaatctttatttctacatcaatccctgtctctgtctctgtctctccatattccatacctactttccctctctccctttcttttgctggagtgtatagttgaatatgtaagtgaaattaccgtgtcttgtcactttgttgaactaggaagacagggctggatttgagtaggttcctcatgatcatctcttctgctttgtagatgatgcactgatactcactattccgcactagtcaaaaccacacaagaaggggacttcctctaacctcttatccaaaacccttttttcttttctttctttctctttttttttttttttttttttttttttgagatggagtttctctcttgtcgcccagactggagtgcagtggcacaatcttggctcactgcaacctctgcctcctaggttcaagtgattcttctgcctcagcctcccgagtagctgggattacaggcacccatcaccacatccagctaattttttatttttagtacagacggtttcaacatgttggccaggctagtctcgaactcctgacctcaggtgatctgcctgcctcagcctcccaaagtgctgggattacaggcatgagccaccacacccagcccagagccctttttcaaagagatgcctaaagatttgaccaccagttaaagtgttagctctcccagggctacttgaatctttagtaggagtgctgactggggaatatttcatggtttggagatagcacaagggcgttgtggaaaccctacaactagaccatgcaggcagtctcctcatctgtcggcagataactgagcagcatcccatcttctcagcacgttcatcaatgaggagcagtttaactcagtggaggtaggtcccttccaatgcagaattccttggcaccccatcggctgaggctgaggggagaatcatcccagactacatggaaggtttaactgtgggtctgtcatccccaggattattggggaccgaatggatagttgcttggtcatgccaaagatagttttctaacattaaaactgctccttcttggagagtcagatcccaaaacactcaagaattctataattatcaatgtcacttttattactaaccagaaattagagacataatttgcagtacactctctgtgtgtcttctctgtgtgtttaagcaagagagaaaataacatacctatagtagaggcagcaatttctgtgtttacttttcgtggttgaatgccatagtagattgaatagtgtcccccaaaattcatgtccacctaggacttcagaatacaacgttgtttggaagtagggtccttgcagatgtgattatggtaagttgaggtcatactaggaggttggccctaaatccaatgactgtgtcttcataggaagaggagggggcacagaggtactgacagacatagaaggaaagccatgtgaagacggaggcagagatcggagttacactgccccaagccaaggaattcctgaggctaccagaggctagaagagtgaaggaaagattcttccctagagttttcgaagaagcgtagccctgagaacaccttgctttcagacttctggcttcctaggaaaataatacaagttcgaagaaaaacctaccatcttcttaattcttgctcttaacaaggatagcagctggtatttattgagaacttgtctgctaggcagtgtgctaagctttctaattgtgttagcatcgtttaatcctcaccacaacctggtgaaatgattgctattactagtgctcctattgtaccaagaaggagatggttgtagtagcctgccccaaggttcacatattagtaagaggcaagactccctttcctttcattttgtagcaactaaaagcatagcctctagtcttaaagctttttgattattgtgattgagtaaaaagaaattagaatattactggatgcagagtttatcataaaaaataggatacaagaattgaacagacactgtttttttttttttgctacatctaggtgtaaggtttattcatttattgactcttattgagcaaacattcattgaacacctaatgtgcccagaagtcttgaatgtatagttgaatctgactacactgaaatttccaaagcattttaatggtttacagatacaaaatcaggcaagtctagaatatatgataggaatacatgtgaattggatatcacccaggctgctgaaaacagttcttcattatgatcctttcaccaagccaagttaagcaagaacttatcatcaagagacacaaagatatctccaaattcactcatctgcactttttttaactataaaaatgttcatgttcatatgccaaaccaggactgcagttgaaaaatacatttctttaatcactctgaaaccattttctgagttagggagttctgttttcttctcaaacattcatttgtttattgcttagaaaaaacttgaagaataaaagtcacaggattactgagtgaccaagatttgaatagtcattcaatcattgcagtgtttccatcatttacagtcacacaaataatgtgccaccctccctgtgttccagctaagtctcctattctccctatgagtattgtgaagttagctaatattttataatctgtattattaagatggtagaagaaattgtttatagcaaattcaagtctcaacctataagatgatgatggaattagatgtcagtttgaatccatctttctcacatacctgttacgtaaccttaggaaaattgtttgtcactgagccttatcttcaggaatacatagtaactacctcttaaggataccttgaaaatcacacagaataatgtgaatgaatttccacatgaaggacctggcacacagcagtccaacagcaaatgtccttttcattcttagcagctctttgctttttggtttgtgtttttgtttttacttaattcatgttgtcctttaatccttccctaatagctttaaatgtcaaatgcctaactggcattatttcggtgatccttgagtattggattgtcatttcggtacttcaggagcagtggcagtgtcctaaaatgtcatttctacttaattttggtcacagtaaaagtattctgaagccctgaagggctgagaagtatgcagagattctggaagatgcaactggaaaccacacccaccatatcggactggttttgtcaatagcgcaagtcttggagcaatgtatccagtcctttcaagaaccaagttgggtcaccttagtaactcctgcatcccttcctgactcaaggcccatcaggagacaagaaagcgctgattagccaggcacactggctcacacctgaatcccagcactctgagaggccaaggtgggaagatcatgtgagcccaggagttcaagaccagcctgggcaacatagtgagaacttgtctctacagaaagacaaaattagccaggtgtggtggcacatacctgcagtcccagctacttgggaggctgagatgggaggattgcttgagctcaggaggtcaaggcttcaatcagccgagattgtgccactgcactttagcctgggcaacagagcaagactgaggaaagaaagacagagggagagagggagagagagggagtgagagagggagagagggagagagagggagagaggcggggtgcgggggagagagagggagggagggaaggagggaaggaaggaaggaaggagagaaagagagaaagagtgagaaagagagagaacaagagagagaagagaaagaaagggaaagaaagaaaagggaggagaaagagggagagaaagaaggaggaggagagaaggaaggaaggagagagagagaagcagagaaagagaagaaaagaaaagaaaggtcccagactcctttttgctccaagagacctcaggctcaagtccacgttatacctctaaggaagagagggttttccacttgcctcctagagaaacatttcttgttggatgtgaggtagtgggtttgccaaaagcggttggaagactgaacaaattctgttccacagctctcagtatgaaacagggaccagaataaatgcatggtctacccttttagagcaggttggagagaaaattaattaatacaaaatatataaacaaatagggagaaaaagaagagaaatgttggaagtatgcatcttagaatttcacccctatgtgaaatcagctaagctgttagtgacaatggccatttttcctcaggtctacctatccagtcttaataatcccagcttggaagacactttcacatcagtagggagagaaacttttcacaggcttctttttcattttcagttggaacaggaggtttgacagatttggaagaaggcccaaaggaacaagaatagaaccctttttttttcttttcttcttagagaattattcaagtagagaaaatatcccttctctcttaatgtatttcttaaatcttcagaccttaggatgcaatttaaaagtatcatggtaactgtgatggttaattttaagtgtcaacttgactggtgttccatagggagcaggtctatgcaagcctacctccaaaggccaagggagctgagaggccaaagaaacagtctgacaaagccagtttctcagaagaaaaaaaaaacaaattgaatagggacttaccaacagaagttgcgtctctggtatctacaagatgagatggtggattcctttacctcctcagacccagggcctatataccatagagaaagggtctacatgcttcagaagcaagttaccctagagcagaatttgcagtaaacagtagataaggtggaaaacttagtggcattctgcaactgggttattcagaagccagcatggtgcattagcatccaagaaggaggtgctttagcccctacacctagaaatctgtaaagcattactttgaggtgggtctgtgaggctgtttccagagaacattagcatgtgggtctgagtggatgaggtggggaagagctaccctcaatgtgggaaggcattatcctgtctgctaggggctgcagagaacaaaaacagagaaaaggtggtagtgtctatctatctactagagatgagatatactgttttggggcaactccaggctccctagcctttgggctccagaacttataccagattctcatgcttttgagcttgggctaagagttacaccattggcttcttttgttctgaggcctttggacttggacggagccacaccactggtaccccagggtctccaccatgtagaggacgtatcatgggacttctcagcctccacaattacatgagccaattcccctaagaaatcccctctcgtatgtctatatctatatagtctgttgattatgtccctctagagagaaccctaataccataacgcatgaaaataatctgattaaaagcttaaaaaataaagagagaaggaagagccaaaaagtcagaaaatatttatggatgaaaatccataagtggacagaagtccacaaatatgtatggaaaaagaaaataattttgacttaattcagaaaagtcaaagctgcagagatagctgccaagtttaagtggctttgttatagaattttgtggtggtaaaataacattccccctagcctgaggttctctttggggtcccagatatttgagaaaacctggccaattaactttcttagagaaagagatttaaaaattcagtgcagaaaaagcaagtcctccgtaaactgttctaaatctaatacaggacaaagtgttcggatttggctttggttgtaggataaataacttttgtttcaagtgtgtgcccttttttttttttttttttttttttttttttttttgagacggagtctcgcactgtcacccaggctggagttcagtggcacaaactcggctcactgcaagctccaactcccgggttcacgccattctcctgcctcagcctcccgagtagctgggactacaggcgcctgccaccacaccaggctaaatttttgtatttttagtagagacggggtttcaccatgttggccaggatggtctcgatctcctgacctcgtgatccgcccgcctcagcctcccaaagtgctgggattacaggcgtgagccaccgcgcctggccaagtgtgtgcccttttctaatccccaccagtgtggggacacagctgaattttttttcctgagtgttttatttgtatatgttgttgagtgtttttatttcctgttcttcagcaatgatcagaactctaaataatgtgaagttcacagaaataacactctttatcttttcccacatattagctccatgacttgagctgaaactctatacatttcttttcttttcttttgtgagccaaaaaggaactggtctgataaattgtcctgagggttttgcttttagattgctcacatgtttggctgccctgcaagcaggtccattcaccaacgtccacgctgcccttgagtactccatcacgtctatgggccatgaagacctgcctctgacatgcaatttcttcactccacaaccatttgcgcgcttatcatttccaacaggcagctctggccttagcaactgggctcattccaggcattccttggctacaggaaatttactttcttaaataatcaagcctgagactataatgctatagcctacccattttatagatcaacctggctttgaactcactcacatatttttacctctattaattccaactggttacaagagtgtttgatttagataaataggcattttatatttttctgtttaaaaccaaatcctgagaaaacaaattatgaagagccagctgctctctctgagccatccttttcttggcattttaaatgtattaccttcattttctcaagaggactgggcacaggatatagtgaaatgtttaacttgactaacaatactttctagctactcttccaagggatatgtttactaaatataaggtggcttttacagtattcaagttctataaggcaaagactctcaattaaattaaattattggcagtacaatttaacattctacattctgtgtgaacgaagtaatttcaagcagtttgatcattaataataattttattccttcctatacactgagcacaagtttagtgaaatacgggaacatgtacagagagcctgctgtgggggaagcagtggattgccagcaaggaaggacaggatgaataagactaggctgggaatgcaatggaggggatagaaccaactgcagcatgcagggaaacaagccagaaggccgagtgagagacccccatggatacccacgctgaaggttctactgggagggctgcctgattcaaagtcttgtccaaggacagcatggcagatagtggtgggttgcacctaattctgagggcgtaatttgggttaagggagaagactctttggaaaacatatatcattaaagcctaaagtctaaagacaaaagttttaaagcatctcaatttttttaaaattgtctttgaaataatacaattgatatttacaagaaatacttatttgctttttttttttttttttttttttgagacaggctttgagctttgttgccctagctggagcgcagtggtgcaatgatggctcactgcatcctcgacctcctgggctcaagtgatcctcccaccttggcccccagagtagctgggactataggcatgtgctaccataccctgctaagtttttaattttttgtagaaacagggtctcactgtgttgcccaggctggtctcaaactcctggcatcagggtatgctcccacctcagcctcccaaagagctgggattacagtcatgagccaccatgcccagcctacttatttgcttttaatattacaaaattgaattgctttagacattaatagtggacaaaatattttaggagttagattagcttaactatttttcaaattatattccaccagccaaaaatatttcatgaggctttgccttctttaatttctaatatgaaaacagtagggaattttttccatttttcaaaaagttattctaataattaatatgattttctcaaaatacacgtctccttgcagttttttcccttactcccacctccagataattttatatgaacctagtggacaccttccccttgagtatttctgccttaaagataactttaaagatacaacttcaaagatagatcaacaaattgatatgtaaaccaggcacggtggctcatgcctgttaattccagcattttgggaggctgaggcaggattgcttgagcccaagagtttgagaccagcttgggttacacagtgagaccccatctctataaaaaaaataaatatctaaaaataaattgacatgtaaataagtttatctttgctttttgttaaaagaggtcttctaaaaacttgcttttatcaactttaacattactaaattttattttagtattctgaagtttagaccttaactaatgcaaatttgcttactttagactagtacaaatgacttatgatttacctgtgccagtagccaatctcactttctgtgcttctccctagggagttgggtcaagtatagcttacagagaaataccaaattctagcccttatgtgaatcatttctcagcaatcctcaaaggcaccaaaatgtcctttcacatcttctatttctttccatcctggatttatgaccagaaacacagacaacactattctaaactaattttgtttaaagaaaggggaaatttgtactttttgagtttatcccaattaaagagggaatcttatattatatagaacagtggaacaagagtaacttgaattccaatttcaacattattaaaaaccaaagtgaacaatcctaactaggcattctgtttctttataaattgcactaattatataaaattcattattcacaaggctgtgaggatcaaatgagctgatggatgtgaaagtgctttgaaaagcattaatgttataaaatgcaaattattattaagtttattaatcattgagtcactgaaagcctctttagtgagaatcctgcaaaatgtaaaccattatctttcaagagctgctaggaaatcctagacagaacttttctatctgtgttgttagtgttgccataaccaacagcaaaacttttccctctcaattgttgacattagtgctcgcccgtctctctgtacagcactgaaatgcgttatccagaagctccgtgctcacaacaatccagcaagactttagacctcagagttatactagttcatgacaggcagtactgtattcatagtcagccaacccttgaatgcatggccctgattaaattcctgtctctgtcatggaattggcatgagtcatttggcctggaacatcattaaagcagcaaacacacttgagattaaataagaatggattctaaaacatcctcttgaggttgttattgagatcgttagcaaatcatgttggttccttgagtatcttatagagtttcaagaaataaaaagcaactgctacattgtagaaagtacatctaaaattttcctcttatcccaagtgattgacagtctctctgcatcctctgccccgttaccaaggatgataactcctgttcagatgaatgagtccagatttttctcaggtctaagccaaatgtaacccaaatatttgaacaagtccattgctagtcactttttagttttcagagatgaataaagctataagtaaaatgctttctaaagctttactattgaagtaatttgatttaaatcccttttaaataggtctattttagcctgttgacttttatatttccttaacaaatgtctcttataaaggaatcttgtaaattcagttaaaaatataaattaagtcatgtaagtcaaattaaagcagtagatcaagttataaattgaaacaagtttataatccctctcctctattaactaagttaaaatgttatcttctgtggcctcatacaacaacctcctgaatcataaaccacctgaggttatgacaaacacttaataacttcttttaaaatatcaaggactattccaaaagacttttatttctgttactataatgaatttatgattactcagactttcagcttttgcgctaacattcaaatgtcattgggttacttattccaacacttcttctattactatagatggttaaaagttcaggaggccccttttgtcacaaaatcaaagtatgtcgtggttgaaaggactatttcattcattcatattcaactgatattttattaaacatttcctgttatgccaggcactgaactaagtgtgttcacatagtttaccttatttaatcatcacaacaacattcaggcattgatatgatcacctttatttacaaaatgaagaaacagagacttctagaggttaagtttatcatccaaaatcacattgctagtaaatggcagattgagattggaatcctaggtccctgactccaagcctagtgttttttccaccatatacactagaatgatgtcctctttataacacactcactggatcagatccaagttgtgttcatggagagcccgggaccacatgaggcagccctcttcctatttgagcatttcagacaactggaaagatttccctcatcctgaaccatcatctctattaaagatggagaatgtctccatgaagaaacagtgggtgtctggctctgggttcaaattcctgtgcctgtaagaactcagaaacacctatgcaccttcaaaatccccaactctgtggagataaggaagagcacctggcctaagtttgacacaaaaggggtatttaatagctgattcattccttactcttctgtttcctttaccaaagtctcaatggcccttaaaactaatatgctgacacacggtcagtggtccaatttgctatggctattctcccaatgccccaggaggccttgaaagatattggccttgcttgttgtccaatgtagaatggtaaattaatgagatccttggataccagataacacagcttgccctgtgtgtcctctttctatcttatcaccctgatgactcagggcaggcctaagtcctaaaagttctgaagaagtttcccttctttctttgccgttctttctgaggccctctctgtgcggttgagcaaggaaacatacacacacacacacacacacacacacacacacacacacaaacagagccaggtgtgagctggacctgtcggtttctaacaataagtcttagataacaagataattctttgtgtttcttagggtgccacccacacaccgtatccatgcttttgtgttaatagcagagacttctctttctgaatatatgaggagaggaataaaacaagggatgtgaccaaataaattcttctgacatgagagaccactttagattgccttattacaaagaagctgatttgcagggtaaacacaggccatgccctgtaagttttcttattgatgaaattcatgctttgaattactgattgatggttgctgaaggatggcaatttctctgttccagtctggagactgcgctacgtaaaacgagcttctgatgatggaaattctaaaatccaaacaaaacatggaaacaattttttaaaactcgacatctatttctatgaggagctaggagggtggatgcaattggtcagctccagctgtttccttgcttttattgcacagttgttacaaagaggaattcagtgtacaactatgagcttccggccgctcaagctactgcattacactacatggccatactctgatcccaacatgagctttttttcctctagccaaaggataatgtaaaaattatgacacaaataaaatatttatcctctaggcatgagtaaaggaattcacaaatcagaacatagcttgcaagcatacaagagtatgcttgagcagtcccctctttttaataaaaatcaaccatatgaataaaaagctgccctgccccaacttcaccccctacccatcacagaccacaccaccaccccaccatccccgcatacatgcgtgcacacacatgcacacacacacacacaaagccacccactaccattgcagcagggaatcactgatttttttaaattaaacttttagagaacccatgagtttagatggaaaaaatcgtgggagagtaggaatagtttaaggaatgtgcttggagaccagccactcttcacccaaaatgatttcctttgaaattcctgacttgttccctttctgtcctgtgacctattgttctattaggccattctattctattacagcatcatttgaatcagtaggagtgggtctgggaggatggtaataccatctctttaatacctcaatgtggacggaattgaaatggccaagtccttacccagaagagctgtcctgaagaaggagcattgagtttgaagggaggagccaggtgtaatttaggagtggggaagacattggacaagctttgaggagatagttaagatgacttccatgaaaacagagagctgaagcctgttagtaacagactggaaggaagaaagatactcctttctttgctgatcttgcctaaagccagcaggtctgcactggcaaaaagagaggaaactgtctttctctcccctctggcagtttctcttctactaagatccagaatccaagctaatggcattagtgctataatttggtttcactactaaataatctttagttattgatccatgttagaattttgtactattggaaaatgtattctgagttcctaaaatcaatttatattattataatgtatgtaccgtactatcattatgtacatagtattagcatatatagcatttcattcccttgaaaccacttggtcttcatacccatcacttaaaaatactgcttcatattattccacccagtgggtttaccaaaatttatttaacctaaatatttcacaatagggaaatggcaatttcaatttctgttcttaaaattgtttccaatttttttattgtaaataatactgcagtaaatgatttttgcaagtggcatttcaatattttacattatttattgaggatggattgccagatatggagaggtagagttagaggatgtaaaatgcttaggcttttcacgtacaaagctagtaagattttctaaacacagtgccaaagtacatgcagtatacactgagaatgccttgttctctgaacactaccagcaatgtttttcttttttttatttttatgaagataataagctaaaatggtaacctatttgcctttacttcctccaaaatccctagaaaaggatttcaaaatttttttgaaggtaagagtcaatctaaacaaagaggacaggagaggacagcaacatttagaaagacggcaagcaaatggaggaataacacacttagtagacaaagggaggccaacccctaagctggttgagggagaagctcaagagcaggcaattataaaagggcagttccttttataaggaaccgactcctgcaattactgccttaactcattcatgaaggtggaaccctctgggtcaggctctggtgagggccctcttctgggtggcagaagctcaagggcatggctcctcttctctttgcccttctgccatgggatgatacaacaagagggctctcacaagacgacatcccctcgatcttgaactttccagtctccagaaccacagccaagacatttctgttcattgtaaattatctgcggtattctattatagcagcacaaaatggactgagacaggctgctatagcggactgccatagcagtctctgttgcactagaaggctcagaaatgggtagcccctggcacctcagaaagatagacttaaaaacggaaggatcagctaaaaatttctatatgaagacaatcttctcctcactcttgcagctgggtaactgccccagagccaaataaggcagaagacccaagatttagtgtctggaggggcttcttttatctcttgaagatttggaagattgtgttttccaaggacggctgccacaaaagctctcctgacacctgtgcttccagagccaagtgactgctccatcaagacgtgatatctagttttcctctccaagaatctggacagccttgggacttgcttaagccaacagaatgtggcagaaattatgctgcctgacttccaaagctaggttatagagccaaggtgacacgtgccttggggactgggccatgcacattggagtactgattgcccaggaaagcagtcaactgccctgaggccaccatgctcaaggaactgcactaggttacgtggatcggacacatgaaaaagctttgagatgacctaaggaggtagagagaggccaaatttctgattcacagaaaccattagagataatgaaataattgttgttgttttaaaccagcaagtttggggagcaatctgttaggtagcaataaggactggaacagagaagatgaataatagttttttggttttccaaaagaacttactctccaagtattatctttgtttttgctaaatcctttgtattagtctaggctcttagagcgacagaatcaagaggagatatgtacctatatctgtatctctatatatgaaaggagatttatttggggaattggcacatgcaattatggcagaagtcccacaatcggccgtctgcaacctggagaaccagggaagccagcagcatggctcagtccaagtcttaaggccacagaactagggaagccgatggtgtagctctcagtgggaggctggagccctcagacaccgggcggccactggtacaagttctgtagtacaaatactggagaacccagagttctgatgccaagggcaggagatgtcccagccctaggggaaagacagagagagagagagagagagagagagagcaaaaaaagaaaaatagaagaaaaaacatgcattcaaatcattttgtaactcctaattattaggacgataataaaagaagattccagattccagacctagagagcaaccagtacagactgaacaaggaagatgaagagctccatggggactatctttgtctttagtctctttgggctgtgctaaggattgaatgtgtcccccaaaaagcatgcactagaaatgtaatcttcaatgcagaagtgttgggaggtgaggcctaatgggagatgtttaggtcgtgaggactccaccctcatgaatggattaatgctgtaattgcaggagtcaattccttataaaagaacaagtctggtccccttttgtgcactcttgctctctctctctctctctccctctcctctttcctctgtcttctccctctctctgtgtcctcttctctttgtccttctgccatgggatgttcaacaagaaggctctcacaagatgccatcctcttgatcttgagcttcccagctagcttccagaaccatagtcatatatttctgttcattatacattatctgcagtattctgtgatagcagcgccaaatagactgggacaggttgctatagcatactgccatagactgggtggcttccaaaacaaacattgatttctcacatttctagaggctggcagtctgagatcagtgttccagcatggtcaggtgctggtgagggccctcttctggattgcaggctgctgacttactgttgtttcttcatatggcagaaggagagttcagagagctctctgggtctcttttataaggggactaaacccattcacaggggctccaccctcatgtcttaatcactttccaaggcctcacctcctcctaccatcaagttaggggttaggatttcaacatgtgagttttgatgggagacaaaaacatctggtccataacagtcaagaaaaatataaaacagtttacttctgtttccttccagtggtgagataagggatgagttagtgatgagtgtgcagaaaacaaggcaaatgaagaaacaaaagattgcactggaatgtaaatgcaagtgttttacaacatatatgatcaagaacaatgcaagcttgttacttagaaatatgaagttgatgccaaaaataagatggcttctgaggagtgggaagtggggaggtggagtggagacttccgttaatgtgtttcagggcttacagaagcacttgagtcctttcttaaaaatgtgtaaatttatggcgtacaagggtaattttgttgcatgcatggattacatagtggtgaagtcagagcttctaaggtctccatcactcaaacaaaatacattaaataaactctcgtcatccacccctacacccttctgagtctccacactctatgtccatgtggacccattgtttagctcgcacttataaatgagaatatgcagtatttgtctgtctcggtctgacttgtttaacttaaagtccttagactatgtatgtcacaacattcataaaaactgatcaacttaaataccacattaaaatgattacagaaaaacgcaagcaaaaatataataaagtaattttttcccctccctcaaagccaactgataacgaaaagaaagaaatggatgaccaaaaaaaaaaacaaaaaacaaaaaaactctccatgcagtgagccgagatcacgccattgcactccagcctgggctacaagagcaaaactccgtctcaaaaaataaaaaacctccaataaaatatggcaatgctcattgccacaaaccacaaattaggaaggatacgtgacacatgccaactactttgaaatttgcatcagaatgagagaggaggcagttaattcatgttttcttaacttcactcaaagttcagcaattcctttagctctatttcagtttcttcatcctattgctttcttatgaaatatgactttatttttttcctataaaagtagcagaaatgattgaaagttctttgcattttttggcggtgtttgaatttttaataagggccacatgtgtctttctaaaaattaacctattctctttttaaaaattaacaaataaaaacttgttctctttttaaaaattaacttatttgttctctttttaaaaaatgaagatttttttcctcaaaatgaatatacttttgaggtaagaggattttcacctagtattctaaaatcacaaaaacaagtttattatttttattttattgcaaatatttttcctacatggttattttcagatcaaataataggattttggaaataccagcctgaccatactgcacagattgagaggttaggtactaaattataggcttttagagggaggtaaagatattagagtccatctccactccactccccacagataagggccaaggccaacctagccattaggtggggtggacacaacccacgttttgaggggcccacacatatatgttaaaatttctttagaaatcagaagaatacaaatgaacttcggggtcaaagaaaatattttaatatttaacattaatacattttctcttgaggccaacattgtcatgaaatacacattttcataatttttttttgtggaagaaagggaccacaagggcaagtgtgcctggggcccatgaaagtcataatgtggccctgatgaggattctgggacctaaaaagattcctgtaattggtggtggcagagtctggaccaaagctcagggcctctaactcctcctctatggtgctttctgccatgctgttctctggcttgggtattccacacactccatggtccagcccacactccttatctgaccttacctctggccatcagtcatagttcatcttctgctccagttaggtaggcccagcctcatttcctgtaattcatcacaaacactctccatcccagctccatggagcctcccattgttcctagtccactgctgttcattcccagcactggctctcactcctcccactctccccatgtggagaatccttcccgtttccttctgcttgttcaagaggatcctcatctctggagactttgtcttaacactgcctttttttttttttaactgaaacagggtcttgctctgtcgcccaggctgcagtgcagtggcgcaatcagggccaactgcagccttgacttcctgggctcagatgatcctcctgcctcagcctctcaagcagctgggattacaggtgcatgccaccatgcctggctagtgtgtgtgtgtgtgtgtgtgtgtgtgtacatatttttttttgtagagacggggtttcaccatatggcccaggctggtctcaaagttctgggttcaagcaatccacctgctttggtccccaaagtgttgagattacaggcatgacccaacactcctggcctctttcaagtacctttaaagactcctccagccttgagtgatctaccctatgtataaaagcatttgccatttagtaacaaattatcttttcttattcatatttgtcttatatgtcttagttttctttccccaattatcttgtcaggtccttaagctcagaagcgatattagtcaaggttccccagagaaaaagaaccagtaggataagtataatatagataagagggaatttattattggaagtgacttatgcaattatggaggccaagacagtctatgatatgccatctgtgagctggaggcccaggaaagcccatggtgtaattcagtctgagtctgaaggcctgggaacagggagccagtgtgtaacctccagtccaagacgagaggcctaagaactgaaggaagtggggtgggcggagtcccagggcatgagaagaaggatgtcccagctcaagaaaaaaaagagacaacttacccttccttcacctttttgttccatctggcccctcaatggattggatggtgcccacccttattggtgagggcagatctactatactcagcctactggattgaatactaatttatggcaacaccctcacagacacaccccaaaattatgttttaccagttatctgggcacccttagcccagtcaagatgacacatgatattaaccatcacagaagccatgtctcatatactcactgagcatatatatgatcagcactcagtcaacacccaaatgattgtcagaaatctctcacaactccccctacaataatagggtcaagtgctacctcttctgggtgtcagaaataggcttggctttcctttctctttcttgtatttgtaccctctgtgatgaaagtcacgctgtctgattgcacattccttctgggcaagggctgatgtcttctcattatgtattgtcagtctccagcacagtctgtgctacaaagtaggtgtttggtaagtatttgatgaatgagcattttctagaaccaacttttaaattgaatttcttggtcctggagatgtttatttttcatgtgagttttccatctctgaaaaaaataggaaaagaaaagacaaggaaatgagaaagcaacttgaaaacaggaaaatattggtgaaagttattttcacagaagtcttagttgacctttctctgtagcattaaattccttccctgtagtattaaattcacaacctaagctatagctagctttccaaactagacaagcatcccacttaagcacaattgatctcatttcagtttgtgtctttgggcaatgaaataccgcaaagactttttctacctatgctttgatgctttttaaaaagtattttctaaatatttttaaaatgtttgaaatacacaatgataggataactccaaagctgtcatatttgtcaaataattcaagtcagaatttaatatatcctataactgagactcttttataaaattgagacaggcacctgaagaccatttttatttctgtattttcttggtgtcccaagcaaccccctttagagaaatcactaatatttcctgagcaattgaaccacaataaagaccgtggaaagaaaaaaaatgggtctgctcagacattcagagcacgcatccttacaaatgcattctactgacctgcaaaatgttagtgggaatttataaatgcctacaaaaagaatatccaagtcaacatttgacctgtcaaatctaatcagtttggttttgatcattgtaccgggttgctattcgcaaacactaattgaaagcaaaaacacaaacagcatttttaaagagtttctaggagaatatcccatttgcacacacgtcagattaattttccccagagttgagcaatttcaggatcaattgattactgatcccaaggaacaatcaaaaaagaaattccctgaaaaatttttttgactgtcaagactcagcatgggaaactatgccatgaaaatgcagtttgaatagcttgtcttttaatcccaagtgaaataaatcaatcatctattagacttttctagttccttgtgtagtcagggatagaagagttcgctgcagcaggattcggaggaactggggggatctgggtccaggaactcgtctgatcactagaatggggcagggagtgagcagaggagtttgcagcacacagtagaggaagctggtaggcacagaatagtaactggcaggcttacagctgggaccagaggggtccagcaatgataacagctcccggcactttctaagtgtattaattaactcatttattcacacaagaatccaataagggagatagttttaatagacccattttactaacatgaaaactgaggcattgataaattaagtagcttgctcaaagtgacccatctctttggcagagcaaggatttgaacatagacaattttgctctaacacctgtgcccttaaccactgacttgtaactgttccagggagaagatgagcctcttttgggcagcagggcagtggacagccactgaaaatgtgagagctggcaatattcaaagaggcacattgagatccttccaggaaagtctaactgcttgcaccagggtccaggctcaagggagggattcagggagcagcccctagaagtaagtgctttcacttgctaggcagtgcttccctgactcttaggctgcaaatttctaaaaggaaaaaaaacaatgttaaacacgagtgccagtttatatacctttatatattcagttatacattttgtaaatatattacagaattaatgtacatcataaaatacacacaaagggaaaaaaatcattcctttacatcaacaacctactataaatttacttcaaatagcattcatcagtactagcactagaaatgtgtgtccctgacgaaaaatatgtttttacataatttagatcttttattttgaaatttatcagaaatttcttgattagaacccagttttcctagaattattccctacttgttagattatttatccacatatagatgattccgtgaaaaaatgcaaagcaagacccttgatatattgtgtaatcctgaaactatatattaaaaacaaaatagtcttttagaaagcctgcagcagtaccccaaaataaaggtcacccaagaagaaaaattctccctagaataatgcctttaaatcccggaaacgaaagctcaagtgtttacccgttctttttaacattttcagagcaatacaacagagtcaatgtatgaaataaggcattggagttcagtgtaagctaccaccaatgacagaacatgtccattcagggcaaagatttatttttctgattataccaatgacccacacatacacaaagaaaaattaaattgaattaaaagaaagcatttcagcaatcttgacaggcttgagccctctgacagctcctagaattctatcagccgatcatcatcgtgttgctaaagccagctgcctcttgaaaccaaatttaatggaaagaggaggagctcaacaaagcagcttaaacatctcaccttcaaagctcattgaaaactaggcttcctatcagtcatgtgtcaaaggttcccctcatcctacaccatacagattagttcttcaagttccatttgtgtggtcatcctttgagtttccttgaagctctaaaaaggctaaaaggttatttccatctggagccactggagccttaatccatgtatcttttccctgcgcgaatctcaacatggcggaactggaaagtgagactcccaacttccatgtgaagggaacgatgtcaggcaggctgagaagcctgagggtggctggttccaaagggactgacccaagcctgtagcgagcaaggaggctgcctgctacccagagccaccaccccccatggcagcagatcacagcccctgttctttctcttttgaagcttcaggttagggatgggcaattcatagcaatttgtctttgaggtgataggtttggcaaaggggcatgatccaagaagtaagaaatgtgtgagaagtttcataaaggttgatggcgattgtgaccatgtgacctgtgcaatctttaactcatcgagtatctaatgtagattcttaactgccttgagtgcttttaagggactccttctgtgggggcttcatggggatttttcctaatggttaagctatgtaaatgtcttccacagctcctgtaaaatctcccatgctgaaataactacatccctgctctacagctatgaggattgtgaccgtatgtgtcccagcaagtggtagccaccatcataagctttggaggacactgtgttcttctagatactccctgggccatcttttcagatgtgccctttcagaagtggtcgccctttcagatatgtccttgtcttagcagttggttaaagcttcataggatatttgtattcaaggtgctagttcaaaaacatgaccttgaattcatagctgcgaagctcaactgagagaaaacatatttaggaggatggaatccacgcattgccgtagaaaactccttctcaccctggtggatacaacttttgaaaaatattgatacctgggccccatctagaaattagtctcatgtgggtgctcagagaacatagggaggtcattggggatggagtagaatgagcaaagaagagaagaaaatagggtgagagaaacaatggggtgtggaatggggagaagaggtgcagattagggagggcatggcaggccatggtaagggcttggcttttgcccagagggaggtggagttcatagagggttttgagcaaaggagtaacatgatatgacatatattataaaatgatcactctggctaaattaattccttttgccattgcatccttaaaataaacctaaaaatgcagaaaaactgaaaacaggaaatgattttccaagctgctactcaaatgtctaataacaagaagtgactagaatcctaaatcccagaatggtccacgtattatctccccagattcctgatagagatatgtagaaggcacatttcaagcaggcttatattgttttattctaagagggctgaactgggaatgtgaggtttcaagtccttctttgcttaggtgtatccagaggtaatacccagaaactcaaatttagtggtttgagatagactgtagacatcctgttgttaaaatgattccaatgcccatgtcgaaaacacgtctccaaaggctggaaaaatcaactgacattgacaaatgcttttagttttcctttcttggactctatatagctgtactgtctatacagtaaccacaagctacatgtggaggttgggcacttgaaacggggctagttcaaattgagattgtgctataagcataaaacactcagtagattttaaagacttagcatgaaacaataggtttatgtgttagtcaaggttctccaaagaaattgaaccagtaggatagagagagatacataagagggggtttcttaatggaaattggctcatgttattatagaggccaagaagtcccatcatatcccatctgcaagctggagaaccaggaaagccactggtataattcagtctgagcccaaaggcttcagaaccagggggacaactggtgtgagtcctggagtccaaaggctggagagctagaagcaccaacatctgagggcagaagaagacggatgtcccagcacaagagagggtgaattccccttcttctgcctttttattctttccaggtgctcaatggattgggtgatgcccactgacaattatgatcctctctattcagtcgactgactgagatgctaatctcctccaggaatgccctcatagacacactcagaaatcatgttttatcagccatgtgggcatctctcaggccagccacattgacacacgaaattaaccatcacaatgtaaaatgtctcaataatttttacatagattacatgttgataaaatattagatatactaaattaaatacaacatattattaaaattcatttcacttttttactttttaaatgtggctacaaaagaattaaaattacaaatgtgggtcccattacacttcttttctttctttctctctctttttttttttttaaagacctctgtctcccaggctagagtgcagtggcacaatcatggctcactggagcttcgaactcctgggctcaagcaatcctcccttcctagcctcctgagtagcagggattacaggcatgcaccaccaggcctggctttcacattatatttctactggacaggactgatgtagagcttttcaaagactcctcttacataggaatcatagccctctatgataaccttcaaaatacacctacgatgctaccattctccgcagtaatttttttaaagaaaaatgctaaattgcttttttagatctttcttgtaggcaagatataaatagaaggctttgaaaggcaatacaacatagtagttaatagtaagaacttggtagatgtgtgactgcaggcaggttgtttaccttctctgaatctccattccctcgcctgtagaatttgaataatatgtaccccatggtgttgtgagactaaataacatagtccttaatgctccataaatggtagagcctttgtaattggtgctgaaatttaaagacaatgtggagttatcttggattcaggtgatgagattcaacataagaagcaatgcctcaagtccttgcaccaacagaggtgcagaaattcatcatctccctaatgaatcttgagttttctttatacttctgtcatttgattagaaacaaactctcagcatgtcagatttatattcaaatctcagaataaaaataattacagaagcaaaatgtcatttggaaagggtgtgtttggtggtcagaattgtggttgccacgtgccttcgctaaatatcatgactaaaagggaaagacatgcagatctttgctaggaaggcaagagaaagaagaggtgaataaaaggcttgaagctcttgctactctaatcaaattgttttatttgtgagagttcgctttagcttgctctttatgtttgaacctaagtcttttcacctgtgacctcatcaccatttttctaatattgctcagctcattagccttgaaatttataatttagtttttacaccattttatcctatttcttcccattgccaagcacaaacatttactttgtaaaaaaacgtgactgaatttattaaaccagtttgtcttcaaaagtttcccttttttatagacatgggaagactcaaatagttggtttccctaattctcaggagacaaaccagtgaagctgaagccagttttgtatgcaactaaactttgtgccccgtcctttgggtctccaattagaataaaatcagggatgggcaggcagcgtgcattttaaatcaccatccatggtcactattatttccaaactcaaaggcaccattagaacagggaaacatttgcaggcatttcattacaccttgaactattaaaaaaaataagacattagaaagaagtgattactttaaaactttcacacactatggaacaaaagaaatggcaatacacagggagatattatagtaaacaaattgacgcacacggttgttgttagtgaaggacagtattacaagcagatgaggcaaatgaatgagttgggaagagagtcaatctcacttcctgaagcaggggcccttgagaagcctgtgccttttaggctgtttctttgtaggattggcctgggtgctgaaaatagcatagagccttttgcagaatcctttatttcaaggagttgcggtatttcatatgtggcacggcccctcccttcaatggcctctctcctgccactggaaggtgtttttacagttccccttgtgacaaaggacaggtcagagagcaaacctgtgagcaaatcaggcttggcacgcacatcactaagcaacagatgctttctggaaaaccatttgggagtgtttcagatagtagtatgtgtgtgtatatacaaacatatacataatttctggggaaaaaatacatacatacatgtgtacatccatactttctgaaaatcacacacacgcattttccagaaactcatttgaggttgattttatgtgtacggagacagagaaagccatccatccatatagaaagccttttgcaagtatttttaatttatttcatagaagcctgaatttatttcacacaacaatgaataaatccattcttttgccacagacgtggtgcaaaaagaggggtgtgcttgaagcatctacaaaggggaaaaagctgctgatacagggaaaaaatattaaagtaaaattttagttgtcagctttgtaattgaagctgtctcctcacttgaaaatattgtttccactgaagtagaagacaaagggggatctggcaaatgcccccacgatgttcatttccccagataaattacacacatcgtgtgtgcatgaagatgaccagaggctctcactgtgctggggatacagtccaatcattcattcaaggctctgtgtagtcatacaacaaacgcgtggcctaaatccattctttttcttctttttcctttctcttctcattttttcttttttcctccttcttctgccaaaagacagataaagtataataactttgatgacaacctcattttcaggatctctcgataaatcataatccttcagttgtattttccaaaacctgcagttagccaattacttcttggtttccttgaggtgaatctttgctttttaattatattttatcttcttcaaagaaaccactattgaaaaattatagctaatggtagaaatacatcactaagatgtcttggattttcttttggggaggagaggtgggggaataaaatgaaaaaaatatgtatatggccaaattggtctgtgataccattaattcatgttcattaattcaaacagtgtacattgcatacctactatgtgctaggagttgggttgtactccagaaataaaaagtcaaataaaacgtgtttccctcaaggaaactatgttctccagcatctgcacatgtaaactaccaattccagtttagtatgacaaactctttggaagtattatattttgaatgtatttcatcgagaaatgaatgtgggccaggcaaggtggctcacatctgtaatcccagcacttagggaggctgaggtgggtggatcacctgaggtcaggagttccagaccagcctggccaacaaggtgaaattctgtctctactaaaaatacaaaaattagctggaggtgttggcctgagcctgtaatcccagcttctcaggaggctgaagcacaagaatcgcttgaacccggtaggcagaggttgcagtgagccaaggtcgtgtactccagcctgggtggcccagcgagagtacatctcaaaaaaaagaaaaagaaagaaaagaaaaggaaaaaagaatttctaagtctggttttcatagaaacaagtgcaaaacaagccagaggggtcattgccaaactagaaagaagcccagggccagaatatgcagggttagtggagaagcccagtgctcctgggcctgaccacctcttggactcggtataccatcataaacagcattcagtaaacatcttttttgaagaggcatagtaaagaactacctgctaagagtccagaaaccctgtgaggcctcagataactttagtaggaaataaccaagctcttgagttgcttgaagtagaatcccattagcttctaatgcttcctgtatttgcgccccattcaaggaagcaactctagagaatttctttgaatcctgttacttccatttgatgagtgagactcagctgtgatagtctatctgctttaagactgccgatacgatgtggcatgttctctaaagaaggcagaaggcttgaggacggtttgtgttgattgaagaacatttcagtgatgagttggaatatttagacaaatttcaaggcttaattaatatatgaaataaagtagttgcagagataacgaggaaaaccaaagttataatctatagttcatttaccttccttggtcagggcaaatattacaaaagatatgtactgcttttacaataatcagcaaatgggaatgactttgaatttcagaacacatatgggaatgtcatcaacttcgactttgaaatgtggctttttaaaattaaaatataaatcattctattgttaacaaaagtttatcaaaagtaatagggcttttgtagatttttggtttttcttttctattaagatctttactggtagagaaaaataaaattttattaattcaaagattccattgtgtttttatgtttgtgagtaataatcagtggttcctggtatctcatttcgtttttaattcccaaagcaggagctaataagcaaatcgctttgtgggtttctgtgaaaacagctagagtttgcacaatcgtcgcctagacagagggaggagtgtgggctctgaagttcagcagatttgcatttgactcttgactctgtgattagctgggtgtccttgagtaaactactcctgtaagcctcagttacctcatctgtaaaatagggatgatgacatctgctcaaagcgttgctgttgagtaattaggttaaatgagataaaaagtgcccattggcacctattggaactcagtaggagctcatgtcttcatggtgtgtaaatatgtacctggctcccatccacaagagtcctcgctgaatcaacaaactcacaagtgcctcttttcactagactgagactaaaaccgcgaattaaaatggtgtttgtcctcaagaaccactagggtcaagaattctacatggctcaggcagatcagctgagcacgtgagaaaataaggaatatgcagtctaagtacagagctcagatgaagcaacttgctgcctatcaacagaaagggtggaaacaccctggtgtgtgcaacaggcacaaatcatgtaattcagtaagtctacaaatatgtagttaaagaaacaatataatttctaaaagcagtctcctcgcagcaaactgtgaagttagcagcacagaagcaaactgaggcagagtcactggattggagacaagctgatttgtgaaagctgcttgagtaattgaccaacctctgcacaactatgttgcagtttactaaaccagtataaaggagaaaaaaagcagtagaaattaagagcattcgttaagctgtaagtcctttcattcttttggatatattattctaaatgcatcttataacattttcattaataaactgctgttttaattaatgatgaggtctcagtcaactgaatgacatttctttcaagaagcccacttcatacgcacacaaaagaaccctgaaatttttcactaaaggaaaggccaatgtgatccaactagttgaagaatatactattgcaattaaaaaatcatttaattccattcggctcaactcaatgaacatttattgaatatctgctggaggccaggggctagctgggattagacacagttcttcctttcagaaactcacagtctagagagaagcctggtgcatgaataaggcattcacctttaacctccttatccctgttctgttccttcccttctcttcctggtaaggcacgcttatttgcaaaagactttctacatgaaaaaaatatatatatgcatataggcatatacacacacatgtataaatattcatatataccctcaaagtagtttcccaaaattacttgtgtgtatacaaatattcatgttcatatatatatttttttatagaaatgggactatggtgttgtattaatgttggtttcctgactccaacttgctctcacatggttcaggaattacatataatatatattataatatatttaatatactagatatgtaacattaaaaattattttaattatatataatataatgttaaatataaatatatttaaatttttaatatttatatttaaattttgactaccatttgtattatatctaaatataacatatttaatatgagagagaaaacaaatatagtgaaatgttaaaagttagggaatccagatatggatgatataggagttattcatactatttttacaacttttcaaaattatttcaaggtatattggtcttgtaaaaaattttaaaataagggattcaagaccttcctggcctcaatcctgcctttcttcagcagcacctgcagccgtacatcaccccacatttaataccaagttatgtccaacatcctcccgctgtcgttcctgacgctgactgcacattagactaatctgagaaaatgctgaaatatgccaataggcaggcctctccccagacaatcagatcaggactcctgggagtttgctccagccatggttttttccaaaaacatagcctaggttgggaagcctggaggcctgtttcccaaacaccatgctgctgcattcctcatgccttggtgcctgctgtttccagtacttggagggtccttgtccacctcttcagtactgtagattcctattattttgtcaggatccaactcagatgtcgccttccttagtgaaaccatccaggcatcccacgccccacccacaggtagatcccatccttcccgcctcctgctatttatttctacacactctccttctacaggtttcccacactgttgtaatgctgtgtttgctctgtctcccaacccaccgcaaactccgtttgggaaaagtatatatcatgtttgcttttgtcatcagcatgagcctcacatatagtaggagtctaagaaatgtttactaaattaaatgcaaacaaggttatacttgttggaataaagttataacaaggagctatgggacacttgaggatgtgcactcttacagtgcaggcggcacttgcggaaggagatggagctcacgcagaatcgaagagtgaataaatagctaagtagtcgggcaggagagggaaatgggaacagcccgcctcttaggctggctggagccacgtggagtacgcgaaggagaatggccgctgaggccaagaagggagccagtccagacgatgaaggggaccaagagcgttagtcactctggaagcagagtgagcacctcgcactgcgctggcacacagatgcctctcagtcaagcattttagagaaataatgagtgaattcttttttgctctttttctttacatttggcaggggagtcatgggaccggattgaaactaactttcttcccagaagaatgtatttgcacatactttcccgaaaatgtcagaagatttacaggttttctgaaatgtattcagtgacacttcccccaaaatgatatgccacattctaagaagagggatatattttaggtttaagaaggacatggttagactaggatgtaaggcgggtcactgaaagtctgtgaaggacagattataggaggtaagatgcccattggaggacaccctttaagaagtcatcacagcgtggtggctcacgcttgtaatcccagcactttgggaggccgaggcgggcggatcacgaggtcaggagatcgagaccacggtgaaaccccgtctctactaaaaatacaaaaaaaaattagccgggtgtggtggcgggggcctgtagtcccagctactcagagaggctgaggcaggagaatggcgtgaacccgggaggcggagcttgcagtgagccaagattacgccactgcgctccagcctgggcgacagagcgagactccgtgtcaaaaaaaaaaaaaaaagaggtcatcacaggtgccaaagtgaaacccaagtgcctgaaccagaggcatgacagagctgtgcccaagagagaacagatgcaaaaggttacgaggcaatgcaaacagagagcttagggtgtctctaggctttctgcctttgagtgaccatgcagatgcagtgtcattggtcaaactagaaaattcggggagaggatcagatttgtgggaaaggatgaattccattgtgtgaagcttgagtttgggtttcccatgaaagaacaaggcggagtttccctacagaaagttgcaggttgggagtgatggagatgaggctctcctgatgagtgagtatagagtgtgatggaagaggagcactggagggaaaacctcagtgccccaacattttcaggatacacggaggaaaaagagccaatgccttacagagaagctgaaagaggggaaaggaaaaccaaagagagtttccaaaggctccaagagttgagtaaatcaaataagggcagaagtggtctgttcactttggtaactacgaagttcatgaacacctcagtgacagcaacttcacttcagtgaatggagttcaggccaaaatcaatgattaggaagtgaaaatgaggagatgagaaggtttctagaatttccccagttagattgggaaaatctaactggacctctgaacagcattctaacctattggtcagctcctctttcttgaaaaaccctttttccttggcctcattcagacctcgtgttcaaggggtccccggggtgccctaattacttcctctctgttcttcctttgcaagctcatttccctgtcccagtttgaaaagggtgacttctcagggccctcctgtcttctctcttcacacacttctcccagggaattctatccatgcttgcattgtaaataccatcataaaaatgattttaaaatgaatatttcagcccagacttttttggctctttgacttctatgcttccctgacacaaaggcacctcaaacttgacctgttcaaagctgaactttgttgttgttgaaacagcatctcactctgttgccccagctggagtgcaatggtgccatgatgggtccttgcagccccgacctcctgcactcaaatgatcctcccgcctcagtagctgggactacaggcttgtgccaccacaccggctatttttttcttttcttccttttttttttttttttttagcgacagggtccccctatgttgtccaggccagtcttaaactccagggctcaagcgaccctcctgccttggccttccaaagtgctgggattaccgtgtgagccacagcacccagccaaagctgaactcttgatacctgccatatccccaaccccaccaagattgcctgcctctgtgttcccataatcagaaattgtcaccaccatctatccaaaaatccgagtctgtcttaacactctttccttcacctttttaattcctaaacatcatcagattctgtccactctactactccaaaccatcattatatttattctgtcccattgcatagcctattcaatggtctacctatattccctcttttctctttccaatgcattcaccaaaatgcagccagaatgagctttcaaaactgaaatcagattatgtcacctttgcttaaaacctttcaggagttacccgttgctttctgtgtaaaaaccaaaatcctcagaataccacgacctttctatctagcctcacttcctactatggtctcccctgagggtttgtcatcttggcctccactacgttcatcctcgacattctcttcttcctcagagcctttgcacatgctcttttctcttcctagaatactttccctacccccgttaccagcaaaatctcactggccttcaattattaacttaaatgtaatttacgacctgctaaatctctgtcagctcatagttcacagatggcagttattacatatttgaaagaatggattaaaaagactgagtgctagccagaggaaaatagaggttcagggtaggggggcctttaagatgagaatgatttaaagcccacagcaatgaaatgatttgcctggccaaggtcaaaaagcgagttggtggcaaagccagggctgcaatccacgacttttgattcttggcctccccatgtcccacactaatcctttattatatgtcttagatgaagttagctgtagtgaagccctcatctcatttgctgtccccaaaacattctaacctgttgaccaccatgcacaacaggaatacgtattaacacagtttcaggagcatgacccaggaaattctataatagatgcaaactatcttcctgtttaagaccctagtagagttgttcagtggtgctgctcttaaattccaatccaagaaggccacccggctcccacacagtcaagccatagctgattgatgtgtttacagtaatatacttcacacttgtgtcttgtgggccacacgtgccactcaggataaacttagagatttttctttggcattttttctccattgtacagattcagacacttaaagcttattacatagaaactgacctagaagtgaccgggcctttggagagaatggcaggaaattggttacaatagatatggacccacctggggaaacagaactagcagaggtgaacgttaacccatcccaggtccaatgttgttagtccaaaaagattacagtaagttgaagaaaacatcaaacaaacagaataaaaaattcagcaaggaaattcagagtggtacacttggggagaaaaagcagattttgccaatgtaagaccaggagaaaaactggttgtgtttcagcattgcagtatcttgggagaataacaaaacaagtttaagcagagttgtgccatgcagattgcctggaaggaaccaggcctgcctgatgcagaatcatgatgcatgcagaggatgatgtccaaggtccccgggagcagaactccataaaattcacttaactcttttactaggtgactaattaaaaagcagttaatgagagtgatcattctgggcaatggaattcagccatgaaagtggttaatgacctgaggctgcagctcagttctatgcctcctctagcatggttctggctcccaggagagcctcctagactttagcagaagctgcacagagcttcaagaatccaggatatctgggaagaggtaggagagcgcattgggcgacagaaaggagtaagcaaatattaaagggtttatttacagcagaaggtaaaaagaaagaagctcaccacaatgggagctcaataaatgtggtttgcttgagcgactaccttgctgactgaaggagtggatagagcacgtgcatgaggcagcttgcacagtctgggagacctcgcttctcagctccttatttaatgacatcatgttggtagcttgaagtcggacaaggtggcagtattgacatcatgggaaataggcaaaaactataaatcagaatttttccctccccctcaagccagttgcttaacatctaccaacttaccattgggtcacttcgttgaaatccctgtgggagcagagttccctggggttcttaccttaagaataaacctgaaggcgttttggttttgctttcctattttaattactaatatacagtggcactcttcagtaatcttttattacacaaccagagtggctcagcatttgtgaagtctcctggcaaactcaccatcatttaaaacattgtttctgtggggaagttttccaagttgcaagttactgagtctaaaataaatttttggaaaagagcccatttgcaagttgggagctttcaattctgagtcctgataggaaagttagaaaacaaaaagaatcatgccaattttaaaaatataggttgcaaaatataggttgcaaaatcctaagtgaaaaggcaaaaggaatagaattatttaacttggagaagagaaagatgaagagcaattgaataataggagtgagtgccagctgttgtttgcttttggtttctgttttttgtgggtttttttttttctcccactgtaagcctcggggatttggttaaacaaggagataaatatctttatgttattattctggaatgaataattggtggattttatgtcaaacatctgcaaacttcttttcctcaatcagggataatttacatataacctgtgatgaggaccaagaaatagttaagacaaggttatttgtctacttgaaggttaactgtcaactttgtgaccctgagtccacagatggcataatgtatttcaaaactttgagaaacatgatataattaagcaaatcctttttatatcatagaatatctaaatacagaatttattatttttctatcaaaaatgattataaaacttagactattagcattatctatagtagtattatattgtctatatctgttagtattgtctattactagtatctatattactagtacaaaaccttaaaccaagcattctaaatcaatactttttgataattttacgagggaaatgatgctattttgggcttgttaatttagagttattttcagttattcattcagaagagatgagagaattgctttcttttagaatatcttttagatattgcagtaccctgatttggcattttcttaaagagatgtgaaacaatgaaatggcagctgtaaatctgccacttggagccttagagggcttacatcactcccaggctttgctttaacagttggtttatgatgtggtttcagaataacacttttgaacatggtatatcccttcctgcaaaactgacataaatccataaagcttttaatgatgtctctaaaatacagccaaagtagtctctgaggcatatttttggattgtttatctgaaatctctagattgctgaatctcccttcatgatctgccttggaatggctgtctccagggcagctgataaacgcatcatgtctcacccaggcggggaccactcagcttcgtgccccatcaggtacactaccctgcctcagctttcaccccaagcatctcacacccttgtgcgcataagtatcacctggggacctgcgaaaaatgctgcttctccagaacccctgagctaaattctgggactaggcctggggaccagcattttaacaggctcccaggaaagtggtcacagaaatgatgtgagagtctcagctctacatgctctctgactccagttctggcttcgggatggagtaactggagagaggctgacaggtggaagctgaggttcttgccggtgacacgctgcacctgtcactcaggtgctggggtctctgctgcccagacccttccctccctaggccaggttctgtgctcctcagtcttgaatttcaagcgcctggtatgcgtgtcttctcttgcacatcatcctgcctgccccactgtgattcatttgaatgccccagcctccatctctagcctgcctcccaccctccctccaagtcccaggtccacctcttctcacccccgccagagcctgttctcaggtaatgaccccccacattctctagcagaacctctctctgtggcaaactgaactgctcagtgtgttttctccaggcggcccgccctgcctgcccttcctgactcctcctccctcccctgtcctctgttagacacatttacagaagcctgtcctaggagtgtccatctgccccatcagactctgaactactgagggcaggggtcacctgtgccttgctcacgggatccccaacacccagctgaaatgtggtgggagcctcgggggtctcaagtgaatgactgattcttaaaaagaagcacgtgaagtttgtccaggcggcatgatgcctcagacttcagaccctctcactgccaatacactgtgccttcagctagaaagctagtcttcatctccgccacctacctgtacttggctacccacctctggccctccaggtcccagcttagatgtcttttcccacagcaagtcttccaccacccctgtgttccagggggccctgtgtctacctgatcctgcacttacccctctgcattctaataatctgtttacctgaatcctcctccaggtccggagctccttcagagcaagagttgtcagcacccagcatcgtgcccagggtgcagtcagtgctcaatagatgtttgctgaaagctaactcagcacatttaggtagtgagatggggttctcatcacatagctgctaaataaaccgccataacattcactgtattgtactcacactgttgatgcgtctcctcccacaaccactgctagatggaaatcttctcatgggaagtgattgtattttgttcatcttcacacttcagtaagtcaggcagcaatgagcatggattaagtagctgttcaatcctatgttttccaagaaggatagttttggcatgtggagcaggagaattctttttttatttttatgtatttatttatttttgagatggagtctctctctgcggccaggctggaatgcagtggcggatctcggctcagtacaacctccgcctcccaggttcaagtgattctcctgcctcagcctcccgagtagctaggactacaggcacctaccaccacgcctggctaatttttgtatttttagtagagacggggtttcaccgtgttggccagaatggtctcagtctcctggcctcgtgatccgccagcctcgacctaccaaagtgctgggattacaggcgagagccaccgcgccccgcccaggagaattcttaattgcataagacagccccacacattgcaggacatgctgctgtccttgcccgtgcccactaaatttcattggtatcccaatcattttgacaactaccccacctacacacacagttacaaaagttttgggggtaagaggaccaggaggaaaattgcactgcacatagttgaaaagctatagttaagtcttttccttacaacttggtgagaagcaatggactccgtaacagtgccatggtggattatatgtgtcaacataattaacagaaagaggatctctgaaatataagatatttatctggaaataaagcattgcaatgggaatatgcatgccatagttaactacatgcatattcagggaggtgaagacaaaagtttttaaaggaaaaaaggaggaggattacataattgttttaaaataattatccttggctacaaagatcaataacaagggtgacaccagtccaagtttggacaggcaaattcagggcagttgttcttgtagaaccgtttttttgtgtaaggttgcaatggtgtttgggcaatgttgtgctttttgcagagtctctgtgatagttcttttgatcaggcatttattcatggccttccccagctccatttctcagggctttcttttttttttttttttaacattagtgacttcattttgattctgacaactttcacacatgtgtgtggtgatgtgaggtgggggccaggacatgtcaccctcaatatacaacggtaacctgtctttgtaataatagttcactaatctttcctgagcacttatatattccgggcactaagctgtgtattatatagtttacttaatcctcacaaccacctatgaggtcccattttttagggacgaaattgaggctgagaaagtttcaagacattgacccaagttaacacggctgctacagacaagggcaagatacacccccaggcgtcggacttcgctgctctgtgccgacctctttaacaagaacaaacatcaaaattcccagttggaagactcctattaaaaactgtcctctcccattaattataacgtagagcagttttgcacaatatattctgcatagtgttaatttagtgggatgtcaagtgttgtgagattaacggttgcatgggcgatggagtgtgggaaatgctttcagcaaggcccttgtagaaggccgtgaaacagaaaccgtgaagaccacaggatccctaaggtggcacagcccttcacagtgagtcggagtgatttagaacattgctgagcaaacagcagggagaccggcaacaggagcttgctggccatgaagtgcctaatatccagtaagcactgctcaggctctaggaaaaggctgatgcaggaagggtttctttcttctaatttctcaataataataaaaatagatactatttatggagtactaattactctccacttcatagatgaaataccaaggcctagaaaaatgtgttaagtaacttctcctaaggtcacacagctatttagtggcagagccaaatttgaacccagttctctctaacttcaagacatgtgattgtaaaccctatacacaaagtctctaaggacgtagggcttataaaggctttcctgtatgaatatccaagcaaattcagtctcaaagaggatgcccctatgggttccctgtaccagggatttatttttggcatatctcttcaacctgacaattcgttccttggtctgagtacatgaaatttttttcagggtatgtgaatttttttcttggtatgtgaaatttttttctggtataatgtaagtttcttaaattttactatttttttaattttatagatttctatatgatatggtttggctctgtccccaccctaatttcaaattgtagttcccataatcccctcatgttgtggaagggacctggttggaagtaatttaatcacaggaggaggtctttcttgtgctgttcttatgataatgaataagtctcacaagagctgatggttttataaatgggagttcccctgcacatgtgctctctcttgcctgccgccatgtaagacatgactttgctcctcctttgccttccaccattattgtgaggcctccccagccatatggagctgtgagtccactaaacttctttctctttataaatcacccagtctctggtatgtctttattagcagcgtgggaacagactaatacatcataccctgttacatgctttttttttttttgataagagtatttgtgttgatgcaatagcatctttctccatagaacttactcagatgcccttcctggagccagtgcctgcactccatgaactgctggagaggtcattgtagggtatcggcatcagacctctcctcatttttcaattctctctctcctttataacagatgttggtgcattttttgaagaagggatgtggctacgatataactttcaggcaccagcaacaaatgccagagactccagcagcagagtagacaacgctcccgaccagcagaactcccacccggacctggcacaggaggagatccgcttcagcttcagcaccaccaaggcgccctgcattctcctctacatcagctccttcaccacagacttcttggcagtcctcgtcaaacccactggtaaggacaaggatacccagcctctgccatttaacatttgggcagacagaatgttctagcaagagtctatagattgttcttggtttgttatttattccccataggcttttttaagcaagtcacataacttctttgaaccccatttctctccatgaatatcaggaaaacaacttgccagctgggtgtgttagagcaaggtgttagagtaataatgttggtgaggcatgttgcgttctttacaagaatgctgttgcatgaataagagatatgtttgcatgtgtaatgattattttttctccctactaaataaacacatttggctggacactgtggctcacgcctgtaatcccagcactttgggaggccaaggtgggcggatcacttgagctcaagaatttgagaccagcctggccaatatggcgaaaccccatctctacaaaaaatacaaaaattagctgggtgtgatggcacatgcctgtagtcccagctactcaggaggccaagatgggaggatcacttgagcccaagatgtcaaggcttatagtgagccatgatcgtgccactgcactccaggctgggcaacagagtgagaccctgtctcaaaagaaaaaaaagactaataagaaagactaataaaacataaatacattcactaaatgtgctaaacagagatgggctttgaatgagtaaaattaattttacataaattaattttatcctgatttatgatagtataccagtaggttgttacagaacatctgaactttcaataggagtagaaaatcagaaatgtcttcattcccaatcctctcagaactttaaattcacaaagtgtatccctgtcataaaggttgcttaaagcaggagtttattttaattttttttgaaacagggtcttgctttgttgcccaggcttgagtacagtagcaggatcacagctcacttcagccctaacctctcaggctcaagcgatcctcccacctcagcctcccaagtagccgggatcacaggcacataccaccactcccagctaatttttttaattatttgtagagttgggggtctcacgatgttgccaggcctggtcttgaactcctggactcaagcgatcctcctgccttggccaaagtgctgggatgacaggcatgagccaccatgcccggcccaggggtgtatttttacttgtaatatcctgggccatcttggtcgtcaaacacacattaagccagagaggatctgagtgcacctaaaattggcatcctgaggagaatatgcaaatgggcttgtgacccttcagcagtgacctctgagagacatctaagaagccctggagtgtacaaacttgctgaacttgagaagtccacttcctctctgaaaatgaactcatataccttagaattctaagatcactcttttttttttttttttttttttttggagatggagtctcgctccatcaccaggctggagtgcagtggcgcaatctcggctcactgcaacctccgcccctcgagttcaagcaattctcctgccttaacctcctgagtagctgtgattacaggcctgcaccaccacgcctggctaatttttgtatttttagtagagacagggtttcacatgttggccaagacaatctcaatctcttgacctcgtgatccacctgccttggcctcccaaagtgctgggattactggtgtgaaccactgcgtcagccctaagatcacttttttaatgaataaaaatattttaagagcatgcaggaacaaatctctctaactcacttcccattggagccgaaaatatggagactctctctcccactgcccattgtttcctgcccttcagtgattattccactgttatggcatcttaaagagcaagaattttggctgggcactgtggctcatgcctgtaatcccagcactatggaaggctgaggcaggaggattgcttgagaccagtagttcaagattagcctaggcgacatagcaagacaccatttctaccaaaaataatttaaaaattaactgggcatgaaggtgcacacttgtggtctcagctgctcaaaaggctgaggcaggatgattgcttgaggccagtagttcaagactagcctgggcaacatagcaagactccatctctaccaaaaataattttaaaattaactgggcatggtgaggcacacctgtggtcctagctactagaaggctgaggggggaggatcgctggagcccagaagttgctggagcccagaagtgcaaggctgcagtgagctatgatcacgccactgtactccagcctgtataacagagcaagaccctgtctctaaaataaaataatttaaaaaaaaagaaaaaaggagatcaagatttttcccatgggagctagaactgttattactaacttaattcagcttgagttttaaaaaaacagtaaattaaactccctctctaggaaatgcactgttgcttaaaaagatggaggaaaaagtatgttccctagtattttccccttctgaaattattcctaaagaaataagccaaaagtcaaagattcatcatgaagatgttcatcataatgtttcgttttgttttttgagacggagtctcgctctgtcgcccaggccggagtgcagtggcatgatctcggctcactgcaagctctgccttccaggttcacaccattctcctgcctcagcctcccgagtagctgggactacaggcgcctgccacaacgcccggctaattttttgtaattttagtagagatggggtttcaccgtgttagccaggatgatctcaatctcctgacctcgtgatccgcccgcctcggccttccaaagtgctgggattacaggcgtgagccatcgtgcctggccaacatcataatgttaactatgaaaataaaaattgaaaagaatctgaaagttcaacttttagtaaaatagtaaaagagggagttgccattttatggaatattatgtatctattaaaatatttatgaatcgtgattaatgatatggggaaattttatgtatgttaaaccaaaaaaacatgaacaagatccagccttgaatgtgaaatattagctccataaaaaatatagggatagaaaaaaaaaagcaataatgtgaacacaaaagtgtttggttggattgtggatgatttttttttctcctgagcagtacttttgtatgcatgtcaaatgctttaatcagaaagatgaaaacagtaagtaaaatcagaaagtgaggatgaaagagagagaagtatggagcccctggtcttcaggagttcatcagtttatttctcctggatcagggtcaataggtttttttgacccactgatgttcactacccacatggaccagcctcccactgggcagataagaaccttgggtttcttctcaggtccctccccaggaggagggctctcacccagagactgtcaagaagttggtgaacacattcccacacatacttttattgtctgctcctcgagtcactgccacactagatttggtcctcaactgtattcgctacctcacatgcccactgctacacacccaccgctgctgtgccttcatcacctgccactgctgtgccctcatgcctgtgtgaggactttcattgtcttcaagggcgttgatcaatggattctgtattaatggccaccatttaatgaagctcactttgtgcccaaagccatcctgaatggtgccatgcattaattcccatgagctgcacaactctatgaagtagatactattattatttcctttctactgatggcaacacatgagtgcatggaggttgagtgccttgcacactcagaggatgttgggccaggctggggtttctcagcctgggtgtccgattccagacccaaagctccccaccggctgtactctccagggcaggcatctctggaactctcagtgttcttggaaggcaaagctgggtgggttctgtctcactgttacaagactatcctcaaactgctggtgaaaattcagctttttcagacttcaaatacaacatgtttttattatttgaagtttaaagttagaaaaaaaaggaaatcattaggaaaaaacatcagtaaggtctacgccaaagtatcaggaaaaagctactagaaagtctccactaaacaccctggcatcactcacatttcacatatcgaaagctctgctcactgtcctccagaaccagctgcccccagcaccaccactgcccatcagacacttgtgttcccaaggtcagtgtcactcaccagtgctccgttcttccctgcttttgtgggtcacccaggcaaacaagtcctgtgaattgaactcatggtgtccttttcctccccaccactactctctgaggcaaatatcttttaattcccagtagtgtttacgtcatggtgtccatagaaaattattatatttgaatggtaccagggtaaatggatgaggtcatgttttggaggccacctgcccagtgactccagctgccatccccttcttcatgtctgccacggtgtgaggggagccttgctcctggtaccccatcacccatctgtaggacagccgtgggcttcagcttgttggctgggaaattctctcccaatccatctctctgcttccagattctccccctcaccctttttcaccacagccagcaccgcctgcctttatagggtgtcttattttctgttgcttgtaacagaatacgtgaaactgggtaatttataaagaaaaggaatttatttcttatagttatggaggctaagaagtctgaggccaaagggccaaacctggtgagggccttattactggtgggaactctctgcagttctgagacagtgcagggcatgacatggcgaggttaagctgccagctcaggcctctcttcctcttcttatagacagtcccactcccatgagaacctgttaatccattaacccattaatccatgaatctatgaatggatcattccatgaatcgatgaatggatcattccatgaatcgatgaatggatcattccatgaatctatgaatggatcattccattcatgaggacagagtcctcatgatccaatcacctcttaaagggctcacctctcaatatacccatattagggattaagtttcaacctgagttttggaggggatattcacaccatagcatagggatattgcttaaaagggatcttgtataatgtctttattaaacactcagtggtgccccactccagcaaaaccaggagagactcctcagtgccacaaacttttaagtttgagacccaccaagctcatgggtgagatggtggcctgtagagctggaccgtctgggtttgaggtcggctttgccttttgtcagttgtcttgggcaatcagttggcagctccatgcctctgtttgctcatccataaaatagtgtctccctcacaggagtgttgtgaaactcaaatgacaatatgcatgtgtcaacagttattatttcccaggtccacggattcaatctacattctaacgcatattcagcaacccctactcttcgttttgagaaactcattacccctcaagcactctgtggtcatatgtgcacctgactttatgcctgcaatactcccttacctagaaatgccccaacttcctctctagccagacacctgcctttcattctaggctgagatcaagtcccacctccttttgatgacttctccttgctttaaactcctattccacttactttcaatgtcatttgtttggcatttaatgtactgtattgttatctgtctctgtgataaatatgccctgtcttcccagagagatgaaaagctcccagcactacatctcctgcctacgatcagtaccctgtaagtgtgtgctgatgataatgatgatgaccaggagagaataaatctgttaagcatgttatttgctgcatccaataaaagagaagtcccttataactgctttaattcacttgggagatgaacatgagacacagaagtgaagcacctcagcatttgaataatgttttattttaatggacaaatactagcattcttcctaccatcatttagcggtcctcttctgctgttatctgaaaggaataaatacatcatttaaattggattattcaagaatatcaccattactgtttatagatagtcactatatataaatttaaagttccaactcatctttctttctcaaagccaataatttctgctgccattaagtgaagcagttataggaatttaaaatcatatttacaaagtccaagaaggacagaaaagaaaaaaaagagaaaacaatgctgattttaatagagctgaggaacataaaggggccagtgacaaagtgacagcagagaggaaaatgtccagcgttttgcataattgccggttcctccgacctctaggcctctgtgtgtttgtatcctcagagccacacacatattgcctgacccatgccaggggatgggcatggctgtatgtgttataagtggactctacacttgtaaccaggcagaaagcctattttcagacctttaaaaaaaaaaagctgtgctttgcacaggaactaaatatatgtgttctgaagaaatgaataagagatgaatcaaggcagctgtatatttaagaaaactggctgggatgatatgatgtcagagcaccagaaataaggcagagagtaaaaacctaagacaatcaacgtgttttttctgcgtgttgccaaacaactgcctgatcatctccgtcattcccaaacaatggactattttaatgctattgggtaaaggaaaaaccgagtaaacactgaggggtggagagagaagcagctcaagaagtaggagcagcatattcaaaggccctgaggtaggaggagatcgtattttctagggaataagagaagttcgtggtagtttgaatgtaaaaagtgacagtgagtggtatgacttgaaaataaagtagcaggaggaatgcacatcagacagggcattgcaaccgctatttggaaagtacatctttattctgtaaagaattggaaggctttgaaggattttaaatgacccaataaaataatcagttacacattttgaaaacatggggaagaagacggtacagaagcagggagactgtattcatctgttctcacgctgctatgaagaaatacctgagactgggcaatttataaacgaaagattttcattgactcgcagttccgcatggctggggaggcctcaggaaacttacagtaatggtggaaggggaagcaagcacgtccttcttcacatggcggcaggagggagaagtgcagagcaaaggagggaaaggccccttataaaaccatccgatctcatcacaactcagtcactatcatgagaacagcacagaggtaaccaccctcatgattcagttacctcccactgggtccctcccatggcacatggggattatgggaactacaatttaagatgacatttggatagggacacagccaaaccatatcagagaccattcagtcatttattcaacaaatatttattccactcctactgtgcatcaggcactattctagacattgggaatagtcataaagaatagaaacaaaaattcttgctctcatggagcttatctttgaataggagaagacagacaataaacaaattggtacaatctatagtatgttgtgtgctaagaactgttatggggaaaatatgaggcagaaaagggagggcctggccaaggggaaggagagggtaaattccacttttaatgaggaagtcacagaaatgatcactgagaagaggacatgagagcaaagacctgaaggagtgagggcatagccatgcagagacctggggaatgagcatcctgaacagaagaaccggtgactgcaaaggcccttgggtaggaacaggaagccaatgtggatggtgaggagtgagcaaggaggagagtaacaggaggttaggtcagcaataatgaggagatcatatggggcctggtgagccattgcaagaagtttgatttttactctgagacggggagttactgggattttgagcagaggatcactctgaccaccgtgtggtgaggacactgtgtatctcagggtcagaggcccagtgggatcagggaaggttggagaaaggacaaaagctagtataatcccagcaaaagacactggtggcttggtccagggggtagagatggagatggcgacaagtggtaagattcagggcatattttgaagatcaagccaagaagacttggtgtcagatgacacatgtcatataggagaaagaggacagtcaaggcttttggcaagaataactggaaggatgaattggcaattcactgaaatgtggaaaactgcaatggaatacttttggggagagaagatggatgttctgttgcatatgttatgtttggggttgccagtaagatatctgagggaaaatatcaagtagacagtttgtgaaagagtctcctcaatgccactgtgtctcctcaaatgaatgtgctgaaaagttatttaactcactcttagtaagaaactactcctagaatttattcattaattttcaaatgataatttcacacttcttgactggaatatcattttgaagattgctgataagtacaggtgtttctgtagcttattaataaaaatatgctattattaaaaaaaaagagtctggagttcaagagagaagtctgactagggtatgaatgtggtgtctgatgggcatacaccttattcaaaggtcctacataggataggattgttggagtaggtaggtagacacacgagcagggcagaagagggtgccccctcccaccaaccaccaagaatgtcagacaaccatcaggtgatggtcaggcagttgctaaactgtctctctctaaaatgataattggctgcagctggcaccaaggaacgaccgtctcccaatagatagaaaacatctggagctggtgatcagcagcttcccaatcagatctcaggagttgggcaagcgggcccaagcatgcacactaagaggcaaaatgatggagtttaacgggtatatgaccttcctctaggaacactcaactggaaaggggaaaaaaaatgcctcaaatgagcatgcgcactacttcagtaaacacctgtgcatgcagcccctcccacgtgctcgcaggccactgcgcatgcagacagcccgccccaagggaagaatcaggggagaagaaaccaaaccccagaactatgccaatgtataaaaccccaaatcaagggccaaacagggcacttggatctctcaagtcgcccgcttggccctcttccaagtgcacttcctttctaaaactttttaataaactttcactcctgctctactaaaacttgccgcagtctctccctctgccttaaacctacttctgcccctcaagccgcattctttcctctgaggaggcaaggatcaagtttgctgcagaccctttgggattttccttcagtaacaggatcaccatggaaacaggcctgaatacaaaagagaatatgcttcagggctggtctttggggactgcaagagtaaggtgccccaaaacgaggggaaaaacaggtagagaaggaaaaccgaaagagtgtgtgctggaagccaagtgttcccgggaggtgaatgaattctgtgccgagtgaagatgaggcctgagagggacaattgcctctacttccccaagggtcacgggcccagcaagagaccgtggagcagggaagacagaagtgagacagagggctcatgctaaaatagggacgggtttggaggcagcaagtgtacccatctcttttcatggggttcggagcaaagaaaagcaaaggataagaggcctcacttgagagtgaaatgaggtcaagagcagtaatttttaaagaggaggctgactaagacccaccatcttctgcaatccaggcagaagatggtgcaggtaaagcacaggtgaggatgaaccaggagctctgtgtggagctgcctcagccagggagcaggctccctctggaattcacacaaggacactgtgggtgccaacagaaagcctgtggttaccgaagtggaaaagagtgagggaatttagatagatttaggagacgaaaatccaatccacggtgcttagttgaaatgccaggggcaaaggagtctaggatgacattctaaggtaaaactcagaaatagtgaaggtttgttgaatttcgtttagaaaacaaatataggaaatgtaattagctcttgattattctaacaaatgttcctttgaaatccaggaacatggcaagtgtaatgttaggatgcctaaataaggaagagcacagcgtgtgtgtgtgtgtgtgtgtgtgtgtgtgtgtgtgtgtgtgtgtgtgtgtgaaagtctggaaggagctactcccaagatgtttagaaaaattatctttgggtggtgggatttcaggtgactttcttttattttttttctgtttactttctatgttttaattagcatgttttattttgtaacttaaaatcagaatatcagttttgttcccctaaaaaggaaatgaaaggtgacaaataatccattaggtgatttgcagttggtcaaattcttgctagattgctggctccatttttaagctctgagatatcaacatgaaaattccaatttgagtaacaaatgagataaaatattgatgtctttaaaactcataactaagatataatatttatgcttgcagattaactaaaagcaggatctacattgtcatattagttattttcaatattgttttttattgttgggacgaagcaaggaggaaaaaaagaatatactgttgaggcaaagtgaactatcattgagggcaaaaagggactcaggggaccagggaaagccatctttcctgttgatttgcatttgattagtctgtaagctaaaataaaatttattacttggtctcaatgaggccacccaaaatctcatctttaagaactatgtttggccaggagcgtcggctcacgcctgtaatcccagcactttgggaggctgaggctggcagatgacgaggtccggagatcgagatcatcctggctaatacggtgaaaccccgtctctactaaaaataccaaaaaaaaaattagcccagcgtggtagcgtgcgcctgtagtcccagctactggggatgctgagacaggagaatggcgtgaacccgggaggcggagcttacagtgagccgagatcgcgccactgcactccagcctgggcgacagagcgagactctgtttcaaaaaaaaaaaaaaaactatgtttatttttaatattgtatgctcatgattcttttatatgcccaatgtcacactttgctgacggggtgagaacatccctgcactctgcatttatttttttatttcacatagtgtttcgtgggacctgcagatgtctcctccctgcagtcctatattgtatatgctctcattctttgtgtccaggcataatcccaacttggatcatttaaactatttgcatcttcaactttgagacgacagtcactgaagttcactgtgggcagattgtaaatatgtgcgagcctggtgctgtcagccgatatgggtcagtaggcctctgagctcgtgaatccaaattcaaatattgaatgttatctgtggacatcaagggagggagtaaagtttaacagaaattggatgggcatggtggctcacgcctgtaatcccagcactttgggaggctgaggcgaacggatagcctgaggtcagaatttcgagaccagcctggccagcatggtgaaacccccatcactactgaaaatacaaaaattagccaggcgtggtggcaggtgcctgtaatgccagctactcaggaagctgaggcaggagaatcgcttgaacctgggaggcagaggttgcagtgagccaagatcgcaccattgcactccagcctgggcaagagcaagactccgtcaaaaaaaagaaagaaaagaaaagaaaggaagaaagaaagaatctaagagcaggaattgaggggatgtgacattaaaatgaaatttagggcaaacaaattactgagctttcttttttcttctataggaagcttacagattcgatacaacctgggtggcacccgagagccatacaatattgacgtagaccacaggaacatggccaatggacagccccacagtgtcaacatcacccgccacgagaagaccatctttctcaaggtatacatacatgtacatataaattacatataatatcgcattatagtccctgtccctataatgcttggccattggttttgttttgaggggatagaagtagaagagatgctttttacactttctcctacaagtgcataactagtgaagtagaaatatatataattctgacaaggaaagacaatgatgaagttgaagacatcttttagggggaaatagaataaatgtttattccgtatagtctttctggttttcccagttctagatccacatatctatcaatttactgcttttatccattgcaccatctttcttcgccaagctctcagacatctgaaacttaccgtgtttcccagcaaaggttattttggtttctccgacctacttctttcactgctccaacacaatacaaagagctgtatttttctctctctctctgcagagcctttgtcttaaaaatcctcaaaacagtctttccccagaatctcagactctgactgtgggctttcggcacacaaagggatggttttattatgacactcaaattttacttcaggttcattgacgaccccggccctcaccactgatttttacagtgaagaaaccagcttgggaaacaccatgaataaaacataatgtgaggaggtctccctgggagctaggccaagacatcaaggatgggaactgtcactgcattctctagaaggagttcaaaatagatgcctgtcaggagaaagaacagcaggaggatgctgttttgtcagtaaagtggagtgtcatttggcaggggttcagcagcctctcagacctcattctgattcggctggatgctgtgggaagttcaggttgcaaagaaaaggcacaagccctatctcttttgagcactggtggatgtcagattcataacttgatatggagtttgcgcgtggcctttagcagtaaatgctagagggcattttaaggagaggcctttcctaggaaactgacatgcactgtttcagcttactgcgccatcaatcaaaggtggcataataaggttctctcatcatggtcgacagagtcccagagcccagcacagtacctggcacacattaggggtgacaaattctttatggagtaaaccaagcccatctttaaccaagttttagtcagaaaagccagcaagtccaggagacagatcgttttacatcatttcatcaacattgtctccctcggcttttgattagagactttttccattttaagccacccaatttgtcacctcttttaaagaaagtgacttatcttgccattttaccattgcgaaataatactaaaacttaaaaagacctaaacaatggcttttcagacagtataacagcagagacccaccacagccatagaatcgtatacagtttaccctcactctctgccacagtgaattagagaaagacttgaggaaggggagaggagtggatgatttttaagacttggggctttggaggcacagaaagccagagatatagacagtggagcagccagagacctgcagagaatccaggggatgaatgggtttgggggagggtctggttctattgcccaagactattttggttgcaaatgatagaaaagcaattcagaagtaatttgttggggaaaattcctagggtaggtcatagaattatagaatttgaaaaagataaaaccaaactttgggaagagaatctagggagcctggagaattaaaactgtggactagaataccactaggtttctctctcccttccttccttccctccctctttttcattctcatctctgcctctctctgaagactggattaattacctcttactgcatgctccatctttcacatatcctaggccatagtcacaggagtactgggctcatgtcttcccaattttgttaccggaagaaggggtcctagtttcttgacactcattttaaaatcccagggaatctctgataggcctggtttgagtcacgtgctcaccttgttgggtggaagggggaacaaagacccatagtccctaatcacatctcttgattagagtggggaacttgggaaactccctcaaaagaacagaatgcagttccagaaaaaggaaggagataggacgacaggagtgaaaattttggatgcacgattctgaggtaggagaggagaaaaacctgggaagtgcttcctcgattccgccctaggttctgcacctggaagtgttgggagatccagctctccctccttctctgtcatgtaatgtaactgactgcagtaagatttctgaatgtcccaacccacgtgagggcaactaggaaagatgtcacggcctggggagctccaatctctcagcccagcctgtcccatctaccctgggacctgcccaccactgagggcaaaaagaaagtaaagatagaggtggtggaggaagacaagatgtagttcctccttatggaaaagcagatcccagggcttctcactcccatgccccactttctttcatgcagggaggccttgcagacgtggaagtaattcggaaagtgctttgcaacaccaaataacactgcaattttttcttaaaacaatctaaaaatccatcttgagaacttctacagcctcaactgtgtgtggaaagagatataataaaatgttcacagtgatcatctgtgtgtgaagggattatcaatggtttgatttcctctagagttttctatttccccattttctattataagcacatgctgcatttttataatcaaacagaaatatgaaacagccatatattctcaacctattctggtagtccccagttataataacatatgataacaaaggcatttcaataatttcaaattaatatttatttatttatagtcaaagaacaaaaataaggctaatgcaaagatgaatggtagatcacagtgctgtggaatgatgtctttggaattaaggtgaatgttgatgcatttatacatgctcaaacatataatttagatgatcctcatcagtgtttatggtgtctttaaaagcaggtttactttcgtagctgggtttggctaaagctaacattaaattaatctgcattccctcagcacacaccctgtgaaacagcactgagcacttgagggaaactgaccttggatgaaacatttgctgccaaaagacaaagtacccagtctccacatagataacagggaactgactgtagtagttatcagacaccagcgtgaaccagaacccatggcatacctccagtggcatcatttgtgaaaactcacagtcgcatcagggagaatagcttaaggcttaatgccagtcaaaatataaacaaacaaggtgcagccagagagcacctgaaaaagtctggcatgcagtgaaaaattatgtcaattagcatgaatccaaaagcgaaacattctaatcaacaattccaaagccttgtgcaactaaccctttcttcttcctttccttccttccgtcttgccatccatgtttcttttccttcctattttttcctttctctcttcccaaccacattgcacaagggatctaagggggtttacagggagaatattaaatgaaatagagagttaatggaagtcacaaaaagtaagtccccaagatcgagaaaatagaacatgattatcaggtcacaaggtcttaccacttggataaatttgactgtgaacttctcggcagccagaagtatgcaacccataaggatgaactaagccagttcctcttgagaattgaaccttttgttattatatcatttttattttatttaattccatggattgtatttactgacatagaaaatgcccatagcatactccacttatacaacatcacatacacgataacagctcacatgtattggtgcttactgtgtccaaggcaacgtgctaagcactttagacacattttctcatttagtcatcacaaaaactttatgaagtatgtgccatcattattcccatctgatgtgttttggaatgtgtccctgtccaaatctcatgtcaaattataatccccaatgttgaaggaggagcttggtgggaggtgattggaccatgggggtggatttccccctagatgttcttgtgatagtgagtgagttctcatgaggtctggttgtttaaaagtgtgtagcacctcctgctttgccctcttcctccttctcaggccatgtaagacatgcctgctacccctttgtcttctactatgattgtaagtttcctgaggtctccccagccatgcttcctgtacagcctgtagaactgtgagtcaattaaacctcttttctttataaattacccagtctcaggtagttctttatagcagtgcaagaatggactaatataccatcttagagatgtggaaattaaagttcataaagtaagatgcaacctgcccaaagttagaaagcggtaaatggccacagcatagtcgaacccaggtccgtcatacttcaaagtgtacacaggctcttaaccttgcttaatagacagatgtctggaaggatgttcacaaaattttagaagcagatacctctggctggtaagaaattaagtgatgttactgttattaccataagatagttcaaaatatgcaaaaacacagagaataataaaccatatgctatgtacccaccattgaaacattacaaatttcgacattttgccctatttcttcagatttttttaaacacagcaacaattaagagtctgttgtcctcctggttacatagtgggccccaataaaagtcagagtcaatgccctcagcagcatttctgcaaatgtatttgttacaaggctgttagatgctgaagctccttgggaaagtaaagcttcccattttgaattcagcccaaacaagtctgtagagagtgaggtagagcaggatgatggacagatgaagaggccaaaggctgagatgatgcagctttctgaaattttgaactgatcctaggataaaactagctggaaaatgataatgaataaactacatgttctttgaataattatccatgacaatcacacatttttgggtttagatgtgagttagacaatagagagttcagggatatattctctggcacagatactcggaatccatattctctacaaatcaaatgaacagatggtaaggatgtatcattttggctttcatctaactagagggccatcttatctttgccaagaagaagctaacagattttctgcaagcaaaataaggcctttcttagaaaataattctaggtcctcaggaacaaatgatgattagatccccaagttcttacaccaaaaagaggatgactttgattattttcactgggaattttcaaaacaaatgttcaaaaatatcactgaattctgttctttaaaataatataagcacggtaatttcttacctgctactaatctgaatttcaaccaaattgtataaaaacaattgcatcaattgttaattgaactaggtcctgtatataaatcttaagaactgtcagagaagtgtcaaaaacattagcaacatgtagtgtgctaggtgctagaagtagaagaaaggatacaaatattaggatgatgccagttgctatacaaattagccctcaaatgtccatgttttaacccaataaaagtctgtcttacatcagatatattttcagaaaaggaaagttctctggtctccagcagtgatgaaattgtgctgggcaggcactctgaggacctgccactgccaccaacttccctgcttccccaaccctggattaggccaaattattgtccattattcttgaagccctcctgggctccatcctctgggaggctcttccttgtgtgtgttcagccatggcctcccctgaattatgtgccggataatgtgctccttacagctgtgcagcaattatttttttttttttttttttgagacggagtcttgctctgtcaccaggctggagtgcagcggcacgatcttggctcattgcaacttccacctcccgggttcaagtgaatctcctgtgtcagtctcccaagtagctgggagtacaggcgtgtgccaccacgcccagctaattttttgtaattttagtagagacagggtttcactgtgttagccaggatggtctcgatctcctgacctcgtgatccaccctccttggcctcccaaagtgctggaattacaggtgtgagccaccgcgcctggctacagctgtgcagctttaaggcccatttcctgcaggttcaaattacactaagggttttttacactcataagccttttgtggactagatctgtgctttcttttccaatacaattccctcaaaacccaaggtggcttctgatcaatttgcttctggtaagtttcatgtgctggtaaatgcaccctaagctcttccctagacatcaatcttagacttactcaatcatttgcctccaggcgcccatgcctctctctctcaaggtaatggcagctactttggggccagtggacacaaaaggcttgggtgggaagtaaagacccttaatttaaatgttacccgtgaggctaagtcagtttgctaaacagaaatcttactgccccattgttggtcaaagcggtttgcagtgttatttcttactctctagtgtaaggctctaaatatctagacttttttctattcttttcattgattattgggaactggtcaattctttcctgaactcatctgctccatgacatgaggagcaaaaagcaactgacacacacgaccattctgtctcttttgaagaactttccttaaagctacttaggcatttagtctgccttccaggttatgtgaggtgacagttttacaaaatattttattgcatactatattagtctgtcttgcactgctataaagaaatacctgagactgagtaattcataaagaaaaaaaaggtttagttggctcacagttctgcaggctgtacaagacgcatagcagcttctgcttctggggagacctcaggaagcttagatggcagacagcaaagggaaagtaggcttgtcttacatggcaggagcaggactgagagagagtgaaggtgctacgcactttcaaacaaccagatctcatgagaactcacatattatcaggagaacagcaccaagagggtggtgctaaaccgttcatagagctctgcttccatgatcccatcaactcccaccatgacctcattttggacactgggaattacaactcaacatgagatttgagcagggacacatatccaaaccatatcacataccattcttcctctgtctttcaagtccctaatattcattcctgcaccacctgccaccttaccacaaagccaatgctacatgtgttaggtttctgttatagcagcaccctgccttaagataccaatgtatgtattcgttagggttgtattcgctgctataacaaaaaatcagaggcttaatacaaataactttctttcccacataatagtaaaatgatttctagttggaaatcgtaagcaatatataaataggctgataaaaaaggtgtttgtactaatgtccaaaaataatagagtaaaagacattgtggttctatgctataactataaggctttgaaggaaggataagatgttaacctgtgaatggggggcaagagaggacatggaagaatatttattatggaagagggagaaggagagggaagatgtgtgttccaaaagagaacatgatgttaaacaaagatgctagcagagtgactatttcatagatttcatcctgtctctatctcatgaatagaaaagaccactggagaagactcagtaaaaagtcttacctggagaaattctcactctgaaatatgtaacatcaaatggtctgaagtcatttatgaatattgaatgctgtaaagtcagtagtctgaggcacatgcagagtggtgtcaaaaattgttggaagaattttatcagcagcaaaatgagagtaattcaattatggactcctagggcagcaccaaatgttaattgacgtgaaacattggtggccgggggagccctagttcaccactttctatatgtggaaaagtgtacaattgtaaggactttcacataacctcctcaagcccagagaaaaatctctgtagacttgagagggccttaatgatcatgttaggtagtgctcaaagccctttcttacatatcgaaatgcttgcccacattgccattctcagccttatgaactggaaatagctggtgctattagtcccattatatacatgagaaaacagagattaagaagtcccaggccaggcgcggtggctcacgcctgtaatcccagcacttcgggaggccgaggcgggtggatcatgatgtcaagagatcgagaccatcctgaccaacatggtgaaaccccatctctactaaaaatacaaaaattagctggacatgggggtgcacgcctgtagtcccagctactcagggggctgagacaggagaatcgcttgaacccgggaggcagaggttgcagtgagctgagatcgtgccactgcactccagcctggtgacagagcgaaactccatctcaaaaaaaaagaagtcccaatgatgaataaggtcccagtgctcacaagagacatgatcttctctagaacccagctaaccagaccccgtttccccacttagtttgctctttgttgtctttgcaagtgggcaagagaagcaagctcactcctgttcatttgccttataaacttttgaaattttttaaaaatgtttacgcaaaattaagtcttttgaggatttgtgttttctttggagtcactaaaagcaatgactttatagcgtttcgtagggggtcataaaaccctaatttttataatcaaagagaactacaaggtccaacgttaaggctagtgtttttacagcacacagtatcatacacccataaaaattccatctcattctttaagtaaatatgaacataacctcttgtctgtccattttaggatccttcttttctgtagaaacatggagcccagactgaaattagatactgaagctcaaataaattatttaaaaatgtgtgcctttattacccttgaactttctgccaataaagaacaatactaacaagcatatggatgtaaacactcctaaaaattttactatcagaagttgttcatgcctttattaaggaaaataacacagtttggaagcactaaattttttagggatgtcagaacaaataaagaaagttgacctagctagcctagggcactgctcttgaaattacatttactgtaactccttccctttggctaatttagtttttatctactctggatgataaactcacagcctgggttgtgcaatacaagcatgcttgacagaaggcaggcaattgcaagaataatgatgagccatttgaacactctggcttcttcccttccagaagaacttttacctattatagcactggctctctattgggattcttagcaagtgtattagcacttaactttccactttaatgaacgactgacatgtataattctatggagagcataggccaatattttattagtttctgatagtattacaatggtttgagtctattgaactgatatagaagatctatgggaagagaagagagagggctacatatattgggaagttgcccattaatttggtctgtatatgagtcagaattcattttttcttctatatttctatgtatccagagaagcctgttcatgattgagagacacatcaaaaacctcatgacctcattagcttttgtaatgtcgcctctggttttgggttgagctatggctcctcggcccctgagaaagtatttgagcacgttttcattatttggttcagaaagtagcagtatttgacaaaatgtttctgaaaagaggaaacaagatgcccaactaccagagcctcagattcctctccctcccagtaccttcaaaccagcttgaagttttaaactcaggccacctccacactgagaggtctggccagcccgtatgcaaggacatggttcctaggagtgtggtggaggcgtgtggtgaagatcctgctgaagaagacagaaggttctcaagatgtccaggactcttctgttatcaatgtacttctcttctacttaaagccacatggggtccctaagaatttaacatgatgatatctaattgacattctctcttacccctgcctaccactaaacccaccacatggtgagaaagttccaaacagcaatcgtttctgaagcctgatttggataaaaccagatggtcaccaaaaccattccattaggccatttactgatgtggaatgcaattaaaattgattccactttaatcaaaataactttgaggagaacaaatatgtgctgagtatctacaatataaaagaaatttggatagataatgatgagttggtggaacagtaggtgactcatacagggatgaataaaatgtatcttttacaactcaaggagtttatattctgggaggggagaaaagatgtgtccagtcactaggcattttgtcagataatagaaacctgttccacctacttctcctctagaagacagtttgacaagtctccttatcaacatgtaaataataaaaagggtatccagcaaaagagaatattagcagtttggggtggtgataaggacacagcacgtaacgagatttccccttgaggacaatgtcagtgtaaacagagaccccacggattacaaactgttgaattcagaggttattattaagacataaatttaaaagggtctttattgataggctaccttactatattagggctctctagcaggacagaactaataggatagatgcatatataaaggggagtgtattaaggaatattgactcacacgatcacaagctgagatcccacagtagaccgtctacaagctgaggaccaaggaagccagtcagattcctaaaacctcaaaagtagggaagccaacagtacagccttcagtctgtggtcgaaggtccaagagtaccaaagctgacgaatttggagtccaatgtttgagggcaggaagcatcccagcatgggagaaagatgaaggccagaagatgcagccagtccagtccttccacgttcccctacctgcttttatcctagctgcactggcagctgattagatggtgcccacccagattgagggtgggtctgcctttcccagtctactgactcaaatggtaatctcctctggcaacaccctcacagacacacccaggaacaatactttgcatccttcaattcaaccaagttgacagtcagtattaaccatcacacttacttaatagctctgtgttctctagcaagttaatgaaatctctgttgacttaatttctaaaattggagtaagtccatcttttctaatgcagtttgtgtatgttaaatggaaatacaaaaaaaaatctagcatagtctatgacccaataaaacggtagttttcttccttcattcccaattcccttctctttcttaaaagcaaaaaataaaatagcagatgtcaggatcagtaccaacaggctctttgggactatggtttctttccattgatttgtagttcaacccattaagcatattctcagcacctagtatattcccagcatgcagcatggctgttgcctccatgagcccagtccagtagaagaaagaccatcagtcatacagatatgaaccaagtgcccattgaagtataagcttgtgctgtgggagcacagaaaagtaggggaatgaataatcctgaggaggaaagagtggatcagagcagtctcacaaaggcatttgagctgttccttcaaggtttccatggtggaggggggaggatcacattagcttatttattttttactacagagattcaacatttgcccttcataaaaattatacagaaaatatgttaagaaaataagttctaagccatcaagcccatctgatctgaaacagaaaaagactcataatgaatatgtcaacacttccacatttttcatttgttttctaaagcaatttcatctgcaaatgaattatgcactccagggctagacagtacctccattcctacactccagaaaaatgtgtttacttcgttttacatttcatgcagctcagtgggaaggcagttgcaatgcaatttctgatccagtttagggtttgagatgtcagtcctctctttctttctccagaatacggctaaagcttgtaagaccaaggttgggagttcacttttttttcctccaagtgcattaaatacataaatcacctctcaagaaagaacataaggttcctggatttctattttgtctggcatgaaaactaaagtccaatctgcaaagcatcatactgttatatccatctgcagtgcactaaaatcactctcaaagattgtaactcttggagcaaatttttagcacaatgggcagagcgggttgtttcttgcccaggtaactgaagcaggttcttatctcacctaaattcatcttctgtctgaaaagtaagtgtatctcaacatgcggtttgaggttctgaagggttccacgctgcccttccactcaggcagggagaagtcagtcctgggattgagtctgaagattttgatggacatggtcctggagcgagttcggagctagtgttaaaatgccctctagtggtcattagctgtaaccagtgagcgtagggaagggaaaatcttgtgaaactggcttgggtgtggttttctataaacaccgaccaaaaccagagtcctaggttatagcgcgggttacttgcatctgtcgcggataccgcgatggcggtaggacttggtattacttatagaaatggaagcttgccgttgcattcaaagggtacaatccagggatttttcttacgctttcacatctcactgctctgtccctgagccctgggcacacacgagagtttcaagaagtgttgactgagtgactgaatacgtgaaggaatccagtttatgaatcatggattctgtgcacattcaatgagcttggctatttgaaagtgcacaaattcttcctgctttctgaagtattaaatatatttgatttgcatcctttccccagtggtcgcttggtgagctaataattgcctttcctcttatatctttgagctgaggaaatataatcaaaatgttaaggagaggggcaacaaaccccccctttgtgggtagaagagaaggtctgggctggcagctcaagagaaaagatgaagaaaggacatccaaaaagaagtggaagtcagagaatgaataaaacacatgagcgaatggctgccatcctatccgagcatccttcctgatattgtcacccagggccaccagcagaggttacatggtgagaacagacagtagaaatcagcccactccaccgatctgactcctggtctcctggggaaatggcattaggatctaggttaccaacatcatagcttctgccagggcttgtgtgcttaaccccaacagtggaacaccacaaatgcacaggggcagtagcctccaacatcctgaccatctctgagaacctgtcctgctagcagaggggacagaggctgtacaaatcagaaagttgacgtattagtccattttcacgctgctgataaagacgtacctgagactgcgtaatttacaaaagaaaagggtttaatggaaaagtcacggttccacatggctggggaagtctcacaatcatggtggaaggcaaggaggagcaagtcacatcttacgtggatggaggcaggcaagagagagagcgcttgtggaggggaatgcctctttttaaacccgtcagatctcgtgagacttattcactatcacaagaacagcatgagaaagactggcccccatgattcgattacttcccaccaggtctctcccacaacacttgggaattcaaaatgagatttgggtagagacacagccaaaccatatcaatggataaaaggaaatgtaatgtcaactaaagacaaaaaaaaaagaaaaaagaaaaaaaaaacttttgaagaattaaagttggttttatttagaagtcttattggggactgtagactgaggcctacaacccacaagcagtcttttacagaggttttatgagactgcgccagcacagtattttagcccactgtgtatatataggtgctaggggtttagcatgtgcaaagttatatgaaacttgtttagacattatattaaagtagaactacgttaaggtttgggtgtaagggtatatctggttctagattatagaagtgtcatcactaatctccccagatgttattttatgcgtaggagaaggtaaggactaggttcatttgtcttttaaggaatatagtgacttaggtaggagagatgggggccaggtgttctgttttattttgtcgttttggagagctgtatgtcatcacagagttggggctttgtgaaattatgttggcacagagacaagcaaacttagctgcttatgtatgtgattttgtctcacaagttctctctttaggtcacaaattaactctggccatatttataaaaacaatattgattgtgttatgtagctgagaaggctgttttttaggaaggttggtaatctttagttgtagttgtaaggaatgagtattgagcccagtgtgtatatttatttattcattggaaaatatgttttggattatatttatgttttaattactaggatttgttagggtttttgatgttgcctttttgggggttttgtgtgtgtgtgttttgggtttttttttttttcaatacagggtttcactctgtcccccaggctggagtgtagtggcatgatctcagctcactgcagcctccgcctcctgggctcaagcgatcctcctgcctcagcctcccgagtagctgggaccacaggcatgagccaccacacccggctaatttttgtattttttgtagagatggggtttcaccatgttgcctaggctggtctcaaactcctgagctcaggcaatctgcccacctcagcttcccaaagtgcaggggttacaggcatgagccaccatgccaggctgttgcctttttttttaatctaatataacattttaataggacattataaggatattatagattacatatagtagtctatatttaatagtaatatgatttatagattttgaaaaaataaaaccaataaaatcagaatatgcatttgtatttttttactaattgtaccttttgtatttatatttactagtattttttatgaaaagcaattttggactggagttgattgagaatacttttagagaagaatttggaataacaactgggttgtcttgtgcatttcctgtgggcatgatgccagccttgctcttctatggcaaaggatacaggttggcacatggaggagcttggcctctgcaagcccacagacctctgggctagctactcagcaactatgtgtcctctagacacagtaacttaatctctgtgcctcagtttcctcaactgtaacatggggcgaataagagtatgtgccgacagagttgtgtgcaattaaaaaaataatatgtgtaaagtacttatggtgggatcccacctgcagttcgcctccaggaaatgttagatgctgatgtggaggaggatgaaggggaggaccagatgtttttcctgctgctggcatattctgcgcgctgctcttccttctcccaaatcctttcagcagcattttctttcttcccgagattgccaagggaacccaggcagaatgccaggaactaaacctctctggaagattgacggaagaagagctgggatttgagcaagatagagcgggctcagggtcaccatgaggttcaaggtctgcagactcccccaagctttctctcgagtagatttgaacacacaatccaagtccaaatccaaatttaataggcttctgtactgagaattcagctcagccaattgtgttagagccttaatgcacatgggtacacacacacacacactcagtgcacacaatgagcactcgtacagggccgggtcacaaaagaagcgaatgtccatcatctcccttcacttcccctggtcttttctagtctccattcctcaccatttctactgaattctcccatccctctccaccttctacttctggaacgagctccaaacatagcattaaaaagcttcagtgtttccagggaacagagcattgctgctttccataaactggcagaactggtcgttaaatggaactttcaggcattcccccacattctgaagtcactctctatgtaatgatcttcctgatacacctttctgctctttcacctggaaaagaatttgaaggatgtggttatcagtcctctgatgatgccaatgtttcgactccatcctgaatattgttattgctgccaaaacctactggtaaagtaatatcaatagagccaccgtactaaaaaggatgtgtctgctacgttgttttctttaatatcaaggactttaactatattacagttaaaatcaatagaaatgtaaccttttcaaccacataaaatgagttcatttttattattattctttttctgctgttacagtgctgtgattgcaaaagcaaccgggtcaacttaagctttattgaaagaccattaaagaaacaaactcaaactcatttaaatactgaagctggtgcattaaaaagatcaataaagtaaaagcaactggggttgctttacttaaacaccccacatacgagaatcattccacaatcacaatttgagcaaacctataaaactaggagaccagccaataaagaagaaaacgctgtttcattactaggtttagacccataaagcccttaactttagtctgattagacatactgcatttaaattttctctcagtattttaaaacatcatccagcaaagacttattgatcaatgaatgtcatttacttaggaaagccattagctccctgagttaggggaatgactcagtggtagaaagtgcagtttcatttatttaaaaataaacacaagattaggctacagtgaagggaagttctagactcacagggagtcaggaaattttctttctatccttgctgagcgtggtatcttgaacatagttatttgtattcaattgaatgtttactaccaattctgtggccatggattagacacaaacctctttgtgtgtgcctcagtttccccagaggtagaacgcattaatatccttttctccctctttctctggataagaaaacaaaaatgattgacacaaacctcttcaagttcttccttaaaaactataatacaaactataaaccttagtggtaatatgtacttagaataattttagaatcagattggtccttattggccatgagtccaacccttgaccagtctctgcttatattactagttatggaaaacatgctatttttcttcttaaaataccatttattgtgtttttctaattatacatttaaatatatttattatagaaagtacagaagagaacacagaggaaaatcaggtttgcttgtgagtcccatttaaaatcagccctcgacccttctccaccaaacccgtcttgcttactccagggcattgctgagcagttctctgtcttcgttctctactgactcattcccatcagcaaataagcatgcagatatttctcttactttaaaacaaaaatttctcctgagaccactttccccacatctttgtttttctttgcaataaaacgcccggcaatagttatctatgcttgctgtttcgggtcagcttctcccattctctctctctctctctctctctctctctctatttatttatttatttatttatttatttatttatttatttttttggagatagagtcccactctgtcgcccaggctggagtgtagttgtgcaatctcagctcactgctacctccacctcccaggttcaagcgattctcctgcctcagcctccccagtagctggaattacaggtgtgtgccaccacgcctggctaatttttgtatttttagtagagatgaagtttcatcatgctggccaggctggtctcggacccctgacctcaagcaatctgcccacctcagcctcccaaagtgctgggattacaggtgtgaaccaccatgctcagcctctttcttcagtcaactttactgaaatgtaaattgcatgcaatgaaatttacacactttaaatgtacagactgatgagttttgacagacgtgcacacccatgtagccaccaccacactcaaaatttggaatatttctaatatcccagaaggttcccctgggcccctttcccacccaccattgcccccaagcatttactgatcaaatttctatttctataaagtcacagattagttttacctgttctataatttttttttttttgagacagagtcccgccctgtcatctaggctggagtgcaatggcacagtctcagttcactgcaacctccacctcccagattcaaatgattctcctgcctcagcctcccaagtagctgggactacaggcacatggcactacacccggctaatttttgtatttttagtagagatgaggtttcactatgttgaccaggctggtcttgaactcctgacctcatgatctgcctgcctcggccttccaaagtgctgggattacaggcgtgagctaccacgcccggcctacttgttctataattttaaacaaatgtccagctcctttcattctgcataatgattctgaggttccttcttcttgtcgtgtgtatctgtggttgtttttttaattgctgggtggtaatacacttatgaatatacccccatgcatttattcattcacctcttgatggatatgtggatcattttggggatattatgactacacctgttaggaacatttgcatacacatgtatagagcagacttttttttatttctttcaagtaaatatctaggaatgaaatcaatgagtttatggtaagtgtatctttaactgttttttgatgtaatattccctctaggaagacagcagaattccagtgactccacgtagtcactagcacttgatattgtcagtctttttaattatagccattcaactggtgtgtggtagtatctcattttgggtttaattttcatttccctgatgactgatgatgtttagcgacttttcaagtgcttattgaccactggtaaatcttctttcgtgaagtgtctgttcaagcctttggcccctttttaaaattggattgtttgccttattattatgttataaggattctttacgtattctggatacaactcctttgccagatgcatgtactgtgaatattttatcctcattttttcttattcccaatcccagctgggctgctgtccaccactgcttaaagctactcttatggatactatcaatgaccttctcaccaccaaacccactggctacttcacagttctcctgctgctccacttaaaggcagcatctgaaaccagggagcccttggcttttagggaacactgctcctgtcctccttctccctcatgggccccttttgctctgtctccttcactgtttctctccttcctgacctccttcagtgggcgtgcttccagtgctttaccatttgtattcactcctgtgatgatctcatccaatgtcgtgctcttaaattttatctctgtgcctcaaactccaaattattatctcaacccaaacctcgccatgaactgccgactcacacaccaaactgactcccagatatctaactgattcttgatgtctgataaacactccgaacacaatatctccaaatctgacctcctgatctgccccttcccacaacctgccctgcttatagcctttccaatttcagctgatggcaactccatccttccagctggtcaggattaaaaccttggaatatcactagaacatcactcactggttctcacagctcacatccggtttttcagaacctcatgctggttctaccctgaaaacatccaaattctgaccagcctcccaccttgcacatctgctgctcgggctccagactccatcctgttctgcagaggcctcctgacgggtctccaagcttcctcccttgcccttgcaggagcgtctctgacatcactaccccatctgtttaaagtacgagttctctgctcaacacccactgacagtcctcgtttctctgaggacaagccaaagtctttccagtgacctgcaggactccacaggaactagccccgtgaccctccccttttcatgctacttgagcctcactggcttcatgccgggaattctcccgccttggctgctctctctgcctgagtgttctttccctgggtttctgcagggctaacccctcgaatccctcaagtcttcattgaatctccttttctcagtgaggctaccctgaccgccttatttagggttgcagtctgacttttacaccaggcctcttattgggctctaatttgagggaaaagacttcgaatttatcccctcctaccatattacatcatttactttttctctgtgtctctctatactaggaaggaagcgatatgagggttaggatttggggctttttgttcactgatgtatcctaagtacctagaacagtcagttcaaggcaccttatgggcacttgacaaacgtttcttgaatgaataaacggacctgtgatgtgactacagattccttcccacacgatgcactcggaggcccctttcttcccacccagccagtgccaggcattctgcagcaacactgctccatcatcctcttttctctgcccctgcagattgacatcttcagctccctggccaccagattatggttgggttcagctagcagaacactgcaggaaaacacagggggaggcacgagagatcggggtctgtcctgtcctcacctctatcctgcttcttcccaaagtgctgggattacaggagtgaaccaccgtacccggcctcattttacttattatagccacaggttcaaatctattcatatttttgttttgctttgttttttctgctctgtttagagtcggagtctcactctgtcatgcagactggagtgcagtcacacaatcacagctcactgcaatcttgaactcctaggctcaagcaatcctcctgcctcagcctcccaaagtgctgagatgacaggtgtgcaccaccatgctcagcccatatttattttttaacccttgttctattattacctcactctctgcaaagacttctagaaccaactacttggagttaggccaaactttacagctccaagggcacagtcctccacaagactggtctcacgtcaaaccccagctgcaagcccaggggtctccaggtgaccctcatttacaagcagctggctacaaattcagaggttcccactactccctcaggtcaataatttgctagaatgatttgcagaactcgggaaagcactatacttatgatcaagttttactataaaggatacaatccagaccggccaaagggagagatgcaggtggcaagatttgtcccaaatgcaaagcttctttgtcctaaggacacactaccctccctgcacatcagtgtgtgacaatgcccagagtattacaaaccagggacatttactgagcttcggtgtccaaagttttttttagaggtttcattacacaggcttggttgattgaatcattggccacaaaggtgaactcaatctccagtccctctgccttatctggggtttgggctcaatgctcccaactctaattgcatgtttgatgaaaagaagggagaaggaaaacataaaaaccctcctccttacatgaatgcccttctctcctcagttctcatcactgctcttctagctagctttctcttggcccaaagtacacaaatggtggctccagcaggttccctattcctggacattttcaattctaagcagcagcctcaggcattggtgatcctattggatgatccagtcacatgttcttcctaaatgccaagggtatgattatgctacattgcttggaggagtgtgcagccttgcctcattctgcagaagttcccagccatgctgtagccccagttccatatacgtaccacagccaccaacacaggagcctgtagggcacagtcagaatccatcttctttacctcttgggttcagataaccaagcaaagttctcctccaggccattttcatgttctctctgtcttcaatacacattctcctatacatgcctcatagtcctgattaggttagcaggccctgtggttgagcagacttccaatttgggaattgaatgtcagtttcttcctacatttaggcccagaatcaccctactcttgcccaatgtctttgaactgtttcttcatccagatcttttcatcccttaatacattctttctctcaagaagaatatcagtttctcaaggagagagatcctggggtctctccagacacaccgacatgtgcttgagtcccaacgtagctacacatgaactaattcgtcagccccttagggtcttgatcaggtcaccttgagccacaattttcaccaacctttcctctctgatggaaatctgaagtcctccctgggatttccaagggttctttctgcttccaggtgctttcttctgtgggtgatctctctgatccagagaatatccacccagaatgaagctcagcacttcctttggttcacaaacacacaaccgcccaaagcattcactgagcagtagcctctattgactatttcagggtcggggagaggggtacacagcacattaacaaatcactgcaagtcatagagtagatattcatgccctcaatagttcctttacccatccttctatagaggcttctcatagcccttcacgccaggcagtgccagtctttctgctttcaccccaggcagtgccaggattttgatttctcctgattcatgctccctggctccccacctgcttcctcactcatctccaggtctcccccactattatatacaataacaagctgactcttcccaaaacagggtccaagcttgctggcccagagtagtcaggtgctcaacagatgcaaaaacttggatttgaccccctttaaaggagttgtggttacaaataacaacaacaatgagaatttgggggtgatcctatgccagaataacagagatagatagatacatagatagatagatagatagatagatagatagatagatagacagatgatagatagatagatagatattgattgatagatgaaaaactgtaaccccagttttgtatagatcaatccaaactttgcatcctagcattcaaagcccttcacaacgtatcttccatttaccttctattgtcttctaccattcttttccaaaacacatcctaaggaccagcatggctggtgtcgtctaccattttttttccaaaacacatcctaaagatcaatgaggctagtgacctcaacacccttagagaaatttggtttattattcctccttcaaaacgcctccactctgccaatctactgtaccatgatgacacttattctccatattacatattttagaattaggggtaacattttacatttaattttagtagattgtcttagaatattattccttcattgtttcatgtcatgttttccaaacaagaatctaaagcgccttgagcccagctgggaacatctgcacgtcatcagctggactccagtcccagtgctcaaggtggctggaccacaaaaccacatggaagcccttgcataatgttaggaggtgtcagcaagatgatttgagtcttacgccgaggcctctctcttcccacagggggtctgcaccacccccagcagccaagttaccctgtgacagtcattcatctgtgctctgggtggcccatgggatgagtgtactactgggcaggtgtaacttcaggggcacacacagcagacatccccagctgacatgacaacctactggcttctcaagatttgactaatcatatatagtcatcccacaatatcctcggggtatcggtttcaggacccccaagtacatcaaacctcatgcatactcaaatcttgtggtcagctctgaggaacctgcatctagcaagggccgactttgcatatacgcaggtcctgcatcccaagaatactgtatttttgatccgcatttggttgaaaaaaaaatccacttgtaagcagtgcagttcaagcccatgttgtttaagggtgaactacatttctgtgaggggatcatcttcaaataaagtccttgtttctgtaccagttacagcaaaggccctgctttgagaatttaacagtcagagtagccacccacttcaaaactgaccagtcccatccgtggcaagcagacgatgtgacatcaacggctcttaccgcaccaggctaatacagttatcctggtcgtagtttcattttactgaaggccttattaaagcgcccccacacaactcagccaggaattcaccaggaaccaaatttaaacaaatcaaaccccgaaaacgtgctcaacaattcaagattacagaagggaataaagacgaaaataagaaaagcctcaatcatatttgtcatatctccatcgtttctcataataattctcaaagttctttattcctttcatttatttaattaaaaacttaggccatgcacgttggctcatacctataatcccagcactttgggaggccgaggtgggcaaatcacgaggtcaggagatcgagaccatcctggctaacacggtgaaaccccgtctcaactaaaaatacaaaaaattagccaggcttggtggcgggcacctgtagtcccagctactcaggaggctgaggcaggagaatcgcttgaacccaggaggcggaagttgcagtgagtcaagatcgtgccactgcacttcagcctgggcaacagagcaagactccatctcaaaaaaaaaaaaaaaaaaaacttaaccataacattatacaatttaagcagcatcatatttgttaatatctattttcaaaagcgactcttcctaattttattgttttcttcctcccttttccacgcatttgtttgtttttcttcctcctagaaagtcatgttctaagttatcaaaatgtgtttttcctcgagctcttcagggaaaaaatgccatataaaattaattcatgattattttatgtaaattattatctaaagtactcactatgtgtaacggttaaagttgattgttactaaagtgattctaaatatgaaagtgtataaaaccatgaactattctcacactacatctcaaagaaatttgaaatttctagtaaatttcaaatttactagaagactagttcagatattgtttttaatgatttacaatcatcttctgaattttcatttgcaagtcaaagtcacaaaactaaaagtgctacatgttttctgaccagattctctgaaataattatatagtgcttgagccattgtgctataaatatctttgaaatcaatgctattaaagaaatgctatatcagctgtgaaatgagaatttctcctcctgtccgttgacatttacaaaaattatacgaacttattgatagaaaatccgtttgcttggtttctttttaaacatcttatgctttaaataatattcagtgtttttccagtaggtggagtattagtctagataaagtaaatcactgtgtgaaagctaattttttcttcctactattttgagaaatttttgatataaaacataaatcacctaatagtttcactaattcttttaattgcatcaatatggtatgatttcaattactctagaccttaagaggcagatatattttactgattacattaccataataacaatggcataatgacaatagcagtaagtacttattatacctctcattttaaaattgcttatcaagccattagagaaacctcctgacatctctgaaacagaaattacacaacaaagaaagatctgtctcttaaatcctttctctctcgagccttaagcatttctgggaaactgcgttccttgtgagttgaatattggttcaaggctgatgctaccacttccagtccaggaatctgagacgatcactacctctccctgggattctgcttccccttctaagtttgtgaaaagatggtgataaactacatctctgaggcccctccctacctgaaaatccccaaatgaacctgaaattgacaatcttatggctgaatgtcgggagccaagtctgccgagatgttttagtacatacggcaaagatggcacttgttatacggtctggatctcaaaatggaaagtgagagaatgatgcctttccagggcaggtggacgcttcctcccaccctccatccatcaccaaaaccggtcgaagttgaatagtgccctgaaaagacaccttcaagtggtaccctagagttgtatcttcacagatgattctgctcaaagcccccagagacatgggaaaatactattccttagggccatggtagcagaacatcttcaaagaaacctcacagaactggttcaacctcctcactttacaaatgaggaaactgaagtccaagaaggcttcctaacttgataaacatccatttaacacgtggcagagccagggcccatctcctggccccattctcatccccccaggccacctctcctctcttacactggaagtctagaagctggtttgcaaggggtccctgaatgaccttccatagaggacagtgccttaccgagaagaggaaacacatactgaaaccagccacttttctctttttgccttctcacagtcaggtgattcgggtttggagagagccccagctcccatgcgcaggggattttctgtcctagaaaggcttaggcacagtggattcacctggatctcttctagttttgcagccagtttttctttcttgctcttggaccggagagcccccagacccaggcgtaggcttaggtaaagggggctcaggagacaaatctgtctgctttggccctaggctaggccacctctggccttgccaacaattaattaatacattagttaattaattaattaagtcaaagtcctccaacgtggttgagcccagctggggactggtaataaagtgagtggtttagagaataattcccagaagaagcacaaattgattattgtatttggtgaaaggacagcagaagagcattctgggcaaaagatacagctggtctaaagccctgagcacacctgggagtgcacagtgcctccccaggtgtgagagtcaggtcacagcacaggggcaaggtctaggcgagggcactgcattctcgcctctccattctacgaagatgccccctacccctctgatctccccagggccatttaatctctcccaaagaggcaaaggctccctgacttatccatctgcagttacctgcaggattcggttaactttcccttcgtaaaggcatccgccgtgaaacacaccaggcacctccaggaccggcatgcatcgctaacccagtgacaaaagcatggctgttgctcgtttattccagagttctgttaggggagagtgtttcttggcctctttcttcttcttgagtatctctataagtcggcaggatttatgagtagctcaaccaaaaacaaattaaggtagacaacgtgacctctaaatgggtcagcctcccaaatggtgtcctctcatctgcacccatggctgttcttgggattggagggatggccgcagggcttggcaatgtaggttgggagggggctggcctgctgaccctcaccctgatgggcttgtggctctcagcaatgtggtcccaaaaacaagttgcactgaaatcaagactctcagagcagagcaggggcaagtgtctcttgcatgaaaattcggagtcccagattcacgatcagccagtctccccatcgatgtggtctgggaggatggagccaagctcactcactcaaactcgatgtcaataaaatgctatgagggcttcagtccactgagtcattcacagagattcctccctctacaaacagaagttctaatggaagtaaaagctaggaatccacaccttaaacacacacacacacacacacacacagacagatttacatacagatacatacacgaacatggctcagccagtgctgacccatttaacacatgttaaatgagcaccttgcatatcacaggcccttttcatgtggatcgtaaattaactggaaggtttattagataacactacagagaaagaaatagccgaaagtccagaggtgaggtgttagccacggagctctgacaaccaggtggatttccactgcacctgctgagcccactgatcagtgtttaacaagcgtgtgttatgccacgctcctggggcaggagtggtaactgaggcagcgtccttgaacccacagggttacggtctcaccaagggaggatcaggaacagagctgcaaccctggactagcaggagagtcacacctaatcctacttctttatctcccacacatctacatttgctccatgtcctctccattatcaggaacaaagtgattctagggttaggaaggggcagaaaacatttagatgaacgtatccttgatactggggtcaaggcctgcttgttcgtattttcaattgcaaatggccctaggcttgtgtatacccttcatagaatggagattccgatggggagaaagagatggtctccactcttcaaaccctctcttctttgaagtctgtgggaatttctagtttagaaggacgggtagacacagataaggggtgcgagttgagctgataattgtttctcctacctgaagtctatctgcatcagcctcttcttatcttcagccttgggcttcaacttggagtaaataaaacattcatcagatgatatgctctaggctgggcgtggtggcctacaatcccagcatgttgggaggttgaggtgggaggatcacttgagcccaggaatttgagacaagcctggacaacatagtgagaccccatctctcctaaaaataattttaaaaattagccaggcagccaggcacggtggctcacacctgtaatcccagcactttgggaggctgaggcaggcagatcacgaggtcaggagttcaagaccagcctggccaacatggtgaaaccccatctctactaaaaatacaaaaattagctgggcatggtggcatgtgcctgtaatcccagctacttgggagactgcagcagaactgcttgaaccagaacttgggaggcagaggttgcagtgagccaagatcacaccactgcacttcagcttgggcaacaaaagcaaaactccgtcttaaaaaaaaaaaaaaaaaaaaaaaaaaaaaagccaggcatggtggtatgcacctgtggtcccagctactcggtaggctaaggtggaaggatcacttgagcctgagaagtggagtctgcagtgagctgtgactgcgccactgcactctagcctggatgacagaataagaccctgcctcaaaaaaaaaaaaaagaaactccttagtcatacacctaaagccaatctctccataatcactttattgggaataaaatgatattttgaagaaaaaagatgatatattctaaattcaatatcgctgagctaattccaagtattccctaaaattaacgattaggaaaaacagcaagaaatcctaggcctttgtctaggccatggaaaaagcgggatctgccttgaaattgtgtccttcatctcaggagatggggcccggcccctccaccggtccaggagaacccacgccatttaggtatttcttctttagcttctccactgcatccccaaagcgtaaacggctgatgaaatcccttcaaactctgccaacgcaaactgtggcttaaaaatggaaatgaatggatattgcaaaataatacctgaatagacgttaaagctttaagctccacgtgtaagacacaaggtcctgcctaaatcagtatgcttctaatggcttcatggcaaatgttgaacaagttagtgttcactcaaggttgtcctggggtacatggagtcacagtctttaattttaatgagcctctattacacaatctcttatcgcctcttaactgccagtgaaatgaccaccagctaaatgtacagcaaaatacatttctacaaaagagctcacttggaccccaaagaaattaccttgaaattattacacttaaccgtggcaaatgcaccagggttcatttgaaaagaggtggccacctggcaatacgagtgaaatcatataatatgtcatttccttaggcttttcatgttaagcttttctcgctatatctgatttaaagtattttctcttttaaatgtaaatatttaaaatgtagctgatcctctccctctcctaattgaggtgactgggctagttcaagagactgtggcctgcagctcaccgttttgtctctggagtcagagtgccagccttggtacttactctgtgactggacactttataatatcaaagatacgagatcatacctatctaatatctattcaataagacaatacatattaaaagatcagcacaaagccttgtacacagcagttgctcaatatgtgcttcctcctttttcctactattgaatcccaccagccaagaccagaactatatctgcagttggacaaagttgggtttatcccttgttgcagtgagggcttagcagtttgagtcaaacgggagctggaaaccacagtcggttaaaatggggtgataaatagaagcattaactatggcaaacagcaactccaagatgtaaggaaatccgtgcagtttcctagtggccccctagggctgagggagcccatccagggacaacctcggtgggtgtctgaccgtaatggaggcaaagctgcccctgtctcctctgacagtctccagctgggcctgagagttaagttgacgtaggagagactaacagaggaaacgcaagccaatgtttacaggcatgtgagggccttcacaggacaccaagatccaaaagcagccaggcctaagtgcttatgcaacagggtgaacaaaaagtagtaattttgaaaaagtaactaactatatggagatactaaagacaagggttattttaacaagagctttttaactgtcaaaacactttttgtttgtaccgatttccctcggcctcaactccccgcctctggagagaagaatgttcttttcttcctggtagagagaagccatcttccatatgaaagtttcatctcctgctttcaggaagaaaaggggaggtcagagtgtcctttgtgcatctgttgtttttctttttttctttgagatggagtctcactctcacccaggctggagtgcagtggcaccatctcggctcactgcaacctctgcctcccgggttcaagcgagtctcctgcttcagcctctcaagtagctgggaccacaggcgtgcaccaccatgcccggctaatttttgtcttttagtagagatggggtttcaccatgttggccaggctggtctcgaactcctgaccacaggtgatccgcccactttgccccccaaagtgctgggattataggcgtgagccaccacgcccaacgcatctgttgtttttcaagtgcctttagctcaaaattgtccccatctcaagccagcatatctggaggtggcgtgttctgaagcccttcaggaccttgctggagaaggtgtgtctgcctggcagagagcagagacccctgcttagccaagctggagctggtccggaattgctgggggagcgacaggctggctgccctctggagtgcaggtgggggagcaggcaatagcaatggcggtgggggtgagagtgaggggctaccagggcggttcagacacacgtccagaggtctgtgggcaggttgccatggctgagacgctagggtcacagagggttctcttaaaaggcctgcgactcagacaggcttcacctcatgtcctcgcactctgggcagagcctctgctatccccctcctcgagcctgtgctggaaattgcagtaagccccttcctcttgcagtgtccctccagagcacgctactgagaaagcttgacattgtgctcaccttaaaagcaaaatctttaaggaattccattgtttatcatagagcttatattgaagggtgcattgggagccaggaagcaacgagttgattgataattgacgcaaagggacccatataccttagagaatgacggggtggctctaagagtcaggaagggcttattttaggaatcaggcttatggtggggagggttcaaggaagcaggtgtctctaatcaactgggtgctctcagaaaagcagggctaattcagttattgggcctcttaatgcatttcatctgggaggcaggaagaatggagaacactaacgttgttattgaagaaattgccgggagaaagagatgttttggttttgggttgtacaaggtctgttattttttaatttcttgtattagtttcccagtgttgctgtaacaaattgccacaaacttaaggacttaaaacaacatgcatttactatctcacagttccagaggccagaagtgcaaagtcagcgcaaacggctgaagtcaatcagaaaggctggtgccttccgcaggctctgagaggagaatctgtttccttgcctttctcagcttctaagagtctcctgcgttccttgggcccttcctcacgtcactctaacttctgcttccgttgtcacatcttctctccactgcgaccctcttgcctccctcctataaagaccctggtggggacctgagacccacccagggaatccaggagaattcccctattatcttaatcacatctgtaaagcccctcttgccaaggaaggtgacgcgctctcaggtcctgagaattaggatgttatctttgggaggcatgattccgcccaccatatctccatattcagacaaaattgcagaatggtctcgtgtcacatggtcaggtcctggagagccctgatccgatgctgctgttctgaattatgttcggcagggggacagcaccacctggtggtaacactcggcaaagcatccgccgtcagctgcagagctgcttttcctttggggtcctcttgctttaacccaccttccccacaatcccactcatcccttccggccacagcccgccttcttagacacaaggcaggcaggagtatgcgagagagaagacgtaaggacgccttgctcgtggtaagatcagagactgatcggagaacgctttcctccttccctcctttgagaatttcctcaggcactgcagcttcacctttgtgaatgttgaaggctttctggatatcctcgtcacttctcatattttcctaactgagcaggtaatttggattagaactgtacagcatgacccatttaggttcctgttcactgttttgaaattaatgacttcatcaatgagttaaggctaggagtgttcattatgttttttagaaaagtcaaaaccgagcaggatcaccgagaagcaagatgacacaatcaacaatcaaaaacctctgagtagaggctattactgtgtttcaaaacaaaatatataaaagtggccgggtgcggtggctcacgcctgtaatcccagcactttgggaggccgaggtgggcggaacacaaggtcaagagttcgagaccatcctggccaacatagtgaaaccccgtctctactaaaaatacaaaaattagccgggcgtggtggcgggcgcctggagtcccagctactagggaggctgaggcaggagaatggcgtgaacccgggaggcggagcttgcagtgaaccgagatggtgcctctgcactccagcctgggcgacagagcgagactcagtcccaaaaaaaaaaaaaagaaagaaagaaaagtttatataaataaatgtaaaatttagcatttttggttaaagccatcaaccacgcagacataggaagggaatacacttatagagatcaactaggaattttattttactgtagctcagcaaaaataatataaaatggctgccaaaaagccaaggccgtctagtctggatctgcagaaacaattcaggaaaaggaaggtacctccactgtgtgggtcatgccaaacctgaggacggatttcccttcggtgctcgcgactttaaaagttgcattaacaactgttaatgtcaattatcaagatcccaccatgtattgtattgggctgtattgggcctgaggacacagaaatgtaaaaacctaaacatggaaatttaatctttaaaactgtgtactatgtatccatagaacgaaatactagtcatccatgacaaatgatttttgttgtatatttattgagacagaagacattcataatatatcgtcaagttaaaaaatatacaaaacataatatgtgttagttgggttccatccctttttacttaaaaagttgaaagaatatacattaaaagttaacattgactatcagctggcagtttttttctgcaaatctatatcattttttctataacgaacgtatattacttgtatccatttttaaagctaagaaaatagaattttgttgtatttttatcgacacagagcgacattcataatatatcatcaagttaaaaaatatacaaaacaatgtgttacttgggttccatcccttttttatttaaaaagttgaaagaaaatacattagaaattaacatttattattagcaggcaactttttttccggcaaatctgtgtttttctataatgaacatatattatttgtatccatttttaaaattctttaagaaaatagaactttgttacaaatttagttttttgttttgttttttttgttctgagatggaatcttgctgtcaccaggctggagtgcagtggcgcgatctcggctcactggaacctccacctcccaggttcaagccattcccatgctacaatctcctgagtagctgggactataggggagtgccaccacacccagctactttttgtatttttagtagagacagggtttcatcatgttggccaggatggtctcgatctcttgatctcatgatccacccacctcggcctcccaaagtgttgggattacaggcgtaagccactgccctgatcacaaatttagtttttaaattgtaagaagtatgaggtggagattatcacctcctaaggcattgccaggtaggctattggttaacaatggcattttgcatttaaccatttaacaaaagagagtaagtaaacagaagtgcggtggcagttacccatgggtgtcattagatggcagcaaagcagctagctaatatttaagagcagaaactgaagagcttttgctccaaagaaacatatatatgagattttaaatatttaagattatctgaacggaataagtgtttttgtttgtttgtttgcttccagacagggtctcactctgtcacctaggctggagcacagtggcatgaccacagctcactgcaggcttgacctcctggcctcaagctatcctcccacctcagcctctcgagtagctgtgactaccggtgcacaccaccacacccagctactttttaaaatttttatagagataatggtctcactatattgcccaggctggtcttgtactcctggactcgagagatccacaagcttcagcctcccaaaatgctgggattacaggcatgagccaccacacctggtttgttttgttaatgatgcatttgacgttatagaaaacttttcaaaatgatagccaagcatgcaaatgtttactttaatagtttttgggggtggggtgcttttggatttttgtggcaatactactcatgcacaaaaacctactgtaccagttctgtgggtcaaaaatctaaaatgttcttgagatgtgaggaccctttgactcttaaccgtgactgtgcaatgatctctaagtttctaggaagcagtttcaagattctgctgcagacagtcattaataatgaatgactattcatcgtagtatgatgtggtgatgccatttgatcacttgcctgccctctttcttcactgccactctctccttcctcccaagagcacagctagcttccagcatctttgctcatctgaaggacagttttttgcctaatcaggcccagtttgagcaaggactctggatcgtatctgcttctgagtctgtgctgctgccttcaacaagttgctgcttgttctgtctccttcctctacacaattgacgtggcccccatgggaatgcccatgtcggaaagcaatgctgtgctttcttataacccgcacctctcgtcatgctgaccttagcacgtattaaactcacttcagaaaaatgaatgcttacaaaagaatgttttccaccggggtggggggcccaaaaaaggcccagaaagctctaagagctcacagttggagaaacacatctagactgtataggtggtaaaaagacagctgagaagataaggcaggaaaagccacacagggacacaaagggcaaggccagtgattctgacaccaccattggcactttgtccacgggcaacaggatcagaaacgtgcgtcgcttccgtggttactgtctgtgcaccgttcccaacagcttcatttctctccctctgctgccaactcgcccaaccacccctgcctgtggcaggagaaatcattctcattgggataaccgagaaaactacaactgtttaccccacttgaccctcagcatttgagtgtgtgtgtgtgtatgtgtgtgtgtgtgatcatgtcacaaaataaaatgtttccgcaaaacttcattgctgtagatgtggcatattccctatcagaggctgacactggagattggatcaagcagatgttactccattaaaaagaacatggatcttaatcctgtaggtaaatcatccacagaaaatgtacatcacctggagagccgttcataaaggatcttcacttaccatcctcagattttttcaaagaaccccagcaaaggaagacatgggtttccattttctcggggtggtgttttagagtcagtgctgatgaaataagatatcagaaaaccagggttcaaagagtgatgtcatccccacagggaagatttggttccacacagggtagagacgtgcttctaaaagtgtctcttgttttcctcctgcagctcgatcattatccttctgtgagttaccatctgccaagttcatccgacaccctcttcaattctcccaagtcgctctttctgggaaaagttataggtaagaatgtggttcgttaggtataaatgcgtgctacaaatacatttgggtaatgtgagtttggattttaaaactatcaggtaaatttctcttactggggccagtcacgaatatcttctctgtacaggaaagttacgtggttgttctcggtgttgcacaagcaaagcgtcaacaaattatctttgggggaaattgctcatgtaactcattctaaagctaattcgcctttgaaatacattgtgattaggctgggcatggtgggtcacgcctgtaatcccagcactttgggaggctaaggctggtggatcacttgaggtcaggagttcgagaccagcctggccaacatggcaaaaccccgtctctactaaaaatacaaaaattagccatgcatggtggcaggtgcctgtaatcccagctactcgggaggctgaggcaggagaattgcttgaaccccggaggtggaggttgcagtgagccaagatcgtgccaccacactccagcctgggtggcagagcgagactctgtctcaaaaaaaaaaaaaaaaaacaaccaaacaaacaaaaaacacattgtgattggtaatgggggcttctaagtcagcgatggtaatggaacaaacgttgtttggtgcgtggcataaactacaacccaagcgaaggcaaatctgctccaggcttctctatgtagaatttggtctattacagacctctacctactagcaatatgtaatttaacgtttcctttgtcaaagcatatcaacatgattctatcttcctctcactcgtaagaaagcaccttgatattatttgcagataagaaggccaataaggaatttgacagtgtgacagaacacccttccccatgtgcgactgtgaattccagagtctccttgtccctctcttcaccagaggagattagcactgtgcaaagctaaaaaatgtaccatgagccacagatatgtgaagattacaccctaaatttttaaaatatcgatatgattggtgaagtattttaaaatatttaatgtgaagccaatgaattttgttcatatgaggctgtgtactgtgaactgcaatgaaaacagtaagatggtggtgatgtacaggtgggagggaggtcactcggcggccagtgtgtagaagtgatcagaatagcattaatggtaaaaatgctcacttaaaaacatgcggcaggggtcacaaaatgaggagtgagtaggagactgaacctataataaaaataatagactgggcgtggcggctcatgtctgtaatcccagcactttgggaggctgaggcaggcagatcacgaggtcaggagatcaagaccatcctggctaacacggtgaaaccccgtctctacaaaaaaatttaaaaaaattagacgggcgtggtggtgggcgtctgtagtcccagctacttgggaggctgaggcaggagaatggcgtgaacccgggaggcggagcttacagtgagccgagatcacgccactgcaccccagcctgggcgacagagggagactctgtcttaataataataataataataataatgtgcacttatgtaagatttactgtaggccaggctccagtttaagcacttgacagatattagcccattcaatcttcgtcacaattgtatgaggtagttaagattatgatctccactttttagatgagaaaactgaaccatgaagagattaaataaccgggccacctggctaatcagtggcagaaccaaaatttgaactcaggcaatcagacaccaagggagctctttactgtgctgtaatccctgtggcagttaatctagaatgcaaagagaaagacagagaggaaagattgggcaggtgataaatgctgaggctgtccaggtaagggataaagcctatatcttgtgccaggaagtggtcaagaacaaaaaggattcctgggtttagaaccaggaacacaccagtccggctggagagggaggcatccagaagagagggggaaagcaggtgtgtgcatgaagcccaagaccacacacctggtgaacaagacagtggggagtggcaagtgataaatcaaagggtggaactggaaaacaaaagagggctaacatgtattgatcactgagccttagatattgtacgatatgaaagataattaaatagcttctgcttaatcctttgcatcctgaaaacagcactcaggcacagtctcaaatctagctttggattacctcaccctgatgtccttatctgaattttctccaacactttctatagttgatgtatttttacagatcttatcaccacttttatgttctgtgaacaagaagagactttgtgacatcacatgttacacgtgtaaatataagaaacaaacgtcacaacaatccaatgaaatgagatccctgattatgaacctcattttgcagatgagaaaactgaagcagaagaaggtcaatttgacaaaagttactcaactaatactggcaaagcagagtttggaagcgaggtctctctgaagacagtccagactcttaagtgggtcaaacaatcttgtcattcatggtgaagctccagaagagggatgtatttgaaagttgagcgatgccatcagttagcaacaaaaagtggctgtttagtggagtagggccttggcattcatgagtcatggatctgagactttggtgagtacccgctttctaccagaggtactcccacggttcagttgagaatactttaaaatgttaagtgctccttcagaaccatatgattccatcaaaacaaacgctacactatgatatggtgatgttcctaaagatactacactatgatattcgtaaagtaacatcaactataaacatacccgaaaataatagactttttattactttgtggaacctgcaaagtcaaattttgatgggaatgttggatgatttctaggttctgtcactatgagtaatattctctggttcctctgttttccaggtcatgtaactagttcacatttcagcacaattccaatatactgtatggcatggaccttcaaggtcgtgaacaaataacatcataaaggccacattttctacaactaagaatgtaccttgacatcaatctgtgcaaagctaaaagtgtaccatgagcctcagatacatgaaggttacaccctgtattttttgtacacccaagaaaaatgttgctgcatacacaaactaggtaactgtgcatgtggcagtgagttacagaaagtacacataaatacctgtaaggaggtccacaattccaagatggaaatggtgttatgcaggtgagagtagttagggctccagcaatgggtccttggtgcactgacttctagtggagattatctctcatccctacaagcctgtgacctccctgcagaccaagaaagcatctcatagttccaccatatactaacaaggagcaagtgctcaataaatatttgttgaattaataaagagtaaaaggggaaggaaacagaaagatatcattgtagacgtatactgcagggtgaaagggtatggatgatcatcctaacagaatcagtaagattcgcacagaggtgagagctgcaatcctcacatatctcacagcctaaaagtaggcatctgacgatcatgaagtagaaagaatgtggacttcggaatcaggcagagcttgttagactggaatccagttctacctctgttagcattgaaatcttgaccatgttgctttcttagttgaacctctcagagcctaggttctctcctttgcaaaatggggaacacaaatgcctacttgcaggttgttaactccctgagggcagaaggcagagactttttttgaaactaatctatttacagcaggctgatcagtgcctagtatacagaaagggctcaaaaaatacttgtggagtaaatgaactactcttttaatattaagctaataacgtcttaagacatacacaacacaatgcctaatacataaataattaccatttttgatgctagctacatgccggttattatgctatatgctgtaagtacaatactgtctgcgtttctcacaacaccacagaccattgttaccctcgttgtatagaataaggagctaaggctcaaaactattaagttttcttcttaaagtggggtttcccaacagcagaactattgacattttggatcagaaaattctttattatggggctgtcttgttcattgcagaatgtttagcattctccctggcctttacccactagatataagtagcaccccaagttgtgacaaccaaaaatgtcttctaacattgctaaatgttccccaggagggaaaaattaccaccccagttgaaaaccacaggcttcaagctactcagcgagtcagcggtgacgctgagatttgaaaagcgtgatttgtgacctaagacctatgctttgcttcctgatgacacctgcaccttccagaatggtgaggaagcaaggacgaggttcttgctactctgaagctaaaattctgttaataaaattgaaggagtctcagtgaagaccccaagaagacatgtaagtgcttgagaagctaatcactggccaccccttcaagccaatactcctttgatatttgatcatttcacaggggcaggaatatgcttaaatgtctctttgaaaacaacatatacttcagtgagagacaacccatttgcattccccagttgtgtaaaaatccatctgtacagacatacagtattgaacttgcaactgatatgtactccggccaggttttgaaaccccctggagtttcatgctccaaagttgttgctttacttttataggatcagtttctgctactcagaaactgattctataaaagaaagagaagaagatggctctaaatacctaaaatgacttcacactgagctctttgatgagcactcctcaaaaagggacacagaaaaaggatgaaagaaaggctacctaatcaaggacaagtgtgatctttataaaggggatggaggatatatattcaagaaatagtagtgtgatcactgccaaccaacagcaaacttttagaacggattcttacataattctgaatgcttctagaaggaattcagaatcactagcaatcagcaaaggttcacaaaggagaaatctcactagacatagttatgtccatctttcatccctcatatccatccatcttttaccagccgagtgatgtcatagactttatctttcagcaacaaatttaatggtctctcaagaaatcttcaaggaagagaaatataacttgaagccgaaagtggggtgttctgtttgctcatgtccttttcaacatctctattaatgccttggagaaagacacaagtagcatgtttattaagtttgcaaatgtcacgaagctgagagggatggtttaatatgatggattataaaaagcatttcaaaaccatcttgacaggctagaaagatgggataaaaataataagatgaaatgtaatagaaataaacttaattgcagcacttagataaaaaaaatatatacaatcacctaaatagaagatgggagacccccagcatcatgaaaaaacttaggaaattggtttgatggaaagtctggtacaagcaatgttacatggtgatggattcttaaatgaatgtgattctgagccacactagtatgagaatcatgtccagagcgagggtattagtcatctgaggagaaaaccagataaacacaagacccgtaaaggaaatgtcagaagacctgggaatgtctgatcagaaaaaaatatgatttgagagacgagagaatcaattttcagtctttggtaactgccacatgcagggtggattagacttagttgaggcttactcagcaagactgacatggaccaaaagcagaagatatgaagaggaaaatctcagctccatataagaaagaacttcctaacaattagagcttttcaaaagtgagtggtctctactttgaggtaatgaactctctattattgagaatattcaacaaaggctaaacggaaatgtgccctgtatattaaggagttgtctggattgagtaaaaccagattagatatagcctaaataaactttgaaactttaagatttgtggtgggagtaattttcttaattaaaaaggtgaaaatgcaatattatagtagagcagggtctcctgttccattggcaactagggggataacatttagggttccttgatataaaacactgttatgatgcatgatgatagatatgaatttagaagaatatcaatgtacagcgatcaccacatcactgtgagttgtgtaattacatacacgacctgtttccaaggtggcaatatgcattttaattttatttctgagccctctttaattaatcgtttttcaaattaactatttctgccatcgctgtaaatcagagtaatataaaaccgtaatgaagtagatctattctgaaataaaaagacggtagcttctctgtgtaaacttgagaagctgtgcttagaaagaagctgaatactaatgcagtgtcgttgttgcttggctgatcattgctgttgtcagtggcgatgtctggggtggtaaaaataaagcgaacttctatccatttgaactaactagagtttgtaagtcatattggtctcagatcctcatatttcccaaactaccattatccaaagcaattccaatagaagtggctagtagcccctatattatttctattataatctaaattgtgaatatcatgatcctacacgactttttattgattaaaaagtcttattctaaggctttctaaaactttctggagctttggcaaagcctcttcacacagaaggaactgacatacttagatcttcatttgttggtgaaatcatatactgtgataaccatgctgctcacagaatatttctggccagagttatgaatggaaaagatttgtgtgatttccaggctagaacatttaagtgctcatgcaagaccctctagagtccttttatccctttggcatggtgactgacaagcctaagacagtgattttttccgtaagcctgggtccctctgtgactacagtgaacagaaaactcttgacttgtgatgaacatatagcatgagataaaaaaaactccttgctttgttaagccaccgagactatagggctgtttgttactgtggcagagccttggcctgtcctgactgaggcataaggactgacttaagggcagactttgctctcgcacccttgggtttgatctctgatatagtttggatatttgtccccaccaaaatctcatgttgaaatgtaatccccagtgttggaggtggggcctggtgggaggtgtttggatcatggtggtggaagcctcatgaatggcttgggccatctccttggtgataagtgagctctcactctgagttcacacaaaacctggatgtttaagtatgtagcacctccccccaacactcttcctctggatcctgcttttgccatgtaccctgcctgctccaccttcaccttctgccataatcataagcttcctgaggcctccccagaagcagatgccagtgctgtgcctcctataaagcctgcagaactgtgagccaattaaacctctttccttataaattacccagtctcagatgtttctttatagcagtgcaagaacagcctaatacaatctcttactctaccatttgccgattgtatgactttgtcgggttacttaacattgtgtgtatctgttttgtcatgtgtaaaataggaatagtaatggtctctgtgtcacgggattcagcaaaataatacatgtttagcggttagcacagtctctgctgcatagtatgtgtgtaatacatattagttttttactttgcataatcagcaaatgtatactcatcatatgtcagatgccaggcattgtataagtccctggaacatcattagggtccaagacaggcacagtttctgcctttggaaactttatatattcaaatccagttctcagaggtttctcttgggagaacccaaagcaagataggggatcatacaatgtatcaatatgcactgggtcacatctttagagcttcagtttctggaaaagaaggtaatggaaagtcaattagaagtaaaaagacaagagggtgggataaatgaaaagaagtatagaattctttgggagcaagtagggagggcacttgagccagtccaggagtgagggaaggcatactagaggaagtaacacagaagctgggaccctaatgaagagttagaatgatctgggtaaagcaatgggctgaagtagaggccataagggcgggggaggtcagttctccattctgcacagcagtccacccaaaactgtgtggctcaaaacagtagtttattatttctggcaattctgtggattggcagggtggttgttctgcttcatgactccaggcagggtgtaagaatgactggatagcccgaaatagcctcattcatgtggctggcagcaagtgctggctgcccaggagctctttggggccacgagccaggggctgagttctcccccaagggttccaaatcatggctgcttgggctacctcatggcatggtggctgggctccaagaaggagctttccaaacagcaaatgtagaagctgaaggtctctaagagccaccattcttgccatatgctattgaccaaaatctgggttccagcccatgttccaagagagaggaagcagaccctacctcttggtggcatcgtagccaggtcacattgcaaagaaacatgccatgggagttacggttgtgacatctttggaaacacagtgtgctatgagagaaatttgaggaaccacaagttgcattcagaatggtggaaagtcggatgtgaagatgcaagtgataaaaatgctgcagcataagcagggttcagatcaaaggcggctttaccagcagggccacatgtcctgctttgcctgggacagacccaagctactcctgccaggacaagagtacattattagcagtgcccacttttactctaaaaataggactacgcagttgtatgatcacctatcttatttgggtgttcccaggagaaaccctgcagaattcgatttgaatataagaagtttacctgggagacaatcccataaaacaagcaggaaagtagagacatgaaacagggaaagggatggagcattatcaagccactcaccactgtgggcacctggaacataatcccaccaggacactctggaagacagtgcgagacatgcctccgagtgtcccaaccaaggcaggaggaagccagggcatctcgccacctcctcccatcctgcagtgatgagggctgcttcctgcggtactaactccccagcacttccagcttgtcccgtgtttacacccaacacactgctgaggccagaggaaagtgcagatgacagcgaatcgcagtcagtggttcctggagcaggactgaggtgaatgccgggcactgacagcatctgccatattacggatctatttataagccatgttaaggttttaatgttatcttaggggttaaaggaagtcaaggaaggatgttttttaatccatagaataacgtgatcagattgacactttagccagataataccatctgcagagtgcaaaatgcataacaggaagtgagaagctgcagggagaccaaattggaggttgccatggttatcacagaattgcacattgtaatgcacaaagcagctcacatatgtggagaaaatgcaatgtctttatctgtgtctgatgatgtcgtattccttctgggtagcaaaggcaaataagctaaacatccaggctggtttaaagctgattctgacttaatcatttcaaaattccttcctggttgtgctctgtccctcatgaataaaaatgttcagtttctcgaagagcctttcccgtcctctgcttctttctataaggtggggaccaggtgtacagaatataaaaggagacaggcagcaacatgtctagctttagcattctaatgataccgtgggcagggagagacctggatgcatgctggtccttgagtttgcatggccaggcatctgctggcctccagcccagtgtcctgtgtccctgagtgctcttctggccttggagcttaaatctgtggttgatgaacttagagtccctttctttgactcaggcagtgttcccagggagcacctgccatcctgccctttgcttacttgctgtgccctcaatctcccacttgagagacccctaagccctaagtctctttcgcatcctccgtctccccatggcaggttgtcgtcagctatcaagcagtgagggctttcatctaaggcttcatgctgcacgagaatgagatgatgcacgtgaggaccagagaccctgtcggcttactcttcttccctctctacatgaggcttggctgccccatgttagtacaggaccgccccccaccaccaccgaccccctacacagcaacctctccccagagccccagactgggaagcaaggcaagagccctaaacccttggtcccatccgtcatcctttagaaacccacttctgctctctgggccaaagcttagctctcgtctctcctgctgtatctcctccttttctcatagtcttctagggcattaagaaagaaaaaagaaaaaaagaaaaaaagctttgcttttacttcctacaaaaaaaaaaagcaccatctaacaaatagctccaaaactcaattgcttaaaacaacaattctatttttatcactaatctgcgggtcagctaagggccgaagtttctcttgtacacctctcgtcttcctcctgggaccagggagttagcatgggcatgtttttctctggcagagacacgagagaacaagccactcacacaagcactttccaggcctttggtcttgtcacatccactaacatctgattatctaaactaagtcatgtggccaaatccatagtcgaggagaagagaaacttgctttcccttcagtgaagaaaacagcaaagtcacatggcaaaggccacggatacagggaagggtaaagaattaggggccgccaatgccatcttccatacttaggaggtggatgcaggagaactctgtgacctcctcgatgtactaaaaagcctgagtaggcccggctcggtggctcacgcctgtaatcccagcactttggaaagccgaggcaggcagatcacgaggtcaggagattgtgaccatcctggctaacatggcgaaaccctgtcgctactaaaaaatacaaaaaaaaattagccgggcgtggtggtggtcacctgtagtcccagctactcgggaggctgaggcaggagaatggcgtgaacccaggaggtggagcttgcagtaagccgagatcgcgccactgcactccagcctgggcaacagagtgagactacatctcaaaaaaaaaaaaaaaaaaagcctgagcaaaggaacttggggaaatcattttattcactcaaaagtatgttcagtgctcacatgtaccaggtgctaggcacagaacaatggataaaacagaaatctcttatctttatgaaccatgtactctcatgagcatagacagaatgagaaaagagttgtgtaatataaatgttagcaataagtgctatgaagaaaagtaaaagaggcttagcaggaaagcatgttacaatggccaggaaagtcgtctttgagaaggcaatatttaagcagtggccttaacaaagtgagaaagctggctgtgtggacatctgctggaaaagccttccaggaagagagaatggcagtccaaaggctgtgaggtagggacacgcctggcttgttcaaggacaggaagaaaaccaacatggctggaatacagccatcaagggacagagtggcaggagacagatgaagtcagagggttagccagcagccaattgcacagatggagaccatcatggagagtctgcattttattctaaatgagatgagaaacagtagaaggttttgagcacataagtaacacaatccaatttacatattagaaaggtcattccagctgtgggatgctgtattaactgcagaaggggtgggctgatataggggcaggatggacactaagagaccatttcaaatacagttgtggagtccatgtgagagttagaggcacgtgcaccaacgcaacagcagtgatggtgatggagaaatctttggactaggaacacactgaagtcagagcccatagtatttggtgatcaaccggatgtggtgggtgagagaaagagaagtcaaagagcgtttcccaaggtattggcctgaatagctggcccagtggtggggctgcctactacaatgaggtaccctgggagagaagtagtttaggaactgtggaataaaaattaagacttccattctagccacattcaaggctattccatggatgcatagcactgaggtgcatatcagaaaccgaacaccacctgtaacacggccttttcctgtctttatctcccatctcctcctcaggcagatagatgtcttggcttgactaggacattgatcgttactgggaaaggcaaaaaagaaaaaagcctattgataaatgtcagaatatatctccattataaagtcattcaggtgttgcatatgaacgcaatgatgaagaagaacaaattactgatacacaaaacagcttggatgaatctctagagaatcgtgccaatggaaaaaaagccagtcccaaaaggttacatacccaatgatcccatttatgcaacatttttgaaatgacaaaattttacaattgaggacagattagtgagtgccaagggttagtgactaggacaggagggaaggggaaggaagagaggtgtggttagaaaaggaaaacaaggaggccgggcatggtggctgactcctgcaatctcagcactttgggaggctgaggcaggaagatcacttgaggtcaggagttcgagaccagcctggccaacatggtgaaatctgtctctactaaaaatataaaaattagccaggcatggtggcccatgcctgtagtcccagctactcgggaggctgaggcaggagaattgcttgagcccgggagacagagaagttgcagtgagccaagatcatgctactgtactgcatctaggtgacagagctagactccatctcaaaaatttaaaaataaaaaagagagattcttctgcagtgggaattattcattatcctgactatggtggtggatgcacagacctacacagatgataaaattgtgcagaatcacatttgcacacatacaagagtacaaaatctgaaataagatcattggatcatatcaatgttaatatcctgatggtgacactgtactcctgatttgcaaaatgtctccaatggggaaactgggcaaaatacacaggggatctctctgtacaatttcttacaactacatgtgattctacaatggactcaattaaagtttcaattagaaaaagcaataaaaagccgggcacggtggctcatgcttgtaatcccagcactttggaaggctgaggcaggtggatcgcctcaggtcaggagtttcagaccagcctagtcaacacggcaaaaccccgtctctactaaaaatacaaaaattagccaggcaagatggcgggagcctgtaatctcagctacttgggaggctgaggcaggagaatcgcttgaacctaggagacggaagttgcagtgagcagagatcacaccactggactccagcctgggcaacagagggagactccatctcaaaaaaaaaagaaaaaagaaaaggaaaagcaataaaagtaaaagaagaccaagtccaccttcttctgtggagccatttattcatgggatatttagtcagtgtctcctaggggctagtgccatccaccctgggggagcgtgagggacaggagagggacctgcagcgattaagccaccggttctacccattccctctttactttcctgcgctagccagtagagattaggaaatatgtgggaattattatttatttacagcttagaattttgtagttcttttagagtcattattgaagagaatgattaatataatacatttctttaaaaaggagctagagaaaatggggtagattaaactgcctgcaacttctctcaaggaaagtccccgatggcagcttatcgccttgtgatttatctctacctcctaagagtagaatgcagcaaaattgataaatgaacaaatggcaaatagttaattgaaatttctggtcagttgcctttgcgttttactataaggacagaagcagcaggaaagcactgatgagaaagctcattgaagtgataggtgagaaataatatttaaactgaagagaagaaattatgtcctgtttttcatatcctaaagaacatatagcgtagtcttaatgtccagaatcttctcaaggctgaaggaaatctattttaaaagaattcactcagggagttctagttcaaggctggcttctcattcttttttaattgcattgactttcattcttagacatttattgggctttattattattattgccttatagaatcataggaggccctaagaaataatttgttgaaactttgtcacattacagctgaggaaaatgaggcccagaaaggttaaatgaagccaaggtcacatagctggtacttcacaacgtttcctttttttttttttttttttgagacggagtctcactctgtcaccaggttggagtgcaatggcgtgatctcagctcactgcaacctccacctcccgggttcaagcaattctcctgtgagtagctgagactacaggctcacaccaccacacccggctaatttttgtatttttagtagagacagggttttaccacatgagccaggatggtctcgatctcctgacctcatgatccacccacctcggcctcctaaagttctgggattacagtcataagccaccacacccagccttcaacgatattttcaatataatatactgtcaatatcagaataatctttgcttatcacccaaatgtgtctttaacaaggacaataaataattaatacatcataacctgcaaacatactctcaatatctagataaaacagctgcaaaggcaaatcttgtcataagtgtaggctggaagaggatattttgaacattgagggtcaggctcaatacaggctctgtgtcagaacacctgcaattccagttgcctcacctgctcgaggagctttaacaggtttcttacaaatctcagcttcagttttcttaaccgtgaaatgagaatgatagtagtgccaatatcataagctttgttaggaagatgaaagatgctatcatgaatgtaaagggcttatcacacagcctggcacacagtgagtgtccagtacgtcttaggcagtatcattacatctaatctttgacttttagctaatacaaataaagaatggctgactccaatcctgggtcactcataaaaagaacactcaaacaatgaaaaactgaaaaaaacttttgattgaaaaccaattggtatcatcatctttccatggtttccaaaattaaattatttttaattaacaaaagcaacccccaccaaaaaaaatcatttattgttaaaatgtgatgagagatcagaagttctgttttaatcacatttttagtatttggttaaagaagattgtcaaaacacttatttctgtcccaaatcttcaactcacctgtctttgacacacaacatacttttgcatacccaattgttttgaaataaacaaacatttgaaagccaaaattctaggctgggctcggtagctcacacctgtaatcccagcactttgggaggccaaggcaggtggatcacctgaggtcaggagttcgagaccagcctggccaacatggtgaaatcccatctctactttaaaaaactacaaaaattagccaggtatggtggcaggcacctgtaagctcagctacttgggaggctgaggcaggagaattgcttaaacccaggaggtggagttgcagtgagccaccaagatcatgccattgcactccagcctgggcaacaaaagcaactctgtctcaaaaaaaaaaaaaaaaaaagaaagaaagaaagaaagaaagaaagaaagaaagaaagaaagaaagaaaggaaggaaggaaggaaagaaagaaagaattcttattattataacattccaaagtattccagaaggcatggaaaatttttgaatttcttatttatatacagttgatcattattattatacatttcatatttacaaattcacctactctctaaaatttatttagaacctcaaaagtagtattcttggtgcttttgtggttatttgcagacatgtgctgtgcagcaaacaatttgtcatcaatgtgtacattctcatttgaagtcaaacaaggtgatgcccttgccttctagtttcagctcttataccataaacaagtatcatttttgtagtctattcagtgccattttttttgcattcttgtgtttttattggtgattttactgtataaaatggcccctaagtggagtgctgaaatgctatctattgctcctaagcacaagacgctgcgatctgtcctgtggagaaaatacatctgttagatgagctgtctttaggcatgactgattgtgctggcagccatgagctcaatgttaataaatcaacaacatttatttcaaaactgaatattaaataagatacacacataaagcaaggtaatgtattggttggttgataaaatgttatgaccagatgcttgcaggaacctaaccctgtatttactttaggaacaatgttttagtattcactaattgagtgttagcagcaactgtatgaaacatagctactgcaaatagtgacaattgactgaattatttttaacctgcatcacatgaatatgatgatacattatgtttttatattattttgcagtttaaacagctcttccacagctattatcacacatgatgttcatggagcgttacagtttggctgtgtccccacccaaatctcatcttgaattgtagctcccataattcccacttgttgtgggagggacccgatgggagataattgaatcatgggggggtttcccccatactgttctcatggtagtgaagaagtctcatgagatctgatggttttataaggggtttccctttcagttggctctcattctctcttgcctgctgccatgtaagatgtgcctttcaccttctgccatgattatgaggcctccccagccatgtggaactgtgagtccattaaacctctttttctctgtaaattacccagtctcaggtacgtctttatcagcaaagtgaaaacagactaatacatggaggtaagaggagagtggttactgctcagcacactagattaacaagtccaactaaggctacccaggtagagcctggtcttctccttctggtttgtgaaatctcatggtgcttcctatagcataaagactggctgtcactcaacaccactgcatcttaaggtccgtggaaggggaacataacatgtttcgaagaaaaaggtctgggctacaaagaccctttatgtaatcttgctaacgacctggaatttaaactttggagagcttgaaggttaacaaattggaataaaaagaaatcaagtcactccttgtttgaatgctctgaagaacaaaacagaaaaacacaatgaaatggtaacagaagaagcagatttggcccaataagtctatgctttgaatgttcctccggcactaacatggccacatttgggaagactggcatccccacagacttttctgtagcactttgaaggaagaatagagcagttgtagaaaaacaaatgtttgcatgaaagaattattcacctcttaaaaatctatagggtgtgaataatcctgctataaaaagcattaaatgtttataacagatatttaatgggactgttatgttttttggcagcaagcatggctagattttgaatgtcacagctctgtgctctggtgataagacagactctgtggtctaagtaagaattattttcctgcttttaaatgtagctgttaaaaaacaataaagtgtatttatctaaggaagataatcttctaaaagaagtgtttaataatttttaattcacaatttatactacttctccaaggtaaattcattttccaactgttactccatctttattgactgggaggaattagcattcaaaatacaaactcagaggttaaagcaaagccatacacagaagtgagccttattccattgtcttttatcacgggtgccagatttatttaacagactgtctttcagtctcacttacagtaactagacaggtactatggaggacagtgtatgttgaatgccttccaagtgtgaaacacctgcctggcactacattatcactaattctaaccttgcaagtaagtgcctacttaaatctgcacttgacatgtgaggaaagaggctctgaagttttaaagtgacatgtgccaagtcatatagctagtaagtggtagaaccatgattccagggtgggtctttctgtgcttgttggtttatttactgtctgtgtttgttttatgaaagagaaaagaccctgagagataggcatagtacaggtgacccttgaacaacaggagaattaggggtgctgaccccctatgcagtcaaaattttgcatacaacttttggcttttcagaaacttactgccaatagcttactgttgaccagaagccttactgataacatgaacagttgataaagacatattttgtatatgtattatatactgtattcttataataaattaagctagagaaaagaaaacattattaggaaaatcataggaaagataaaatacatttattattccttaaatggaagtggaacatcataaaggtcttcatcctcatcttcttcacattgagtaggctgaggaggaggaagaggggttagtcttactgtctcagggttggcagaggcaggagaaaatctacatataagtagactcatgcagtttaaaaccatattgttcaagggtcaactgtgtatttatttgatgcttcagaaaggggaccatgtcaattcctgataaggttctctcctctttccttttcctccatctctctgtgtcgatcctagtgctctcatcggcttttaaccagtagaggtctccaaactgtcttgtggcagcctgggctccctatacacagaaagacctggcttcaaaattctggttaatatgggaagtgcattaggaagtagaaaggaaagaaaagtcaaacaataaggaaaggattaatataaatcataaattaattttgtgggcctaattactattttttaaaacactgtaagttttagtagattttcttactctaagttatagaagtcaaaccctaaaacacgttaaaaaaaatctttttgttatttcttaactattacggttattttatcaaaattaattaatatcaaattaatgataatacaaaggaagtcacattattaattaaacaaagtgacttagccttgcaaataaaacactatcgtgtggattaatagtttgaaggtttaactttacagccttttcaattgactgtaatttagagcatttttaggttcacagaaaaatggagcaaaaagtacagagagtttccatatactccctcacccctccccacgttatacatagtttctcttcttattaacatctttctacgtcatgtttttggtgttacatacttgccacacatagtaccctaataatctcttgggccgtacattctctgggtttggacaaatgtgtaatgacacagatccaccattacagtatcatagagagtggttcccctgccctaaaagtcctctgtctccacctgttcatccctccctcccctctgctccttgcccggtccccaggcaactactgatctttttcctgcctctatagctttgccttttccagaatgtcatataattggaatcatacaatatgtacccttttcagattagcttctttcactttgtaaaatacatctaagtttccttcaggtcatggcttgatagatcatttcttttgattgataaataatatttcagccttatttttgtaaggaaaaaatcaaatcaagaaactaaagtttgaacagccactatagaaaaaaaggcaaaagtcaataaacaaaaacaattgttcagcttcgctcataattgtatacacctcccagctcttggactaggtaacatcagtggccagcaagatgccaccgattgagtgattgtttttatttcatgccatgtgacccattggccctccttttcctgacacatttataatcatcttaatcccaaagcaactgtttttaacaaatatgcatatatcctctgattttctgttgctataacagaatacccaagagtgggtaatttataaagaaaatgactttatttcattcatgcttctggaggctgggaagtccaaggtccaggggccacttctggtgaggactttcttgctgtgtcatggcatggtggagggcatcacatggtgagaaggcaagaccaggtcaactcaggtctctcttcctctttctttctttctttttttctttttttttttttgaattggagtttcactcttgttgcccaggctggagtgcaatggcatgatgttggctcactgcaacctccacctcccgggttcaattgattctcctacttcagcctccggagtagctgggattacaggcacgtgccaccacgcccagctaatttttgtatttttactagagatggggtttcaccatgttggccaggatggtctcaatctcttgacttcgtgatcggcccgccttggccccccaaagtgcggggattacaggcgtgagccaccgcgcccaacctttttttttttcttttcttttttttttttaaagacagtctcacactgtcgcccgggctggagtgcaatggcacaatcttggctcactgcaagctccgcctcccagcttcaagtgattctcctgcctcagcctcccaagtagctgggattacaggcgcccaccaccatgcccagctacttttttgtatttttagtagaggcggggtttcactatgttggccaagctggtctcaaactcctgacttcgtgatctgcccgcctcatcctcccaaagtgctgggattaaaggcatgagccaccgcgccccgcctctcttcctctttctttaaagccaccagccccatcatagggacccaccgcgatgaccttatctaattctaattacctcccaaaggccccacctccaaataccatcaacatatgaatttagagattaagtgtccaacacatgaaatttgggggacacattcaaaccatagcatcttctttaagataatgtaaaactattaaattaaataatagagtagaaatcacactaataatttgtgggtctattcagattatatattacctaataatttttacctattttttgaaaattgttccaatcattccccctgcttccttttcaaaagagtcaaacatagccagttaatttaaggtatctgcaaaacctttccaccaagacttttatggtacagagaagtgactcataagccacaattcaattaaatttagcaaatatttcttggacaacaactacatgcttgaggttggcatggggacctgtttttaaacctcctgttcattctactttgactttttaattacaacagattaaaatatcttattcagcaaaaaaaaaaaaaaaaaaaaaaaaagagagaaaaacccactttgtatattgaatttttgaatacacaagagaagtgcaactcagggtggtgggattcctacctagcaggcctgtctccctttgattaccccaatattccaaaggtgcaggttttgtgcaccaggcactctaataggaccctatcagctcagcgctctcagaaatttcagttgtctcccagcccctagaaagtcacaatagctccagggttgtgcttaacgggccatagtgggaggatttggaaaggagaaggtgaatcttttctgtgaaaagcaggtggaggaaactgaagagtggggagaagagaggtggatgctgacctgaattgtgttttcaggagcaggaagagtgtgctctctgcttaagagatgacctgaatggcaagactacatgtcactcggatggtacacagatactgtcttgatgggagttttcggaacagatttgtcctcccagggtgaaatagcagagagatttgaggcagccctcaactagagtatgaccaataaacaccaacttacttggtttttttcattcctttttccctgtgtccaagaagcaaaatgataatgtaaatgaatacacacacactcacactcacacacacacacacacacaccccatgttggggaggcgggtaaaggaacagaattgctctcagcaaacactggtggcatcaaaatagccaatcatgctgatggctgccacacagctcatggaagccttccacaggccagctctcttgctgttggctggctggacttcccagctcagtccctcacctctttacaggacaaggcacaccagaaaccaaggctgttgggggaggcagcaacagagaccagacgttccctctgcacacacatgatgtcatcaatagaaactctgctgatgatgaacccactttcacacaaaccttttaaagcctgagttattttttgcaatgacaaaaataacaaaccacatttttttaaatagcttccttaataataatggaaattcaggtgacattaatgaaaattgtagcacatgttcaaatcagaatctatgttcagtgttatatgcagaatataaagggatttcttttctcaattgatagaaaagggaagtcatatttaagtagtcacggtatcctagatttttaatatagcaacataattgaataatattttgatgtatctggttttagtatttaaggtgataaaatattaaatttaagcttaaaattaaaaatagaggaaaaagaaaaacaaattgaactgaagtgaaaatgtttcttgttttttaaaaaatcattgtacataacagttttcaccttcacttttagaaatcaaagcacaaccctctatcacatggtaaagagagtcagccatacggaaaaccaagctgattgttctattcctgtgcaaattctaaccctaaaatatttctctataatgctttaagaaagaaagtaaatctggaaaacattttttatcattttgaaagctgcctttgttttgattctcattgtgaaggtcaaggataggagaatttccagagatgggaatttatcttcactttatgctatcatttcagaatgaatagtgatcaggttctaaataatgcattccacaggtgtgagcaaccaccctatcactttctatcttcatgtggctggtgcctacaacactaaatttctgcggcagattcattaaggtagttgttcattccctgtcgtaattagacctcccatttcagccttttatgtcaaatccatcactcaccctggcactcaggctcacctctttacaaagcccttccctggtgctattctggctctaaacacaggtgataaatgtgtcagcatggggcacattcctgtccctgaggaccatcaatcgttaagtacagagagctttttccagcagccttctaagatttatacccatgaggatattatttttgtggctgcatgaaggagaattattacttgaaatgggttttgtgaaaggatggttttggtgttgctttggcaccattttaagcttcttttcacaaaattgaccggcgcaagtcagaatttatacttctatgaatgtagatcttcaccatctgatggtgctgagtcctacagagaagaggatttgagactttccagtttttagagatctctacgatgtgcaagaatctagatattcagaggccgtactgacttcaatcacatggtaaattagtatatgagagttcgcagtaataaaagaagtatgtaagtgatcagcatgtgttttagtcagggttctctagagggacagaactaatggaatatatatataatatatatatatataaaatatggaatttattattaagtaataactcacacgatcacaaggtcccacaatagaccatctgcaggctgaagagcaaggagagacagtccgagttccaaaactgaagaacttggagtccaatgttccagggcaggaagcatccagcacaagagaaagatgtaggctgggaggctaggccaagtctccctcttcacatttttctgcctgcttgtattctagccgtgctggcagctgattagatggtgcccacccagattaagggtaggtctgcctttcccagcccactgactcaaatggtaatctcctttggcaacaccctcacagatacacccaggaccaatactttgcatccttcagtccaatcaagttgacagttagtattaaccctcacagcatgggaggtaatgcgtatgttaaatagtttcatttagccatttcacaaggtatacagattccaaaacgtcatgttgtataccacaaatatatgaaatttctacttgtcaatttttgaaaaaaaatgtttaaaagaagtgtgtaaataacttcttactttagatataaaatcttaagggccaggaaaagggcaccaaaatccagcctttgacatctcagaagaagcgatgattaatttcatttcattctgttggtttccatggagtggtgctgggtggtgaggcaaacacagcagcaggaatgttaacatttcatattttagccctaggagtaaagaaaaaaaacatgtcccagatcagcactagctagaaccaggaaaccccaaaagcaaaggtttttttgttttgttttgttttgttctgttttttgtaaaagacaggttttcacaaaggaagttttccaaattctatgtataagagagttgagaaggaagatttttctctcttcttgcccaggaggacaaagggaagagtaccacattaagccattcaggtaaagtgaagcttattgaacgctgtggattaggataaaactaatagagttttcatttttaagccagttcagatattcagattaattatggacgtaatgtagaaaataccaatttctgcaagttctacatttcatgtgaaatcccaaagaggttaaagctgatgggttttaactgatgaaaacacgtgcctctgattaaaaatgtttgtagtgatgaaaacaaagcatgctagagttacagtgtgtagcatgctgaagccaccagcagagcttaggggacaaaaacaactgtttcctaagagaaaaagaggctgagtatcttaagcctggggaagggaaaagacagtagttagcaagctcaggttagccactggtattactctacctttcatgagactcttcactggggaggttggggagattcggtctcacctaaaggagagatggctcgtgaacccaaggatgctgcagggaccctggccaccacttgcagcccaaacactagaatgaggaccagagaacacaatctagctgcttcccatccatcccctccaccccaacatctggtctcagcaacttcctctgccctacactgggatgccctccttagttgatctgaaccatgcagcagatgaaacatgttggcctgacaagtagcagatggctataattgcctgagccatctacaccggcaaatttttcttctttatttgcatatgagtaaaatttttcccagtgttaaattatggtgtgagtagagattttttgagggagcacagcgcagttgtatagacatcgtgattgacaaaaaataaataaaataaaataaaataaatgaccaaaatctgctaaatgaatttgaattaaattgttctaatgctttctttttctttgtaactcttcaccaccacctcaatacatgcattcctggacattcacgcatacactcacacaaacacaagcatggtattttttgtgtgtgagacactgaaggtagcatgaaatagcaaccaaaaaatctgcagtattaaagttagatatgacttggtttgacttgcaaatcaactgcctcactagtaagatgacttctggtatatggatatgtctctcagttttacaggcttgttttcggattaatggtaatagatgtaaagaattgggcacggtaagtcaatagtcaaagctattcaacaaattgaggacaaacaaggaaatgggttaggaattggtctgtagccagtctcagaaatgttgtattaacctttgggatataatcccccaaaattaaagtatagtgattcatccaaaagtacaaagtgttactagcaagatggatgaggatttccatctaacatttttcatcttcttatccctgacacattattaaaacacctagattttggtaaaagaggagaagtcatgtcttggacaggattgaaggttgtgtcaacattccctatgctttcaagtttcagctttagaatccaaaacccccgggcacagtggctcacatctgtaatcccagcactttgggaggtcgaggcaggcacatcacttgaggtcaggagttcaagacaagcctagccaacatggtgaaacctcatttctactaaaaatatggaaattagccagtcatggtggcgcattactataatcgcagctactcgggaggctgaggcaggagaaccgcttgaacccgggaggcagaggctgcaataagccgagattgcattgcaccactgcattccagcctgggcagcagagcgaggctccatctcaaaaaaaaaaaaaaaaaaaaaaaaaaaagaatctaaaccctttggttcacagatggaaggaaaaagcaggcggtgtttcctattctatgtgtatgccatgcctcgagccctgaacaggctactcatctgtggccaatattatattataacctctccattctcagaaggcacgctggcacccatctctgcaagaaaggcatcaaattgtctgtaagtcacagaaatgttattgtattgtcctttattcattcattcagaatatactctctaagcatctatgtaattaaacattactaagcttacatataattaacctcgaaataataactaagcattgttagttttatgtacggctaacttaagaaataaactcactttctagttatcagttttggaaaacaaaagagctctataacaattttgaattaatcaaaaattggagaattctgtgcaaacctataatccttccctctttagggtgaaggagcaacgctttgtgttacttaaagacacactttgccattgtgattaactataataacttttaaaataatcaaaaaatcagtccactttcttgtctatttgtgtattgatcactaaaattattgtacctagtatgatcaactttgtatattactgtatttcattaaagcagctaacttctcttgtccagacataagagaacactagaagacaaaaaacaaaaaacttttatgaatctcttttccttacgaacactaattttataccattttaacatacttgaggtggcaaaaataaacatatatatattatatcatccaaaagtatttgcatattttattaatctattgccattctaagaattcagggtaagttaaaattgtgttaccaaccagcatttattttgcatctgtttcactcttgaaattgtctaggtttcaaagattattaactaattaacttcaccatttgtctaaggtcttaaagttagttaaggatcgagaaatcacaatttttgcaaacataatgaatcctgacacccagcacttaaaaattttacaaaacttaattcttttaaaaatccattaccttttcatttaattgactataattatatgtatgtatgtgtatacattttaaacaagttataaaatttgtgatgatccacttataaaaacaatgtaggaaatttaggaacttaaatgataagaaatttatcattggtctcgtacaaaccaaagtattattctgatattatttttatatgataaatgaaattgtaaagaccctaagtcgtgctcaaggctcttcttctatcttgaactaaggttttcttcttatcttgtaactatagtaacaagggctacaaaagaagcacagcttaatatttttccttttagacatttttgactactaatatggtacagatattcctaatgtgcactcataatgatagagtgaatattttaatcaattttttttttttttgagacggagtctcgctctgtcgcccaggcgggagtgctgtggcgcagtctcggctcactgcaagctccgcctcccgggttcaccccattctcctgcctcagcctcccgagtagctgggactaccggtgcccgccaccgcgcctggctaattttttgtatttttagtagagacagggtttcaccgtgttagccaggatggtctccatctcctgacctcgtgatccatccgcctcggcctcccaaagtgctgggattccagacatgagccaacgcgcccggcctcaattaatttttaaagcttcccaaaagaggataaaagaggaggaaaggaatagaaaaaaaagcagtgatagggacccaccttcagacacttaagacattatcgctgtaaaaagcaagggtcttccctctgcaagaagaggcactaaatgtttagattcaggaaaacccactgtgacatatatacatgcaaaagataactcttacagctggtataaacaattatttgggccttgaaattcttatcaagtaacatgtttaaaagccagactttattaatcctcaaagaacagaaatgtagaaaacagcatttacaatgagccaaaaactctctctttttagattgcaagacaggtatctcttcatgaagctttctccaatttttgttctcaggcaccactcaaatgaacaatcttgttcatgtcaaaaaggtccccaaaatagccactgcagttcaaaattatcctgtgaaattggctaggcatggtagctcacatctgtaatcctagcactgaggtgggcagattgcctgagatcaggagtttgagaccagcctgggcaacacagtgagaccccccccgcccaccatctctactaaaatacaaaaaattatccaggcatagtggcatacgcctgtagtcccagctactcgggaggctgaggcatgagaattgcttgcacccgggggtggagttcgcagtgagccaagatcacgctgctgcacttcagcctgggaaacagagcaagactctgtctcaaaaaaaaaaaaaaaaaaaaaaattatcccgtgaaattctgccagttaaagacacaagcatgtcagttaaggtgatgtgagaaagcaggtatttgtttcatagaaaatgcccagttttaggatggatcagacactatgagcactgcaatagatcctcccacacgatggtgcccgtgcagcctactttcgtcaggacttggccaaagcccattccagggtcagacaatcccttctgatttcaagaagcctaatctaaacaaagcagctctcaggaaaagaacaagaccgacgaaaaagttcttctaagggttcgaaatcatgacccaagtcaaagtttattcaaagaatgttgattgtaggagaacttctgaactcctaggcccctgagccagctcaagaactgacttacctggcttatgctcattgtctccctagagaccttttgttttagagataaagaacactcaagacactgtacaagcagacagtccataggaacatatatctgtagactggtaaacagtatcaccaaagaacaataaaaatcagatcagataaccaaaaagtcactggtaaccttattcctaggggaagaaaaaaaaagagagggagatagagaaaaggaaggaaggaaggaaggaaggaaggaaggaaggaaggaaaaacacctaaagtggaaggacctcagcagaatatggaagctcagttcagcatgaacttctcctagcacgggcagtgtggttacatcagacagctagagacacaaagggtctcaaataagcacactaaaattggtgagtggagggttcccatccaagactgtagggctcacagatgaatattgatggatcttcaaatgcagagattaattacagccactgaccactaggagcccacctgtagtagaacaaatgtgggattcttcactcattgcatcatgggagattgctcattatggagaaccatagaggcatctcagtaagaggatgctggaaagagggtgctagaaagtgctattcggttttcagtaggtgatttggggagagttaaaaaaagtaggggtttgttctagattggatactgtcaggaagcaggtaattctgtgattgaatatcttaatttttttttatcttgaagacagtagagaaaaacagctgtagttggtaaagaagtagaaatgatgtgtattaggctgagaaggggtatgttggatcattttcgtgttctggccagttttcttttttcagtgctgagacatgtctcatggagtgacctcttctttgcctttccccatgaaggtcacggaatgaccttgtctgatgttgagttctgtgaaatggatcaccccaaacagaagcacacatggcctggctgtgagttcccaaacagctccccacgctcaagagctgcttttctttctcattctcaattaaggattgaaggaggacacaaaaacacgatcaccaaaggaaaatgaaacaaatttaaagtaaataaaactcagcaaaaagaaaaactacaggaaaagaaaagtaactgtaggaaacaataatgacttagccctaaatggcatttacgtggtcttaatcatatgtgaccttaatcctataaaaaccaaattgtgatctaactccaagtccaacctgcctattttagaagggtagttggatggtgctagtggatggtggggaggagagtagaagctaactcatcatcatccgtattggtaagtgaatagataatgcctaaaaacatgtcatgaaattgcaatgtcaccacatcatttggagatacgtttttaagtcagcctaaagggttgaaaatgcttctaggctggggcaacgggagggcagagcatagaagatggtaatgattcctgaccatccttcaagaactatctttctaattttttccatcttctcctccctgctttattctagccacactggcagctgattagatggtgcccacccagattgagggtgggtctgcctctcccagcccactgactcaaatgctaatttcctttggcaacaccctcacagacacacccaggaacaatactttacatccaaccaagttccaaggattggaacaatacaatcaagttgacactgaatattaaccatcacacacagacatatatacatatatatatattttttagacagggtctcactctgtcacccaggctggagtcgagtggtacaatcatggcttactgcagcctgaagcctcaacctcctcagctcaggtgatcctcccacctcagcctcccaagtaactgggactacaggcacacaccactacaccttgctaatttttgtattttttgtaaagatggggtctcactaagttgtctatggctggtctcgaactcctgggctcaagtgatccacccactgtggtctcctaaagtaagtcatggcacctggccaactttttttttttttctttttttttgagatggagtcttgctctgtcgcctaggctggagtgcagtggcacgatctcagctcaccacaatctctgcctcccaggttcacgcctttctcccacctcagcctcctgagtagctgggactacaggcgcccacgaccacgcctggctaatgttttgtatttttagtagagacagggcttcaccgtgttagccagaatggtctcaatctcccgaccttgtgatgtgccctcctcagcctcccaaaatgctggtattacagatgtgagccaccacacccggccccaactttttaaaaatattttttaaagaatgagtagaagtagccaggtgaagaaaagaaaaggaaacagagctgggaaaaggtgtgttgcatcagaaactagaggagggcatttcgcctggaccagagaaagttctgatgagccaggaaggctgggcagagccagctcaggccaggcaggcgcgattctgcacaggacaggatgcacctccaatgaccacgtgtttctaggttgtttccaagggcacacagataacagtcaacgatttttttctgactagccactgtagtgatcgctgctgtgtgaccctccacactttgcttccctcgggcctcagctccgcctcattccactggcctaataattaactcagccttattttcccaacctaattgtttcacagaccaaaagaaatattggatgtaaggtacaatttgaaaagtgtaatgtgctctagaaatgcataaaatgatgattagtctttgcccagtaggctttttagcttaataagctcctgataatacagaaatcactgtgagcaactggcagagaaagatttttccatttctcttaactaagaaaagagatttaaagtcactttggagagctaacactaaataataataactgccaaaggaattgatttgatgctgaatataggcttgtgtaaggaggtaaaaaactgtccactaaagttaatgctcatagtaagaggcctctgtccttgaattcaccttgagagagttgaacagggataacggattttcaaggacacacatctacagagaaagggcgtatggaaatggaaaagggaaagctgctcctagtgtttttgctgaattgttctctttctctaacccagcaggagagatgctaaaggagattttgtcaaagaaaatccttgacattggattcttaaaagccttatggtttcatgataggccctttaccaaggattcttaagggacaaccttatgttagagagaaacaaagtcctgaatcatatttcctcctctctggaatatatgtagaaatacaagtgagaagataaatacatgtgtaaaaagaaaattcatactttcatactcgttatatgttatgattaaatgttgattgcatttggagagcatcagcatatgaactatattacagaaaggatagtcttttgtttcatggcttaaatcttcttttctcaataagattaaggggctagctaagattataatcataacaattttttttttttcactgagtttccaccctgtgaggaacactaggctaagcaggaaaaaaaaaaaaaaaagtcactaaaagaccctaggctatttgtacaccaatgttcatagcagcattattcacaatagcaaaaaggtggaaagaaccaagtgtccatagatggacagataaacaaaatgtggtctatacgtacaacatgggtgaaccttaacattgtgttaagggaaataagccagttacaaaaggacaaatactgtatgattccatttctatgagatacttagaggagttgaaatcatagacacagaaagtcagatggtgactgccaggggctgggaggagggacaatggggagttgttgtttaatgggtatagagtttcaattttgcaagacaaagaatttccagagatgggtggtggtgatggtgcacaacaatgtgaatacacttaatgccactgacttgtacatttaaaagtaggttaaaatgggccaggcatggtggctcacacctgtaatcccagcactttgggaggccgaggtgggtggatcacgaggtcaggagtttgagaccagcctgactaacatggtgaaaccgcgtctgtactaaaaatacaaaaattggctgggcatggtggcatgcgcctgtaatcccagctactcaggaggctgaggcaggagaatcactggaacccgggatgcggaggttgtagttagccaagatcatgccacttcacttcagcctgggtgacaaggcgagactccgtctaaaaaaaaaaaaaaatatatatatatatataggttaaaatgtccattttatgttaggtacattttactgcataaaaaaaaaaaagactatgggcaagccatttccttcctctgtgcctcagtgacattatctgtgaaataaatgtgtagaaacagatggactccaaggatgcattcaactctgcaagtctgtgtgtctaaacatcccctctgtcctcatggggtttagcagcaagttggagagatgaaatgcagtaataaaatgtaaaatacttctagttaatgttttaagtacccaattagtgattttttaaaaaggaatatgtattcccttgagaagggatagagcagaaatctggaggacagctttgtggagatagaactggaccatgcccacttcaagaagtatgtagctcggatgtggatctgtgccagtgggatggccttaacaaaggtgagcaggcttcaccacaccagggggtccgtagaacagcaagaagatgagcctgttggtggtagaaggcttctgcgtcaaagtgaagcattgaggaggacccatgggtgactttgagggactctgaatggaagagagtggatggacgagacacctggcctatccacaaactggccctatagccttgaataatcactgggacctcagttcctgctgtatgacaccaaggctagctcctttacaagacggaagcacagcctagctgatcttgctcttcctgctggaaaactccatgattctctttgccttccaggcaacagacacataagattcctgctgccaggtcactgctggatgctggactccagcagtgacaggccccgaacctgcccttgtgaaggccactttcttagtggtggtggctcatctagcaggctgaggaatgtacaaaggatgtgtaagaaaatctacctagcagtagggtatataatgagttaaagaactgagcttctactggcaatgagaccagccagggtaatgttgcaaaagtttagatgtacattaagacccagaagggctgaacttggttaggggagaggaacatgaaatgaaaagtctaatgcatgaaccctagaaccacatgaatattaaagctcacactgaagtatctgtgcctccttctcccttgccctgccctttttcagcctcccaaagctgcacccattcctcctgtgtccccaatatcccctatgccatgtgatgtggtttgactctgtgtccccacccaaatctcatctcgaactgtaatccccatgtgtcaaggggggacctggtgggagatggttggatcatgagggtggtttgccccgcgctgttctcaggatagtgagtgagttctcacaagatctgatggttttataaggggctcttctcccttagctttcgcttctctcgcctgcctacttccccttccccatgattgtaagtttcatgagacctccccagccatgtggaactgtgaatcaattaaacctctttcctttataaattactcagtctcgattattctttttttttttttttttttttttgagattgagtctctctctgtcacccaggctggagtgcagtggcaggatctcggctcactgcaacctctgcctcccaggttcaagcaattctcctgcctcagcttcctgagtagcttggattacaggcgcctactactgtgtctggctaatttttgtatttttagtagaggcagagtttcacatgttggccatagttgatcctgatctctcaggagatctgcccaccttggcctcccaaagcacttggattacaggcatgagccttgggtatttctttatagcagtgtgaaaatggactaatacaccatggtaactgggtcccatacatcctgaaaatactaatagaacaaatattcccactcctgaaatttaacttgatcctgaagacgaaggatttccttgagctcataaatggaagtggttcatcttccaggtagagaatgcaaggtagattggttttgttcacaggggtcatgcagagctaagcacatagaaggtgctcagtaagcacctgctgaacatactgaagtgacatagccaggcagagacgggtaggtggacagccaacacgccatgagagctggaagggcgcatcctctcttaggagcttgggccctggccagctgactcagcttcaagctctgctagtacataagtccctcggggcctataagcttggccgtgttgcagctgaaatttctgctgaataaggtcatacatactaagctgagaatgcaatagtgagaatggctccttctttttcgcatcccagaccccagaatagaaatatttaccatcacgtctggatgataatatcaataaattatcagacattgcacgtattaagaaaagctcattttctggaaattgtccttattgtcctaattgggaattatcttgaagccgtggatagaaaatgacctttcagattgctgggacaaagcccaagtctaaattggaaacgtgtttaatggctaagacagcccacttccagattaattatggatgcttttccatttcaagattacattaggaaggaaagttgtcactgggtggaatgtgagtctccactgcatccttttaagataaataagttgaagtttgaagaaaatttgagattacttttggttaagtgaataaaatctgtttagcgaactctttgaagttgtggattgcctgggaatctacaaatctgcaacctccctccctctagatacattcagagggtagaagagaagtcatttaaaaccttatgcttgacttcttgcttcctgccttggtttttaaccaaaactaaaaataaaaaagccaaaagagaggaaacttgataggttcaaaacaggaaattagattgtaagcaaagaaattgtccaaacatcgaaaaaaggaacacatcaaagaagggaggtgctttgtttttatactttgttatcgtcctggaaaaaaatgtctgctgcctctgataatacatattaacacttcttttttacttagcttttatttttatcaaagtaataaaatcatcttgtttaaagtgtcaaatagttctatatggcttattaggataaacaaccatccaattttcaagatttttttttcctttggcatttgtctttaattctctaaatatattcacctgctacttgaggggtcagcagacttttcctgtaaagagcaaaacaatgagtattttaggctttgagagccatagagtctctgttgcagttactcacctctgctgttgtagcacaaaagcagctgtgggcaatatgtaaatgagtgggtgtagctgggtgctgaaaaaactttatctacaaacacaggtggctgcacagtgggctgtcctttaccgtctcctaggctactccttgagtttctgtttttagtcagtcactgttaggtgactcctgactatggaagatgaggattaggctctttcacagccaacaactctcctccatggcctcctcccctccatgtttttcctttaccttcacccttccaataggatggtttactggctttggatagatccgtatgcagtgtttacatcatcatgcttttcataactgaaccatataatagagctgtgtttccagccaggcatggtggttcattcctataatcccagtgctttgggaggcacaggtgagggattgcttgaggccaggagttcaagatcaacctgggcaacatagtgtgagatcctgtctctacaaaaaaaaaaaaaaaagacattaacttggtattatggtgcacacctgtagtcccagctacttgggaggctgaagtgggaggatcacttgagcccaggaattggagactgcagcgagctatgatagcaacactgcactccagcctgggtgaaagaccaaggccctgtctcaaaaaaaaaaaaaaaaaaaaaaaaaaaaaagtttcctttcctacacactattttgttttccttaatcattatattgttttcttcatttgcttaattttttgtgaactaattatgaattgaaactcaagctctctctcaattttaaaatcttccctcaacatattgcagccaatataagaggaactcaccatttcattttcttggaaacttctaccccagagcattctggctggataggccttgggcatctgtattagtctgtcttccttctgctataaagaactacatgagactgggtaatttatgaagaaaagaggtttaattgactcgcagttctgcagggttaacaggaagtctggctaagacgcctcaggaaacttataatcacagcagaaggtgaaggggaagtaagcatgtcttacctctgcaaagcaggagaaagcgagtgagctgggatctgccacatacttttaaaccatcagatctcttgagaacccactcacactatcatgagaacagcaagggagaaatccgcccccatgatccaatcatctcccaccaggaccctcccctgacacatgggattacaattcaaggtgagatttgcgggggggacacagagccaagccgtatcaccatccttgcatctctcttctccatcatcatagataacctgggcctccggatggcatgagatccccctcctacccggcttccatgactttctctttgttgatctagtcccttttttaaaaatggagccatccttctgtagcttcctgagaaagaatgaacgggaatcacattttctgaaacattgcaagtctgaaaatgtctttattctccctcatgcttaattgaaatcagactgaatacagaattctcatttagaaattatttcccttcacaagtttgaaggaatttgtctattgtcaatagtattgctctcaagaaattcaatgccattttcattctcaattctttatttgaactcggtgtttttctctctggaagattttaggttcttattcttctttgttttctgaaatctcatgaatattatttgatgtgggtctattttgactctttctgttggaacacacatggggccttttaatctggaaagccgttcttgaactctaggaatagattttgggggacaatttcttctttcatttcctgttctctcttcccagaatttgttattcagctatcagaccccatggactgatctgttattttcttatattttctttcatttgttcaatttctttggctgttgtttcccctattctctgaacaatgttctcaaatttacatttcataaactctcattgagtttttcacttctttttttatgttctgaatttccaagagctctattttttgttctttgaatgttcctttttttaaatcatctgttctcatttcatgaaagcaatatgttatctctcagaaggtattaatgacggttttctcccaagtgtttcttttcctactcagcctctttttccttcaagtagctttctttggttggttggttggtgtgtgtgtgtgtgtgtgtatatgtgtattttcgtttgtttttcttttttcttctcctgtgtttgagacatgtcctcaaatgcctggttcccctttagctgacacccacatttaagattgaggcactacaaatatgactgaaagttctgtgcacacaaatggggcctgtcacccgtgggcttcagtggctgagttgtttcatcgggaagcccctgatgttgcatcactgagatttttgtcttgggctgattgaaagctccagagaagaattttctgccctgttgcctggagggtagacacctggctgtcactgttctcacagctaagaaggaagaggactgcgaggttcaagattcagtgtgtaaatgttgactgaagatccctgttttcagtacagagcccctgccgtcctatgcctagagtcctccaactgagagtctctgtgtccttcccagagaatacatcgttcctcttctgccagagtgaggggaggacagatgcctggggtagggatctggggatataaatgttcttcacgagcttccagtgagttcttctgtttttagcttcacataaacacacatatccagtggaaactcttgccatcaactgcacaaataatgggcggctttgcagtgccaaccgggctacttctcagcactctccacctcagtgcaagcatctgtccttggatatgctgccacttaagatggttctgctgtttttcagctctaaaaaggttgttatcatcccctgcctcatgatttgttcttacaccttcgtatatcttaacacttcattccccttttcacgggctttatgaagaagcagtggtaaatgtaggtgctcaatccaccatctttaatgggaatccttcagcacttctattttagaaaaaatgtgaagaatatacatagagactgggcatggtagcgcatgccggtaatcccagcaatttgggaggcggaggtgggcagatcacctgagttccggagtttgagatcagcctgggcaacatgacaaaacccacccatctctacaaaaaaaacacaaaaattgcccaggcatcgtggcacacacctgtagtcccagctaatggggatgctgaggcaggagaattgcttgagcctgggagatggaggttgcagtgagctgagatcacaccactgcactctaacctgtttgacagagtgagaccctgtctcaaaaaaaagaatatactaaacactcatttcacaatattcttgacttattaaagctggagtcatggcataatttccaatttgcttttcaaaagaattaattgatcagctaagaaatttacaagtaatttttttcaaatagtgaggtcccttagtattaaaatgaatttcatgttttaatactaggtttttcctcccacgcagtgaattttcttcttgctttaagaagaaatgctctggagagaatataaaattatatatagttgtgtatgaattatatgtcataggattacatataattatatgtaaatataattacaattataacattaatacatgttcactgcagaaaacttggaaaaaaacaaagagtttaagagaaacttcataatcaactgtattctcaacaactacagaaagcttaaccaatgatttgtccgtatccatggctaagaacgaatgtacctacacatctgtgccatttttaaattggcattttttaaaaagtagatccaattttagaagtttgaaatctagtttaaaagcctagattttatttttttccattttaacctatttatgtatttatttatttatttatttatttatttatttatttattatactttaagttctggggtacatgtacggaacgtgcagttttgttacataggtatacacgtgccatggtggtttgctgtacccatcaacctgtcatctacattaggtatttctcctaatgctatccctcccctagccctcccaccccccaataggccccggtgtgtgatgtccccctccctatgtccatgtgttctcattgttcagctcccacctgtgagtgagaacatgcagtgtttggttttctgttcttgggttagtttgctgagaatgatggtttccagcttcatccaagtccctgcaaaggacgtgaactcatccttttttatggctgcatagtgttccatggtgtatatgtgccacattttctttatccattctatcattgatgggcatttgggttggttccaactctttgctattgtgaatagtgccgcaataaacatacatgtgcatgtgtctttatagtagaatgacttataatcctttgggtatatagccagtaatgggattgctgggtcaaatggtatttctggttctagattcttgaggaatctccacaaagcctagattttctagaggaattcttctctatacagggaaacattgcagtaatgagtttaagtgcattgattctttaagcacatttgtttgttgaatgataagactattgtatgtagttcacatccagccccctacacaactgtcacacacaatgaccttcacagtgattcatgcctgaacaacattgtttcctttgcctttaggcttgcaattgggaactcattttatttgaaccaaagccttcagtcgagatgaaaattttcactcacgtctgtgtgaagagaccaccaaacaggctttgtgtgagcaacaaggctgtttatttcacctgggtgcaggcgggctgagtccaaaaagagagtcagcaaagggagatggggtggggccattttataagattcgggtaagtaaaggaaaattacagtcaaaggggggttattcgctggtggcaggagtgggggtcacagggtgctcagtaggggagcttttgagccaggatgagccaggagaaggaatttcacacgataatgtcatcagttaaggcatgaacaggccattttcacttcttttgtggtggaatgtcatgagttaaggcaggaaccggccatctggatgtatacgtgcaggtcacaggggatatgatggcttagccttgggctcagaggcctgacattcctgtcttcttatattagtaagaaaaataaaatgaaatagtggtaaagtgttgggacggcaaaaattttggggggtggtatggagagataatgggcgatgtttcttagggctgcttcgagcgggattaggggcggcatgggaacctagagtgggagagattaagctgaaggaagattttgtggtaaggggtgatattgtggggttgttagaagaaacatttgtagtgtagaattattggtgatggcctggatacgattttgtataaattgaaaaactatacggaataagagaaggagaaaaacaggtattaaaagactaagaattgggaggacctaggacatctaactagagagtgtccaagggggttcagcataattacttacttggttggcaagtttttgggctctatccttgagttttttatgttgtcatacaccaggccagattgatttaggtaaaaacaacactcttcatttaagaatatacagagtcctcctttttcagcagtgagtaagtcaaggcctcagcggttttggaggacaactgcagctaaagagtcaacttgggcctggaggactgataaagtttgtgatatgtctgtgatgctagcagagaagtcattagagaggctacggaaggtcgtgacagaggttgaaatgcctgctattccagtaccgagagcaatagtagaggcagaaagtcctaaaccgacaagcaagggaattagtggaataactcttttttgtcgtgtcggtgtcatgaggggaacagggagctcttcggtcctatttgcaaattgaattttgggggtaaggaagactagtgtgcatgtgcctgtccaattagcaggtagacacatgtaggtagaggatccacagacgaagagaccttgtgcgaggcaaaactggagatgcaaagtaaagagaagcagtgctgaaaggggtgtcttgtacccagactcctaggtatccagctagggtggcagccgtcagaggttgtaatggggattgatgaagtaactgcgtagagggggaggttcgatttacatggtgtgtgagaaaacgttgagtatctacgagcaacctttcactgttattttcggggctgggtataagtaaacaagaagagggctttggagatgaagagtaaaggaacatcgagaaggtgaaagattacctaagggaattccagtaggtctttgctgagagatacataaaggagcggccacaggaatagtagtttgtgttgtgagaggtctaaatatggggggagtagagttgatataaggagaaaggtttttcaagtaagtgtggaggagggtggcagcttgctgatgtgaaatgtctggggaggtcttgctggacctgtctagaaagtaaatgagttcttcaggagggtaaaagtgagggctgttaaaggaagtctggaggtgtagggagacaggaggtgttgcctagtctgcatgtaaggtggggacaactgtgtaggccctggaagaaagggaaatgcaaagccagtggttgtttgctaaggagggattagaaacggctaggagagaatgagtaaggttgatagcgtggtggagatagctggggagaggtagagggtggcagaggaatgggaatgagaataaaagtgagtataaaagtaaagaatagaacttcgtcagggtgaaagtactggagggtcccctgccagcaaagatcatctatccactctaagagggagttaagagttgccagtcctgggcgggggcaaatcctcgagcttgatgtgtagggaagggagggggcctgaataatccctgaagagtagcagaatagcagatggaagaagttacttccttgaggatagatttccacgatggaaagaaaatgagaggttctaagaggcaggctagtggcttgtactatagcatagcctgcctttgctggtgtgtggcgattaggcctggtggaactgccatcaataaaccaagtgtgttcagggtgaggaacaggaaagaaggaaatacggggaaatggggtgaatgtcaagtggatcagagagatacagtcataggggtcaggtgtggtatctggaatactgtgtgaggccggattgaagtctgggccaggaacaatggtaattgtgggagattcaacaaagagtgagtacacctgaaggagccggggagcagaaagtatatgcatcaggtgggagaaagaaaatagatcttggaagttatgagaactgtagacagtgagtttaacacagtttgtgattttttgggcctctaaaagtattaaagcagtggcagcagctgcatgcagacatgagggctaggctaaaacagtaaggtcatagttgtttggacagaaaggctacagggtgctgtcccggctcttgtgtaagaattctgaccgcactaaccatgcctaggaaggaaaggaattgttgttttgtagaagggattggggtttgggagattagccagacacgatcagcagggaaagcacgtgtgtttttatgataattatgctgagacaggtaacagatgaggaagaaatttgggcttgactgaagtaatgggagctgtctgtgaagccttgcggcagtacagcccaggtaatttgctgagcctgatgggtgtgagggtcagtccaagtgaaagcaaagagaggctgggatgaagggtgcaaaggaatagtaaagaaagcatgtttgagatccagaacagaataatgggttgtggagggaagtattgaggataggagagtatatgggtttggcaccacagggtggataggcaaaacaatttggttgataaggcgcagatcctgaactaacctgtaagccttgtctggttttaggacaggtaaaatgggggaattgtaaggggagtttataggctttaaaaggccatgctgtaacaggcaagtgataacagactttaatccttttaaagcatgctgtgggatgggatattggcattgagggggtaagggtgattaggttttaatgggatggtaaggggtgcatgatcggtcgctaaggagggagtagtggtgtcctatacttgtgggttaaggtggggagatacaagtgggggggatgtgaaggaggcgttgaactgggggaaaaggtggcaatgaggtgtggctgtagcccaggaatagtcagggaagcagataatttagttaaagtgtctcggcctaataagggaactgggcaggttggggataactaaaaaggagtgcttaaaagagtattgtctaagttggcaccagagttggggagttttaagaggtttagaagcctggccatcaatacccacaacagttacggaggcaagggaaacaggcccttgaaaagaaggtaatgtggagtgggtagcctccatattgattaagaaggggacagacttgctctccactgtgagaattaccagaagatcggcatccgtgatagtctagggggcttccgaggtgatcgggcagcgtccgtcttcagccactaagccaagaagatctgggaaggagtcagagagccttaggccagagttccaggggctctgggagtggctgccaggtgagttgaacagtccgattttcagtggggtcccgcacagatgggacatggcttaggaggaatcctgggctgcgggcattccttggcccagtggccagatttccagcacttgtagcaagctcccgggggagaaggttctggaggaatccctggcagctgcagttcaggcgtttggagttcttgtgtgctggagatatggctggggtttgtctcacagtggaggcaaggaattgcaactcagaaatacattgctacttggctgcctctactctattattgtacaccttgaaggcaaggttaattaagtcctgttgtggggtctgagcaccggaatttaatttttggagtttatttaatgtcgggagcagattgggtaataaaatgtatattgagaataagacggccttttgaccttttagggtctagggctataaagcgtctcagggttgctgccaaacaagccatgaactggactgggtttttatatttgatgaaaaagagcctaaatgctatctgatttgggataaggaaaaggagcattaaccttgactatgcctttagctccagccacctttttaagaggaaattgctgggcaggttggggagagcttgtcactgaacgaaactgtaagccggactgggtgtgaggaggggagatgataaaaggattgtagggtggaggagtggaggctgaggaagaattggaacctagctcgacctggcaaggaggggagaggtcagatgggtctgtagaaaaggaagattagaaagactcagcgacacttggggttgggactaaggggacaggtgggagggaaagaaggaagatttgggacaagttgcattgggaacagagactagggagggaccgatgtgtaaaagagtgcctggatgtcaggcacctcagaccatttgcctattttatgacaagaattatttagatcttgtaggatggaaaaattgaaagtgccattttctggctatttggaaccactgtcaagtttgtactggggtcaagcggcattgcagaagaaaataaggcatttaggttttaggtcaggtgtgagttgaagaggttttaggtttttaagaacacaggctaagggagaagaagggggaatggagggtggaagcttgcccatagtgaaggaggcaagcccagagaaaagagcaagtagagacatggagagaaggggtcggggggttcttgccccctagaaaagcggtacttgccgctgagggtgaaggagaaggagttggggggttcttgccccccagaaaagcagagaaggggtagagacatggagagaaggggttagggggttcttgccctccagaaaagcggtacttgccactaagggtgaaggaccaaggcaggcgtccccgtgtggtcagatgcctctgaaatgtgggtgaataatcaggcaggcgtccccatgtgattaaacaccaagggaagactgtcttccccagtccgtgaccggtgccggagttttgggtccacagataaaacgtgtctccttcgtctctaccagaaaaggaaaggaactgaaattaagagaagggagagattgaagtgtggcaccaagattgaaaggagaaagaggttgagggatagtgagagaggttggagaagagagtaaaaagaggccgcttactggatttaaaattggtgagatgttccttgggctggttggtctgaggaccagaggtcgtaggtggatctttctcacagaccaaagagcaggaggacaggggattgatctcctaaggaagatcccctgattcgagtcacagcaccaaatttcacttgcgtccatgtgaagagaccaccaaacaggctttgtgtgagcaacaaggctgtttatttcacctgggtgcaggcaggctgagtccaaaaagagagtcagcaaagggagataggggtgaggccgttttataagatttgggtaggtaaaggaaaattacagtcaaaggggggttgttctctggcgggcaggagtgggggtcacagggtgctcagtaggggagcttttgagccaggatgagccaggagaaggaatttcacaagataatgtcatcagttaaggcaggaacaggccattttcacttcttttgtagtggaatgtcatgagttaaggcaggaaccggccatctggatgtgtacatgcaggtcacaggaaatgatggcttagcttgggctcagaggcctgacaaaaatgttgttaattgctctggttatagacagaatagtagcaggaataaataatcagaaacatttatggattatatctttgttgatattttaaacctatcagttacctttctagcctaatgagaatgccttgataaagccacattcttggaaattttggttttcataaatgtgcttgggttttataagtcctgctttgcctaccacttgaccaaattccctacagacttttttatataaacacctatggttaagacaaaatgtgttctttcaacaatgtacagcttctgagagtaatgtctaggctggagtatattcatatatattatttatgctttcatttaacaaacacatgctgagatcctactttttgccggacttagtactgattgctctctcctgagcatccttcttaagtcaaagagaatattcattgttagggaaggaaaaaaagatagagggaaaaaaaatagatggcaagaacatggcaggaacccagtcctgaacacccaggggttttcagaataagggagaggttaacaatctacatagagcaactgggattaaaaatgggaagctggcttcatggggggaggaatagcattaggagatatacctaatgtaaatgacaagttaatgggtgcagcacaccaacatagcacatgtatacatatgtaacaaacctgcacgttgtgcacatgtaccttagaacttaaagtataataaaaatatattaaaaaaaaaagaaatgggaagctggctgccaagactgcaggaagactgtgtcagattcagagcatgaccatcagcaaggtaaatccctactgcccacagtcataattggcaccagactctaggaaggaattatatatttacgtggtgcctaatggggatgtgaggatctcagagggagaaaactaggtaggcacaaataatacccgcacaggccttatttacacctattttatgcaaagttctaatagaaatcattaactggtttcctagcccttgcaagatccaacacaaattagtagaatgttctagaaggaatagaagtaaaaatatcaatcacagtaagaacaggcagctagatgcatattggcaagagggcagataaatagaaagatgtgagaagtcaaaaatcctattgcgatctcattttgcagggaaccaaagatcccaaatagctctctctggaggcaccagtgtatatattattaaagactcagcgagaaaagacaattcactttaagacagcaaataaacaaataaacaatgtggagctgccattcccaatccatttatctggaatagttcagcctcatttggcaatctgtattttttctgaagccccacggggtcattaaaaactccataggtcccaaatgtatttgcataatgatagatgccatccccctgcctgacagtaaagaagcagcaatttaaaaagtatgatgccagccaggcacagtggctctcgcctgtaatcccagcactttgggaggccgaggtgggcagatcacctgaggtcaggagtttgagaccatcctgaccaacatggtgaaactctgtctctacaaaaaatacagaattagccaggcgtggtggcacatgccagtaatcccagctactcgggagactgaggcaggagaattacttgaacccaggaggcagagtttgcaatgggctgagatcatgccattgcacttcagcctgggcaacaagaatgaaactccatctcaaaaaaaaaaaattcatggtattattcttttgaggaagcatactagaaatcaagaatcaggccaagtgctgaggctcatgcctgtaatcctaatgctttggaaggctgagatgggagggctacttgaggccaggagttcaagatcagcctgggcaggacagcaagactccagtctccaaaaaaatatttttaattaaaaaaggaccagtcttattaaagtaaactgcagtcctgttactgatcttagtatcaaagcaatgttagagcccacgtgggattcacacctcctagagttcacagcacaagtttgctgtaacagtagataaggtcttggttgccctgagctcatttcttttttttttttagacggagtcttgctctttcgcccaggctgaagtgcagtggtgcgatctcggctcactgcaagctccgcctcccgggttcatgccattgtcctgcctcagcctcctgagtagctggaactacaggcaccacgcccggctaattttttgtatttttagtagagacggggattcaccatggtctcaatctcctgacctcgtgatccgcctaactcggcctcccaaagtgctgggattacaggcgtgagcctccgtgcccggccctgccctgagctcatttctaaatccatcttcctccaaggtggtggcaagcatgcttctttatcccggagagatggccctttcatcaaagtctcattcagacccttctccttttggaatgcttttcttgggaggttggctgggatgcctactactcttgaggatctgcctctgatagagcctagatcttagaatcaggagagtttcttgcaggcccatcagttactgtgaaagatacctgagctagttggctcacaatccacatccatcaaaccgccccctgcagagaagtcacccggctgtcgcctgcttggcttgccctgcctctcgccattctcatttcattagcaatgcgaatgttcacacccttcaatgtgcatatgatgggtgttaatgagcataacacatctgtgaagcgtgtgtgatttttttgcctaataaataggcagtaaacaagaggaagggaagagctactatctgggggcatctgagaaaacaaaaagcaagcaaggtatgagtcagattgattgttcagtgaatcccaaagggccaaaaacttcctaaactggttttggtgtttctcactaggtgtttggacagcttggaacctggatagtcccacctacccaaaagcattcaaattaggcatgcttttaacaaagcaggtggcatggcatgtaaattgtaggaacactgttaacctttgcaaatgagtttcgtggtccgaatggataattacatatttccctccattaggagctacaaactcatcaagattctacaaccaaccggctcttgagtttcaatctccatgtgacaaggggatttattatgagagggcagagagaaaagaggaacaccgctctctttctctgcaatggaatgatggtcagaaaagaacagatcaaaggaataaacctgctctcctattaactcagcttaccaattctggcctacattttcaaagttatcagtaatcaaaacattgggaaaggaattacaacctcttctcctgaaagtttaacaacttccccatgaagcactgcttttgattgcattacaagctattcctgaagaatttatgacctaagatactctttgtcaatgtaggccatttgtccatgagtggagtgactgataaatcagctattaacatagataagaaagcatatcgattgagtcaactttgtgtttaataatatgctagacagtaatgatgcctggaaaatacactctgtaattaagtacttttccctttatatttcatgaagactcttgtatattttattctggcaaaatagattgtgactaacatctcatagaaaagatcatcatattgtgatcctatatctttatcataaaagtgaatttgagggaaatttttataatttttcaatataaaaattattaagatatcaaaactctttgttttttcactactccaaggtttatttcatcatcttaaaaaccttgtgaatacaatcagtctgctaggtcaggggtcaccaacctagggccatggacacctaccgtggcctgttaggaaccaggccacacagcaggaggtgaatggcagacacgcaattgaagcttcatatgtgtttacaactgctccccatggctcgcattaccacctgagctccaccttctgtcagctcggcagcaacactagattctcataggagcacaaacccgattgtgtactgtgcatgcgagggatctaggttgcacactccttatgagaatctaatgcttgatgatctgtcagtatctcccatcacccctgagatgggaccatctagttgcaggataacaagctcagggctccccttgattctgcattatagtaagttgtatagttatttcattatatattacaatgtaataataataatagaaataaagtgcataataaatgcaatgtgcttgaatcatcccaaaaccatcccctactcccctagtccacggaaaagctgtcttctgcaagactggtccctggtgccaaaaagattgcagaccactctgctaggtagaactgcattcttgtgattatgtattttaatgagcgcatttccttttcatatggagaagggaaccacattgccttaattccccaacttctgccccaaagctttctaggccaatatggctgcattcgagttgctgatggctgtgctaccctcccagggctgatgtacagtttcctgcctgggccgtgtcaccaatcactagggtttaggaggctatagtcagatcttgcagaatatgtcagtctcattctctgtagaattttttgtttgcctgtttttttcttctctttggcactggactatgggcagtggcagttagtggtagatccagggtggagagctgagacctaacaaagaatttttttttctttttttttttttttttttttttttgagatggggtctccataggtcacccaggttggagtgcagtggctcaatctccactcatggcaccctccgcctcctgggttcaagtgattctcatgcctcagccacccaagtagctgggattacaagcatgcaccaccatacccggctaatttttgtatttttagtagagatggggtttcatcatgttggccaggctggtctcaaactcctgacctcaggtgatccgcccgcctccgccttccaaagtgctgggattacaggcgtgagccaccacacccagccaacaaagaatttttaggttcccactattccaccccacctgtgctagaccctgtggtgacaacaaaggtgaaacagacatgctgactgtcattaaaacactgacaatctaaactaagaaagatgaaaaaaattaattgaatacccagtggaaagtaagaaggaatagttttaacctccttaaaatgcttttgattgcattataaactattcctgaagacttaatgatccaagatactacttgtcaatgtaggctattcgtcaatgagtggagagactggtaaattggcagttcatgtgatacatacgctttcagagtaaagagaggtttcttctaataatgagaggagcgcctggccagagagacccaggaaacatatgcaaatactagaaatagccccaagtagcaagtgtggctatagatggtacacgtgaaggagagtagtggggttagaccgtgaagccacgaagaaccaggttaaggaatttagacttttatttggtaggcagtggagagatgttgaatttttttttcaaacagtggagtacagtgaggaaggcaggagactttgcagaaggaaatcaggaattccaaccaatgtgttgagtgtaggattctaaatccagcacaaaaaaaccttcaaagcagcagggaaagggtttggctctgattcagcctcagtggttatactgttgccatcagggagctgggcttgggggtggacagaggctggtggcagagggagggatggagggacagagctgagtttttccaaagcagaagaagacggttttgcaacctagcacaccatctgggtcagatttatcaaacaagattatttgttgacagaccatggttatttcccatttaaaggaagcaatacatatattgtatccaaaatggctccccaaaagcagcgttgagctgatgcaaaagatcagtccattctcccagcaaaagagcagtctcttgacatcccaggtaggagggattcatgtatttcacaaaatgtgtccaatgcaatcatcaggcaaataatattttaatgttttcttgacatgctgagagtaaacttgcttcgatgcactgtctccttctaggcacattactctggagtaaaagaagagaggaaagagacagaggaaagaaaaaatatgtaatcacatatgaactgcaaaagaattctagctgaggttcttagaactataaattcttctttttttttttttttctgagacggattctcgctctgtcacccaggctagagtgtggagtgcaatggcgtgatctcagctcactgcaacctccacctcccaggttcaagagattctcatgcctcagcacccgtccccctcccccaccccaactagctgggattacaggcgcacaccactgcgtctggctaattttttgtatttttagtagaaatggaggtttcaccatgtcggccaggctgctctcgaactcctaacctcaggggatccgcccaccttggcctcccaaagtgctagtattataggcgtgagccaccgcacccagccaagaactgtaaattcttaaaatttgggaggaaccatcaagaaagaaagcctaagccttgtaaccatatgccaacctacattggtctactccctctgccacgctaggcatttcacactctcgtacactctgagggaaactcgagaaacaagtgtaataagaaatattcccgctagagcatggcagccataagctaccaaatttttgttataaaatagaaatatacttctagatgtaaacatgtatatgcttatatctaacctctctaggataacttttgtaagtggattttaatataactaaaactggatgctaaagaaatagccctctcttaaagttgtacttgggcacgtctaggatcaaaaagttaatagttttgtctgtgatcaaggagttaattttttgctgcaatatgtttacatctaacattcttttgagctatccacaatctggttatatatcagtttatccaaccttatttctcctttcctacttcaaagacctccattcaagccgttctccaagctcttgcctaaataagtagttttgttttgttttgttttgttgttttttggggttttttttttttttcaaattttttcctcacttctaagtttcattcagggactacctttccccacttcccctcatcattctctttttctaaaatctatccatccttcaaagcccaggttgaaatttgtcctcttcctgaaatcgccccaaaaatgtgccaaatcattcagatctctgccatctctgagtcttataaatcaaattcttagtggcattcatttgactaagaataataaatacatcactattgttataatcaccataatacctggtgctgttgttagatgctttacctatgttacctcttatccagacaatcctgtcctatcacccccattttacgtgagaagaaaccgaggttcataaaggttaaataactagtccaagttcacatagctagcaagtgacagtcataatagtggttcagacccagaaccgactggcttaaaaatccatggtccttcttctgtgccatatggcttcccaattatggatttcttttttttttttttttttttttttttttcagattgtgatttaggtttattcttttttttttatacttaaagttttaggatttcttacattactttttaacaaacgtattttgtgcatgattctaagaggtagtacactttttttttttaattgtttgcctcattttcccaccatgcctacttttcactttgctgaacccgtatagagtgtctggttaatgttagagaaattgaattgaattcctgacatttgggcccttttcttgagttcctcttctttgtccatagatgaatcatcccattacatctaactccgttggacagcttgcttcttcctcaattgtatgtgaatagttttcaatccactttactaaaatctaatagtcaccatctgtgtctgctatataaatgtgaactcttgaaaacactaacatttgtgggtcagaaattagaggacagtaaaataaaccactggaactgtgaagagggaggaggcgtgaagaggcactcccctctctgctgtctgtgggtcaacctttccggcctgcctgtttctcaaactgagtgagacttgtctctgaagccccattttttttttttttttttttttgagacggagtttcactcttgcccaggctggagtgcagtggtacaatctcggctcactgcaacctccacctcctgggttcaagtgattctcctgcctcagcctcccgagtagctgggattataggtgcacaccaccacactccactaattttttgtatttttagtaaagacggggttttgccatgttggccaggctggtctcgaactcctgacctcaggtgatccacccacttcggccccccaaagtgctaggattacagacatgagccaccacacctggcctctgaaaccccatttaattttccaaatgaaggtgatgtgtcccaggcatcatacataggcaagaacccacaaagtggcagaggagcaggagcaaaggggcctgggcaccccctggaaagtcatcatacagctttactcaactgtcaccttctcctggccttccttgaccactgtttttaattgcaaatcccactgcatgatgccctatccctcttccctgacttattcttctccataactcacattttcaaagcattctatgcatttcaccaaattgtttgtggcccttctcctcccaccagaatgtaatttcaagagagtagggatctgaggtcgggcgcagcggctcatgcctgtaatctcaacactttaggaggccaaggcggttgggtcatttgaggtcaggagttcgagaccagcctggccaacatggcaaaaccccatctctattaaaaatacaaaaattagctgggcatggtggcgggtgcctgtaatcccagctacccaggaggctgaggcaggagaatcacttgaacctgggatgtggttgcaatgagccaagatcgtgccactgcactccagcttgggtgacagagtaagactccatctcaaaaaaaaaaaaagagtagggatttgggtctgttttgtactatgctagatacccagcacccataacagtgtcagacacataggacatgtattgaatgaatgaactgatttataagcagaatatttaagactgttgagaagccatacccattctaatcaggcagagcagaaggttaaaaatccacaacgcttacttttgagttgtgttgaaaccattgaaaatatctgtgtcaaactgattaattacctcggtttacagaatcagctttttaacatacatagcaaattctatatgctagccaatggcaagccagatctcaagcaaggccattcttgtaaaataaatggacagatttttgtcttttctattgtataagattctaaagccttgaaagcagtaatatagaatctccttaaatacaaatttaagcatcttttcacgtttatggcctcagtgcctgtttataaaagtagttttgtaagaaaaacagtgtaagaaaaacatctaagagtagatgataaagacctatccttgtgtgaccttcagatggaaaagcatagatttaatctgagattccagaacccacctagtttttaacttcatttgtttgtctaacttaagaacgtgagtcacaactaacaaagaccatctggtgctgttcttccctcctaggagaatgtctccagaagtaaataaaggagaatcttgtccatgcaagctactctcagttccaatagaaaaccatttcagcatctaattcagagagttgcacaggagatggccaaaggcactatctgccatatgtctgcgtctccagcccagccatgaccccaaaccaatagatttatttttaggtagtatcatgtaaacatagaactttttaaactagcaagttggggaaacttcatgattagtcaatctgctagcacatagcagaagctggtgggtgccttcccagcagccagctcctctttctcctacctcatagcaccccagttattttcaggcatctaccctcctccacacagccaagaacttcagggaggctatttccttccccaggcccaaggagcacagcgtggaaggggaaagagagaggttcatggacggctctaccatgatgccatgtgtctgctagtaaacttctactgactgactgagcatgccccaggtgaaataccctccagtacctccttctgtttttggacttacctgttgtctttctccaacctggagactctcaacccttactgcaaattactgccacgtggggagcttttaaaaacctgcagacacccaagtgcacccaagagagcctgtttcaatggacctatgcaaacaggtttttttttttcattaagttctctgggtgattgtaatgtacagccaacaatgagaaatgttatactaattccattactttgaccctgtctttgagatgctttgggagagcttggcgctcaggaccatctttggggatcttttccatcatccagagggaagctggatcttagagtctggcctctcggttatgggtcctgatgttttttcattgtgtatggtttccatgatctgtcctctgcaataaaacagacattgctttctatatgtaattctactcatccttttggggtctctcttcgttaccatctgcccttccatcttgccatctcactcctcactcccatgattctggaccaaactaaccagcattcctaatctagtctcttcttgaaaggatttgaaacggggaagcagctcttcaggaaagaaaataaatagagcaaatgggccgggcatggtggctcacgcctgtaatcccagcactttcggaggccaaggcgggcggatcatgaggtcaggagatcgagaccatcttggccaacacggtgaaaccccgtctctactaaaaatacaaaaattagccgggcatggtggtgggcacctgtagtcccagctactcgggaggctgaggcaggagaatggcgtgaatcagggagatggagcttgcagtgagccgagatcgtgccactgctctccagcctgagcgacagagcgagaccccgtctcaaaaaaaaaaaaaaaatagagcaaatggaatgaagaacctctgtagggctgtgttgatttaaggcagatgtgggccacagttttggtgttcacacccaggtaaacaaggcagcttccttctgctcatacacgtgctcccctctggaagagccaggtttgcaacgggctcgcagtggctttctcatcctggcagcatccagtttcttgtggacgttgctgcatcccaaccacctagcagattacacgaaggagtgaaatacctaccactgaaaagaatgaacccacagagaagggtggcctcactgctcccaggggctgctgcagtggcccgtgggcagctagactggcctgcaggggactgaccctggtggacgcctgagtctatgtgccaccatctaccctgtgataagtgtagctccgacatgatgtacctttgcctgttgatttccaaggacaattattttagcatttcaaaattcagctcaagtgctggacgacttctccctgagttttgctgtttgccagcagcctcctcttggcatgctccctttccaacatcctcactgaacttgttactattaccaccatgtacttagagaatgcaactatcaagtgctattgaacacaccttgttttgtaaaaaccctgttgtaaattgcctccttattcctctgttccatggccagtcaaatcacaccctcatgtaaatagtgacaaagacatattacccaacttcaaattccagacacctgagtcacaggtgttgttaccactaccccaaaccacaaagtgggattatgtgtctcctagaaccgtattataatagacactcactgtcttgcaaattgctcctaacttgggtagaatattttgtatttattacttttgaaaatctatgggtttctattgcctggaaactcaaggattacagcagaattagagaatctggtctctggatcacagatccccccactgccctgcaccgcccccacccctttctcatggagacctaatcatctccacactggatccactcacatggatcttctgaccttgatccagagtttacaggtaaaatgtccacctgaggacactggtttctgttttgacaaaggtagttagggccttggaaagttgtgaaggaatggcatatctcccagaaccctgacttccatcagcatcttattccaggagctctgaggaaacctctaaggcacaagtgtggaaataaagaccacccagatgagaacacgcagaggctatttattcagagcttgctgtagcaagagagtcagccatcgtcacttgtgcctggcagagactctgaggcaagcggggagtgggaaagctttcaggtggagagaggggaaggctggggtgtgccggggctggagcttgttggcccgggaaagctggaggagggctgcctgacacaggaggcatcctgtgtgattggtgaggggattatatttggctccctctggttggcctaaagttggcagcagggacaaaattagggaatctggtatcaattgatcatttggggccagcttcctggaatgtctgctgcagattgtgggtcagcgtgctgttgtcgcatatggccaagctgttgtctgtctgtagattccatctcttggtgttcaataggccttggggccatgaacttgtagggagggttttctcaagacctgggttatggaaccagcattgaggttcacagaactcacatccaccctcaaatcagggctgggtcacagacagtttattcaagtgctccaggcacctgtcccagggtcattctccctagaaagacccaaacaagctgggcgcggtggctcacacctgtaatcccagcactgtgggaggccgaggcgggtggatcacaagttcaggagtttgagaccagcctgaccaacatggtgaaatggtgaaaccccatctctactaaaaatacaaaaattagccgggcatggtggcgcacacctgtaatcccagctactcaggaggttgaggcaggagaattgcttgaatctgggaggcggagcttgcagtgagccgagattgtgccactgtactccagcctaagcgacagagcaagactctgtctggaaaaaaaaaaaaaaaaaaaaaaaaggcccaaaccatcccagggaattcagttcaagccacttctccctcactgtgttctccatgctgctgcctggggctgctggccccctccctgtctgcaacggactctgacccctggaccaggacacccagcaggctccccaggaccacagattctgtctgaccttggggattctctggtgtttctgaaaattgctgaaagcttccagtggccattgctatgttatttgctagtcggctaaaaagttaaactccatttttatatggtctagattagaagagaggaagaaacactccagaggcatcagaggctcaagaaaatgcctagaatgaagttcagaccatcaagaagtccccggtggctcaggcacattcactgtttgttcattcctctgacagtcacggacagccccctgtggacaaggcatggtggcgggctggggacagtcttctactaggaggatggggaagacctgagaacagtgcaggaacagaaggaacaaatgtgcgggctgtgggtcacagtataataggaacacaggacagaggctgaagatggccccaggatttgagttacgaggccagtgctgtgctattagcaaccaaggggacctggaaaggattggaaggggaaggtcttgaggagaggctcctggtaggttttttctgatcaatagtcccaagggtcaaaaatatcaacagtgacagtcagtgctgggatcattctccctcacagatctgaacccttgagtatgttgattttaatgacagggacgttctttatccagccttatgcctgaccaactctgattcatccttcaagtgaggagatatctcttcaccctcgaagctttccctgatgcacaccccccgggccagggcctgccccagagctccccactgccaccatcacttccccagtgcaggcccttacccccgtctggcctgttgggcttattgactgaggcccccaccctccccagccagcagcatgcctgccccacaaagctatccagcaaatacagattgagacacaaatggatgaaagacatggaaggaatgtatggatggaatggagggatggagtggacacatggaatggatggatagatggagtggatggatggagtggatgggtagaatggatggatggagtggatggatggagtggacggatggagtggacagatggaatgggtggatggagtggatggatggaatggatggatggaatggatggatggaatggatcgatggagtggacggatggatgtaatggatcaatggagtggatggatggagcagacagatggagcagatggatagagtgaacagatggaatggatggatggagtggacagatggaatggatggatagatggagtggacggatagagtggagggatggagtggacagatggatggagtggacggatggagcagacgggtggagcagagggatggagtggatggatgaagtggacggatggagtggatggatggatggagtggatggatggagtggatggatggaatggatagatggagtgcacggatggatagagtggatggatggagtggatggatggagtggacggatgaagtggacggatggaatggacacatggagtggacggacggagtggacggatggaatggatggatggatggatggagtagatggagtggatggagtggacggatggagtgggtgaagtggatggagggaatggatggatggatggatggatggagtggacggatggaatggacagatggagttgatggatggaatggatggatggatggatggagtggagtggacagatggaatggacggatagaatggatggatggaatggatggacggatggagtggctggatggaatggatggatggaatggacggatggagtggatggatggaatggacggatggaattggatggagtggatggatagagtggatggatagagtagatggatggaatgaacgcatggaatgaatggatggaatggacagatggatggagtggatggatggaatggacggatgggatggatggagtggatggatggatagatggagtggacggatggaatggacagatggagtcaatggatgggatgggtggatggatggatggagtggacagatggaatggacggatggaatggatggatggaatggatggacggatggagtggatggatggaatggatggatggagtggatggatggaacagatggatggaatggatggatggatggagtggacggatggagtggatggatggagtggatggatggagtggacgcatggaatggacggatggaatggacggatggaatggatggatggagtggagggatggagtggatggagtggacggatggagtggatggatggaatggatggatgggatggatggagtggacgtatggaatggatggatggatggatggatagatggagtggacggatggaatggacagatggagttgatggatggatggatggatggaatggatggacggatggagtggatggatggaatggacggatggagtggatggatggaatggatggatggaatggatggatggaatggacggatggagtcgatggatggagtggatggatggaatggacggatggagtggatggatggagtggatggatggaatggacggatggagtggatggatggagtggacggatggattggatggatggagtggatggatggaacggacggatggattggatggatggaatggacagatggagtggatggatagaatggcctcctctttgtctaaaacccccagtagctacgaattcccccaacaactactacacactgccctgcacatgatcacgttcggtaagttgtgtgagagggcaggagggagaaaatggagctgcctgcctgcctcacgagcacctttcaccattttgatcacatttccagatgcagcaccaccctctgctctcacttctttcctcccagaccagggaagcattggatggtggttcatgaggtgctggaggagctaaagaaattgctgtcatcgttttgtcaaatccagggcctttatgttttaaaatagatatacaaagagatcacattttacctggtaaaatcatgacaaactgagcggacaaaaaaaaaaaaaaaacctataaacatttggcacaacagagcaaaaatcataattcctataattatttttaaactgtgaaactattgtagagcattgaatagatgtatattaaagccatgtatgctttatttgcttatgacatgaaattctggtttctgtgtgttccaccttcctattttattcttaggataataggatatgatgtgatgctttactcatagttagagggagaattgactgtgaatgagcagttcagagagaaaggatcttgggcttggcaagggcaggggcctccagcgttttgagaaaaatgaattgagcctcagcttattttataaaaatcttgacccagagcgtggcccttctgaactcccaccatgtttatgcatggtaatatattaaaaattggacttagctagtagccaaatacagtgctgtgttctggatactaaaacaaactaattctccctgctaagtaagaaaaatttcacacattatcgtcagtcagacatggaaagaggttctccaggggaagagagagaagcaacatcattcatgtgatttaaaattacaccaggccatccatttatctgcctctcaggctgtttgtccttttttgaacgatgcttcagggctccacgctggaaacggggagggtggatgtagaacagcttgtcaatgtaatcattttactataaatctgcaaaaaaagaaacagagcctaaaccaagtataaaataggatcacagaacctcctatgagcaactttgtaagattatcctttctagtgtgagtactaccacaataaacatgatgacatatcctttatcactatgttgcccaaagattttttttcagatttcagtggactcctcccctgccactcttaacagccctgctcctccaaacatagctgtatggagagagatgtccatcacagggatgtttatacaaaaacatcaaaacactcattttttcaggctggaaacggtggctcacccccgtaatcccaacactttgggaggacaaggtaggtggatcacctgaggtcaggagttcgagaccagcctggccgacatggcaaaaccccgtctctactaaaaatacaaaaattagccaggcatggtggcacacgcctgtaatcccagctactcgggaggctgaggtgggagaatcacttgaacctgggaggcagaggttgcggtgagccgagattgcgcgactgtgctccatcctgggtgacagatcagattccatctcaggaaaggaaaaaaaaaacactcattttttaggtgaagttaattgactgggaggactttatggaacattttggttcttttcctactgctgaaatttgaatagaaaggcatgaggtaacctcatgccatcactacgaaaggctaccagaaatgatagaaaacctcacacagtatcagctacattggtggagtccacctgaatcccagaaattcagttcaacaatgtcactgagttcaccagactactgggaaagggattcatgtagagacagttgtaaaaatattgaccctaacagagaaagattcactgcagtcagaagagatgccacgaagtcaggtctcaactcctggagaggctctttctgtgctgtgcaaaaatgtatgtttatccgacttcccaggccttgaggtacagcaaggaatgccagtgttggatgttctacaagtgaggacactggagcctcaagaaataatctgacttgcacaactcctgtcactgattagtggctaaggacatcctgatttctgctccagaactttccccatgacatcagtcttcccatccttgaagagttttcagttattcttagcgtgacaagtgattgctagagtttgtgtaattttcatcataatgggactaatgacccacaacagcagttctagtgacttccagaagatgttgtacatccccatcctaatgaatggcagcagcatgacttacgttcttttatcagagagtctagtttgatctgagttgtgtctgacctggaattcaggcatgtctggggctaggaaggttttgggttcgaggaggctgttttcatgagggatcccagggtctcttgggaaggaattcactcaagggaggacagaggcaagagaagcacagttcactctcggggctgaaggcagcatgggttttaggtgcagcctggtgacagtcaatcgggtggcctaccatgtagtgattaagactttggaaaagcaggctataagcaaaaatctaaatttgctacacaataacttggcaagacaatggagcagtggctggcaccatggaccttggtaagaaacactagaaaagttaggaaaaggggtttttccaggtcagagagagccagtgcatgctggtggacccacagttctgtagctatgagaaatagccccatctggttgtgcaggaaccacaggctgcactagctgctttagttgtgaccgcagaaagcaccctgccccagcatggagcaccagggcctgcacacctttgccaggccccagaagcactgccactgccatgatacccaagaagagagagattagcaagtgctttgtaccagaggggagggctgcccatgcaaaggcctgcctgggggaactccagcaatcattgggggagactttgggagagtggagagaaggggcctcctgaaaagacacagccaggggaaacctactttcatgatatcaagactctaattttagagggcagtgtttgcagatcctaccaatgactctttgtccttgagtctgtgtttgaggtggaaccactcaaagacggggaagatgaggcacctggagccaggcgcctggtctttgtgtctgcacttagccaaattccctctcagctgtattgtgtctggaggaaatagaagcatgactaagctgatttgtattctgccaaccaagggaaaatataattaacacggcagcaagactcagcaaaccccatgggaaagtccaagaaggaaagagctcccgtggctcaagatgatgtcagaggcaaagagaggccaacccactctaatcccacagcaggtctcctctctaatacctcaactcataaagggaaaagacaatgaaatccaggcctgccatgcctttgaaaagaacacacagcctctaggagtgattgcagggattgagcagactgtgatgggggttttctcatgatgggagtctcctgctgttgctgagtgctgccaatcactgcccacacctccagcagggaggtgacttcctcaggctctgctactccacatcaactgattaacgcagctgtgatagcacacctagcagagacaagagactcccagacactaggcaggagtgagaccaactgctgtatcagatatacacctagcttataattacgtgtcaagagaaggaagattaggcagacatcagtaaccgcaagaactgaaatgtgatggctggtatccatcttcagcctgctccccagctaatcatcccctaaaagaaatgcgggagaaagctgcctcctaatacatttcattggcccttcatctccgtctgctgactcacatttgaatttagagacaatttgctaaactttctagatttttatttacttaacattgccttagcctttttgatatattcaactatagtattctccaggtttaaatattgtacgttttttttcacaactttaacaaattagtgctcagttctcctggcttgaaattcccatatctttcatgaagctgttgaaactaaaaggcttaggaggaaggtcacccacctccctcattctccttcccttcttgcccagaggaatttatgtctgtcttcctgccccaatatctacatatccagccatgactacattgtttggtttaagtaactgcctctcattacagaactagattcatttattcattcattctacaaaaacttgaagaacatttatgctggatttgaatccagtgtcagaattgtctttgattggttctatcttatttcatagatttggggtttgaatttaatagctaagcatataaatataattttatgcaagatagcaccttaattctagtccttatttaatacaaatagtgatataatgaaatgatatagttttatctagtttcatctagagaaatatggaaggaaaaatacaaatagttaaaaaaaggaggaaggctgaaaatatatagcagttgatatgcttctcagagtcatcttttactaatcagtagcagtggtgatggtcttttaaaaaaaaaaagtttcggttgcttttaaaaagagatttccagtgggaagcctgtgagtactgactggctcctgtctaacctacacttcctgtttggttgatgaaaaagaaaaaaaaaaaagccaaaactaaaaggtacattccagaacaagtagtcattttaacaactggcggagccaagaaaatgcgatctagtttccctctgtcccccagtctagagccattattaaataatttaatgccatagaacttatatcaaaaatagacacattccttaggaaacatttgaaacttactggttttgaccttaaaatgtaatcattcatgaagagatcaatctttcatatgttttcaaatatgaaacactcaagtccattgtcagaatcccaatagtgtggaaagaaacctaccagggcaggcttatctctgctcattctttgctaaaatatccattgcatttgctaactgtgaaacgatgggtaggttacttcacttctctgagcattgaagatgccctgtctacaaaggataacagtctctctcccaggggtagctgtaattgtgaaattaggcaacatatataggaaggtgcctaatggagtggcaatcatttattcattcattcccgaaatatttatcgattggccacaatgcccaggcacagagcaaggtgctagtgatatcaacacgggggacacttcacatttccccccattcctccctaacggtgcagcagacaccccactaaagctgaggaggcccctgctgctccccctccctctctgctccctgagtctgtgagaggcatcgctccagcctcccaagaaagccctccccctgcacatccaagcagctccctcttatcctgatgccctgacccgcctgcccacaaggagcctcctccctgagccgggaggactttccttctctcctatgacaagccctggccctaggcagctgaaaacaatcacccaggaagctccttcaccgtcagattccctgacagccctggatctagcgagaatcaggtgatttcgatgtgaaacgaggtttgggaaccactgctttcagtcacattctttttgtttgatcttctcagaatcagcaggcatttccctctgctactttgtccaagatccaacccttctcatctgcgtcttgccagtctctccactttagagctttgttaccagctacttctaacctcttgcacagaaatctctactcaccactgtggagagtgaaaaaggaatgggtttttatgtatttctagccagctcttggccctgcgccatgcagagtatatgctgtacattggactttcgggacacttctctgttaaattctaagccttatgtctgtggtgtctccacagtgagtaagctcttaatcacattccctattgtaccttcttagatgaaagagcaatgggtcagggggactttttaaatgtccttaaacttgattagtttaatctttattatggctacagaatgtttcttaaatttacatacgataaaatccactattttatattaagtagagttatgagttttgacaaacaaatatattcaggtagccaccaccataatcaacacacaaagcaatccattacccccagatttcccttacatcctttgttgtccccctcatcctgtacttccagcccctgagagccacttatctgatttctgtcccgacagtttgccttttccacaatgtcatgttatataaatggagacatacaatatgctgatgtgagcatttagaaagatcatgtatttaaacaattattagagtaagggctggctatggtgacttaattttttggtttctgacacctataatctgatttgaagtgtgtcattctgtgcatcatgatcctttttgcagaacctgtgtctattagaaaatccagatgaagcaggctcttcctgttgtccttcatttggaaaagacagaagaacagagcgctttacgaaagtcaagttacagcttcctaattttctctcccatggacaaactcttccctccccccaccccgacctagcctcttacccactatcctttgcaaattcctatctcttatattgcccagtaattggggcgtgggggggtgaggggggggtgagttactgctgatgaaccaggaggcagagcaaggtttattttgctaaaggcttcagctgctactgcctggacctcaataagcattttctgctctttcctatcactactgtcttccctttctttgagaagcaacataaagataaaaagaaaaatacttgattttgtagcatgccagaatattaagatgctcctgaaaagtgtgggatttaaggcttctcaaaaaagagcagaggagggagtgagagaagaagacggagaaggaggagaaggggaagagaaaggggaggtggaagaagaaaaaaccaccatcagaaactgagtattacacaggacgtaacctgtgctctgagagtgaaggaggccacacagcagtagaaccccgacaggaaaatcagaaaacattatattttttcccagatcccagagtatcagatgttccattcagaaataatccctattgacccagtctctgtgtctctctctctgccaatagcatcaagcacagtaaccctttccatgctaatcccgttattaatgccatccacaacaagcgtagtgtaagtaagacacgaagtgtaaaaaaactttcttccccgcagtccgggctctcagagccctccttgtaggtcaacagtatcaaaggtgcttaacgcagatacaccaggaggctcaaagcccaaacatcgaaaaaaaaaaaaagacccactcttgtgctgtgtgtattgcccacgggtgggaggatgcaagtacaattacgttttttaaaactccagtccagatattggcttttccttggatacttttgtgtggctctcccagtacagtcagatccgccgccgcagcctagcgctccaccccgggttttgcgtcctcccctcacctgcctttcagtggtgcggggtttgatcccgagagcggtggactcaaagctgcccgccgggactcgggctgccggccgacaaaggacggtcctcgggggttctgaagtctgacccggccagtgggaaagccacctgcatcacaaagcgaggggcacacctgaaccggggctggcgggaagaggcaagtattgcgcgcgggctggctcccacatggagctgcctcccggtgcaagtgttgcaagggtgcgctgctccagcccggggagcgcgggaggcggcggagagagcgtccgggtgatgagcggggcactgtaactggattttaacacctctgcaagcagcgcttttggtcaaaaaatttccgattcttgatcttctctctgcaaggtcgggggttctttggggagtaaatcacagcgtttgggtttgcattcgaagcactaccaagtctactccacagggtcactgcacggggagcaagtaaaggaaaacgaggagaatctgagagtgctccttcgtgcagtgtgtgtgtgtgtgtgtgtgtgtgtgtgtgtgtgtaggcaaagctgagatttacatggtgtgaactgttaaatgttaacagttaaatcccacacttttcaggagcatcttaatattctggcatgctataaaatttttgagacttgtttaaagaaggggacttcctttttaatttagaacaaattagtagttgttataacattatagatactaatcagtaacaatactagtaggtaatgctttctgtaagtagacacaccccaaaagtatctgaaaagtatcaccaaaacggagcgtgctttcacactcctgcaaaacaaattagcccttaaacagaataattaacatcccgagggaagataaagcatataggttccttgaatcattacgttacatttaaagtcggtcctgttcagtttgcctttgtccctaaggagtaaaaatagcatcaaattgcttgtttggttttccccttttgaaactcagcatagtgtttggttatccatgaaggtggctttaatatttcaccctcatatttggcagacagttctggacttgctcctctccccgtagggactgagtcccactggcagtgtgtggagaatagaattgattctcgctttttctttgcataatacctaatcatcaccattagcacttcagacgttcacagctttctgaataggtgtcatttcttccacataccctattgatttgcatcattaacaattgaaaggaagctcttcttttgattaagaagccaaacaattaggaaagcgtggattctttcatagtatttattgagaggcgtctccacctgatctaggctgtgtttaatgggatgagagagactaagagagaacagaaagtgtaattaccgcctctccaggcccgtctttactttttccagaaacagagaattatgaaattatttgtaatgttacaaggacccttggagctcttctagtgcaagtcaagtttatttcacaaacgggaggtctagacagcctttgtttcttctgaacgggtctgcaaggccaagatctggattctgacccacagcgactgctgatccaggaattccatgcacatatgctatgcacttagcgctgattgtgaagaaacaccaaggtggcccgtcaagacctgaactaccacaggtctaacttgggaaagcctcattcctcacgttctttccgcttctactgtaatggtactgtgcctcttgccagcccacacttattcatttgaaatgtgcactttggaagttcactgcatttaatcgattcagaggatttcttttttttttaattttttttttaatcagtagctgagctatactacctagttctaatccgtaatagtgtgttaaaagactgttttctgtgtagttgctggctgttatttaaatcccaaggctgctgaaagttggtaatagaaccaataatagcaaccattactcaaaagtctattgcttactattaactataataattaactattaagtattgatattgtccccatcaatttttaggcgttacctaacattatccccattttacagatcagaaaacggaggcttcagaaaggtgaagttactagcccaatgtcactcaccttctaaggtggggagcagaagccaggttggtctgacccctaagctcatggtctttctatactaccttagtagtatagaaatgttctaactttcacattcccggatgtctgagctcaagacaaattttaaataaattagcgtggctttgatgttctctcactagtgaaagggtctataacactttaggcaaaatgcattgaaattatgttaaaccttcatacactgccaataagcaatgacttcccagaaaccatactccacatttgacccagtctctaatttagtgagaaggtgagatgcatggaaagaaggcaaaggagagtgactagtgacccccagaaaagggaatctcttcccgaggtttgtgttgtgccctgtggagctgagaggagagtagggaattgatggagcagaggcttagccaacgcatctgaaagagaagagtgttttatgtctttaatttcttcttgtcagaatcaaccaagcccagagctatttacgtgttgagaagggtctcccatggagaggccttcccagtggcccttctactctctgctgcggtggtttatcatgtcttcaaaacagactcgccaccaggcttccaacaggataatacaaatgtgaaatttttgtcctcaataaagagtcagaaatgatgaccattctgccactttcatcattttaaaatctgtattcctgaaaactggcctcgaatttatttctgtatagtccaaggtattgatttgaaagtgagaggctagcatgaaagccaacacttctcaactttaaaaaaaaatgccttaatatttagtattttctcattctaatgtatcctgtaagtgttctttctgtacttcttgttaaggcatggctgtgtaaacttcagagggttttgggaacagcctccattgtcatccacttttcattctaaaatcttggtatatctgtgcatacatgcacaaggcctcccatgattgcactgcttttacgaataatcatagtcaaaattcattttttaatactgctagctcaatttttatttcttattcctttgaaattgatcatcatttggacagggactgcattaaagctcaacactgaccttcattgtggccacaggaagaaaagatctgctaaatgaacaaatactgtgatcgatattgtgcaatggcttgagggaaaaaggaggttttaaccacttaaagtaagcccttttagaaacaaaaactatttcagtgaaaatgctaatcctacacctctccaaagtaaatgtgcttagaggacaccagccagagtttctttacaatgggaagttgccttccaacaagaaagggttttcaaagtgcagaagaaaactttatctggaaaaggtgagaagcagagagcctccaggctccagccccacacactctcatcttcaattaatactccacaaagggaaagttccattgtgggccacagcactccctgcttgagaacctgtagggacttaaccgctgggtttatccaatgaagtgtctgaggtccccgctgtttagcttggccctccactctctgttcccaatttcgtaaccactacctcagccagtctccccagcagagcacttttatcttatagccatgaggcatctgtgacatgtcccacaacacatcacaaactctatttgtcctccaatgctcagtgaccttattttcccaggcaaaagtggctcccgtcccggtgcccactaagccttgataccagcccacagtacagtgcttctcagactaggtcgtctcagcatttgtcaatgtattttatttatgtttcgacgtccagtctgttcatcttcagtacaggactgggtcatactcatctttccatcctttcccttgtccaccttcctttcttcgatttgaatattttctgtagttgctccattaatcagtaattaattaattgcagaaatgtatttcccaagatgtagataagtcacacctcagaatgctacaaacatttgtagatgtgactgatcagtaattgtcaggagactttgtcaatctggagaggtgctgaaaaacagagacaagaaaatgtcaactttcaaaaatactcatttaaaaaagtagtttccaagaaaagcgtagactggcaaaaggatgattgacaaaattctggactagattactaaataggtgatatgtgagaatttagaggagaatcgtgtgatttgcataatccaacatgagttccccggaatcaagccatcccatgtgaaccatatatctcttttatatataggttctgaaactggtgaaatggggaccacttgaggttagagattcgtaattcagtgttgcctctgatcagcctggaattgtagtttatatgccagcaactgcatgtagcctgagggctcccatgactgggctacagccaattgatcacaatctaatgatacccctaggagtgccttgggtgagagcgttgtccggggcaaaccttatgaaactttgtcagatggtcttcacacagcatttcttgattttagcagagcctttgactcagtctctcctagcagattttttcacttactccacagatatttatttaggtgtttattcagtgtcaagcattgtattaggtgttcagtgtttgtggctcagaagcaaattctgacttagttgataatatggagagcaaaaccgagtcaaaaattgattgcctgaaattatctttggaactgcaggaagtcaatcgattgatgaattcatgtgtgtccgggtctctggggtacactgtgtgctcccccattcactccagtccctgctcagagtccttctccaatcacctcctctataaaagcaccttgccccatcatttcctattccctcatgctgttttatttttcatctttgcacattttattctctgcaatgatcttattcacacaagcagtcctgtagttgcctgctctctgcccccttgcttggaatgtggtatgaatctagggaggcatttcacagggctgggtcttttgttccttgccgtccattcaatatgtctatcagtgacaattgttgtcattcctgctaatctaatttgcagatgatagaaagtgaggaggcagagctggcatggtaaataaggggatcaaaatgtacatcagcagcatatgtgaaagcactttgataattgaagaattataattaaatgcaagttatcattttttaagtgcgtataaatctaagccaaaaccaataaaatgaaagtatcaaggttaaatataagctcatgcatttaggttcaaaaaatcaattacacaaattcaaaataaaggagacctaagagggcagcacagtccatgccgcgatttagccatgagctgggcgactctagggctgcaacacagtccccgagtggtggagccatggctggaaattcttcgaatgttatcagttaggagggccacatggtgaggtggacattaccaagcccgagtgtggccagtggagggtcactcagaacagcagcaggaattgggacgtttagcctgaaggagaggggacttagggaggtggggacccatctttaactctctgcggggttcacatggaggagacgggcatgtgtgtgctgagtgctaagttagaacctctgggtcctggggggcagactttcattcaaggtacggagaatgatgggagcccagggccagaagcctataacccacagcatctggacgaatactgagcgctgtcactagattctatttttatttgtttgtttgtttgtttgtttattttttgagacagagccttgctctgtcacccaggctggagtacagtgacgcaatctcagctcactgcaacctctgcctcccaggttcaagcaattctcctgcctcagcctcctgagtagctgggactacaggcacccgccaccatgcccgactcattttttgtatttttactattttactctactattttagaagagatggggtttcgctatgttggccaggctggtctcgaacccctgacctcgtgattcgcccatctcggcctcccaaagtgctgggattacaggcgtgagccaccgtgcccggccgtcactagatatttaaagagaaactggacaactgtggggcagaggccagctcttaagagggatcctggctttgggttggatcttcaattgtctttgttctttgtctttccaagtctaacattcttatctgttctaaacttccgtatttttatttgttctgactgatttttttttcttggtgtgacatttgatgtaaatagtacttagcaggcttagcaactcctatatgaaagtgctttgaaatttgctgggctttggaatctctgttgtttttgcccattaagtaattccctcccatccctcttcaatgttcccctttccctatcaaccagccctttctgcaggttggagtttgatagacttggcacttggcacaccccctgagcgccagtgtcaccctctgcgttgtgaatttatagatggagaccccttcatccttttacagtcgtgctctgatcctggggtccctgaggtccagagcagaacctgaactctgagtatcaggcaagcgcatcttacttcaaaaaatgggaagaacaatttaaaaatgcaacttggatatgtttttataagatattcccgctttctgttttctacacttatttagcattttaacattttcagaatacgtgaaaattagatttagtttcttttttaaatgtgaaatataagaaaattatgattacccgtaacacatttgtgattaaaagtacattttttaggaaaaaagtattgtttccagggaacaattttctattaagttggtgcagtaatgattgcgatttttgccattgaaagtaatgcttaggccgggtgcggtggctcatgcctttaatcccagcactttgggaggccaaggcaggcggatcacctgaggtcaggagttcgagaccagcccggccaacatggtgaaaccccatctctactaaaaatacaaaaattagccaggtgtggtggcaggcacctataatcccagctacctgggaggctgaggcaggagaattgcttgaacctgggaggcggaggttgcagttagccaagaccgagccattgcactccagcctgggcaacaagagtgaaactccatctttaaaaaaaaaaaaaaaaaaaaaaaaattaatggttaaaaccacaattacttttgcaccaacct

SEQ ID NO: 386 - DNA, 64464 bp, Homo sapiens
attttctcgagccgcctgtttcgggtgccgccatgttggtgaggagaaatcaccgttacggccactgtccaaatccccgcgtcgctgcacgccgcccgcccgctcccacgccacagccaccggcggcgaatagagactagagcggcagcgccggcagcgcggggccgttgcccagtgtttgcagttagagccccatctctctggcgtggttgttaatagactggaaagtctgtgtctgtgtcgctcactagtaaccgtgagtttttaccacttcgtcacctgtcggcggcggccgggagcaggttcccgcaggcggcgcggggggtcttccccgcgccccgccgccgccggcctcgcagacctgccctccagccccgccccgttcttgaccaaacatgacagactctgaacatgcagggcacgacaggtcgggaacccttcttgtctgtctttctgtcggatgagaggaggggtctggggcggcgggagcgggccggggccgggcgcctcctgcatgacctagacgtctctgtgtggctccgtcagttccatgacgcgcactcttatgtaaactgctggatcgcggccgcgggggaggtcggcccggccgcgcccgcctccccgagccggggtcgctgctcgccagcgccggccccgcccccggccgggcacgtgcgagccccccgccccccgggcgggctccgtgtgcgccgggcggctctcagcgtcccggctcggtgctgaggtcctgcttctgcccgtccaggtgtcggtgctcccggccagataggaccagccaggaattttcaggaatgggtgttttgatatttgactgcttcccgagaaccgagaacacctctaaaaaaataaacatttggttttcagggaagttttaagcagcaccaaaaggccatctgttgtatacagtcttatcccttggaatttgagatggcaagtttcaagtttaatatgttaacacaaaatacttaggctttgcagaaacttagtttagcacagttttaccctaacgtaaaaactccatggattattccggctagcccaattttctagatggtgtgtatcacttgaatattgagattctgattttttattttttgctctgtgccttaagaggcacattcttgtttccattcgagtttggggacatttacaaagtatactgtagcatacttaaattttggttataattcaaattttcattcgtatatatctttaataatgcgaaaggggggctttcattcattaaacttactgaaacaaaatccattgcatctgattcttacttagaatattaatttgaaaatctagaacctcacaattactcctttgtgaatagaagtaagaaaaaatatacgttttactatagactatatacattgctgaagttttatctgtagtaatgtgatcggcttggtaaagcatcctaaacacgttttttaaaacccagaagcaaaaatcacaaacactgctgaaatttgaaatatctaaatacctagcaatcttgagagggataaaaatggtatttcaacaacttcagtattgtaataataaaagtagattcccagagggcacgtcaatcaaagtgtaaaaatttttggaaagtaaaatgcacttttaaaaatgataagcttgcacttggcacatttttaatgatttttttaacgttatcttttgtattaaaaaggaaattcttagaatgggttgactaataccttgctcttgaggtatggacaaaccaatgatggggttttgctaatggagcctaaaatcctttttttttttaatatggaagaatatctgttcccctctcttagtgcacaaagtaacttctatatatggagttatgtattgtacatcatgaaaaaacaatgccatcaaattcaagtatcaaaataattttgctggtaaggaactgtgatgacagaccttttaaagaatttgaaattttaaaatactggtttagaggttagaaaactttaaagaattatttgtaagatatgttaataggttggtagtaggagctaaagattaagattagtctattttatttaaaattcggactaaaagtattttctagtgatttctgaaacaaaaaggttagctccactttaacttagccaattgttaagtggcatcattgtgctgagatgaaggagatggtttttttttttcatgctttttttgtcaacccacatgaaaaacaaaacaactacatcaaaaacaaagtgaactagaagtcaggagaaattctacaagatcagatcaatggttctaaaccttccctggggaactttttttctttaaagtattggcgctatttctgttggtctggacctcagcctgggttttaagagttctaaaagctccccaggaaattctaatatgtgccaaattgagaaccgctatactcgatcagtgtttcccaatgatagttaatcatcagaatcactttggggaataaatttttgttctgcccagagcaactgaatcagaatctctagggtatttttcataggctccctgggaaattcttaagaaatttggggaaaaaatggactaatctgcgggcttccaaaatactgtatctttccatataatagctattttatgctgttataaaagtttctgtgaattaagtggagaaaaatatatgaaacttggtatatggagctaggctttgtctcaaggattttattttatttattttatttttttgagacggagtctcgctctgtcgcccaggctggagtgcagtggcactgtctcagctcactgcaagctccacttcccgccttcacaccattctcctgcctcagcctcctgagtagctgggattacaggcacccgccaccacacctggctaattttttgtatttttagtagagaccacgtttcatcatgttggacaggctggtcttgaactcctgacctcaagtgatccaccagccttggcctcccaaagttttgggattacaggggtgagccactgtgcccagccaaggatattctttttataacattttcaaaaattaaggcatattgtgtatgcaggaaaaaaaatgaagcctatgatttatatttacaattgctttgattttatacaaattaaaatattactgtttatgagaatgagattctaaatgtaaatggaattcacagaatgcataatttttttctcgtttaaagaaatagagtctcgctatatgcctaggctggtcttgaactcctgggctccagccatcctcccatttcagcctcccagagtgttgggattacaggcgtgagccaccacgcctggccttgtacatgttatatagtgaacattttgcacaagattgtttgccaaatgaataatttaaaaaaaatccatttagtgtactttcctttaaatattttcacacctggagttaaaacattgtattttataagatgttattaatataaaaatacttctaattctacttgtggctatgtagaatgtagtagaggacttttgcataagcccagagcctagtttctaaaggtctttagggatttagggaaatcagagggaggtataattctggtctctcgtcgttcagttctttttcattcagttctctcaggcacgactccagccgctcagttttatatttcaactggatgttgacccaattaaaacaattcacaactcctgaagacgaaatactatgagtccctgctttggacacatctgtagtagagtaggaaaagataaatataacccaagtaattgttacagaattttctgaaatatactaatggtaaaaggttttgtagggcttgtactggggaaaaagataattttttagcatgaaccttttaagagcttgtgagtctcaaagagtctttaactgataggtgatatggataatactcccctttgggaggaggtttataatacataaacaacctccccacccttccctcgcagctttctgtcctgtactacaagaacaacaaaactccaactagtcagaattgcaagtggtttatggccccccatatagattgaaaacttgctaagagactgcactggagaacctgaaaggatgaggatggaaaagatgattatacttttcatttgcaacagggctttcatttgattctcacattaatcccatgtggtagttaattaaggtagcattacaaggttcagtgaattgtctgagatctcataaatacaacctagataagaacccaggtattattattttcagtcttgcaatattattttcctacttgcaatattatcttcactcttcattaagtttgcacagcaaagtaatggaataagttctgggctttaatccttgagtagtttggaattgtaatgtgctacatttgagagagagcccttcattttgaataaaaccttggtactgatcctgatcttctaacttgggttaatgctcttccccttttcattatttttttcatttgtgaaatgaagtagttgcactagatcattttcaattttccttcccacttaaatcaattttaattaaaaaaattgcagatgccttttctcagattagagtacactttttgctccacacaatatctggtttgtaaattagtatgttccgtggagtaaataactttcctgactagccattaacttacttctgattcctgaatccactaatttaactattgttgaaattactaaaggaaatttttctttagcaaatgtaaaacctcgtatcaggtctcaggtttgatgttgtaaagcactctgactctcaggaagactctttttttcccccaacctctcataaacaaatatttcattcattataaaatttcattcattacattttcattcctcagacttaacagtgtttcgtctctgctaagtatagtgttaagcactgacaaaagaactctggacacaacatcatgaacttgctctctgggatcttataatctagttgcagaaacagattggtaaatacatagtatagcacaagtactataatggaggcctgaactgagtgctgtgggggtacacagatgaaggcttctgggagacatcatggcataactagacctggaggatgaataaaactttggccaagtaaatacagagatacacgaaaagcatggataaatggcacaagtaggttcagggatgataaaagtgttagtatgtggagagtgtacaactattttggggaatggggaaacggattaaatttggggccagaccctgaaggatgtggggatcccatcaaagtcttttaagcaggagaatgatcagatgcattttttggtatactacctgggggataggaggaaatggactacagaaggggagatcagtagaaggaagacaagttaggaagcttttcagtcattttcattaaacatgaagcttaatatgtattgttctaggatcaggaatacagcaataaagaaaaaacttggtgtaatgaaacatattttcttgggagagacagaaaataaacatgaaaaacagatgtgttcaatggtgataaagcagaaagggagatggggagtcaagtggatgtggggagggtgtttagggaagcacttatgaaagagtaacatttgagcaaagagccctgatacaagacaacaattcagacccaagacatttgaggaaagagcatccatataaagggagtgggaggtagagaaagcctggaccaggaatgagcctggtatgattgaggaaaacacaagggatttcactcttgagtgacctgggagctaatgggggattaaacagaggagggacaggatcctctatggtatatggtaagtgagtagtatggtaaatgaggtaaatgaatagtaaaaggaactgctgtggtaatttaggtaacagatgatgatggtttaggtgaaaatggttggattgtggatatggtttgattggttttagaaccaataggatttactggtggctggatgtggacaatgagagaatagaatgaaccaaagctattgtaaacgtctagaaatcagatgaggacttgaccaaaggcattggcaatgagaaagtaggcacaattcatgaggtatttcttagcattgatagagttggatataaatatctggaatttttagctgattgaaatgttagttgaaatgaatgataccactcaaggtatgtgtgtcaagaggtatggagaagagcacagaagtttttggaaaccaagggaggagaaaagaagggatagtcacagagcagtaaagaaaaataaaggttaaaaataggtcacaggatgtacattatcctaagttaaaatattttaaggtttgaatgaaagggtgctgcagggtttgcaaactggtgggcttcaggcctaaaatctgcctatactgttgtttttgcctgacagaatatcttaaaatatctgtatttgaaagcatttaaggcttgacttgtgctctacactccacagtcttatcattcatagtttcttggcaaactcaccactcaaggtgtgcctcacttatttaggagatctgcctcactagggtagacattttaggtttatgactcttaagttttcacctggacagattggctaccaaaaagaacctcacaggtgggtgaccttgaattcaccaggtcatgccatcagttcagagcggccggagaactctgttctcttgtgcattgatgcccccggagttgtgaaacacagtggccctgctttagtttttttagatttagaaactgatcagtgtcagagcgatcagacacaggaatgttaattcatgttcaaaaataataaccaggctagcatttgtttagcacttgctatgtgacaggtactgttttaagtgctttacatgaattgtttaatcctcacaacaaccctgggaaataggtcctattattaggcaccctttctacagatgaggaaacagacaacagattggtaagtttcccaagatcacaaagtaagtcagtgggaactcaaagtaacctgactccagagcccactctcttatctaagcatatacattcccatcacaagagaacgccagtttattcaagtaaaataaggactagaaatttacatcaagaaatatattctttcaatgtagaatgctgaatggaaaaccaaatttcaatagttgcctactgaacaagatcatgagataacaacaagggagttgattataaatgactagaagttttaaatggcatcggcgctgataaagtgataatctcagctccatgatatacttgtcaagcagttacttacatcaatctgccttctaggatatcctttctcctggttgatgcttatatgatagtgttttgtacctttcctttttcactgcttccattgctgaccaaactactcacctccatatttctggtagatatattttttctcattgcatgttagtatcttaaatttagtcctatcttttgcttgatcctctgggcttgacttcctaatctatgttctggtttatgttttagtttgacagttgagctttctgaggacattcttattcccagtatctttttttgggtggttgggttctgggaggtggtatttgactgctgctgatgtgtaccaaccaagacagtagtcattaagtgactaacaataatgatttcagcagattattattactcttggcaaaaagcaagctttctctattataaatgattttatatttgttttgtttttctttatttgtaatttgagttctagcttaacattaatacttcagataactgttaatacactttcataaatcatacccacattcttgaatggcaaataaataaataatcaagttccgagtagtttctaaagagagtaaacattaaaagtaaacataaaactacataaaaatcaatcacagtctatttataaagttggtatgaaaacaaagatcctagatttggaacactcatgatactcaatattttacatatatcagagtttgtaatttccataacttcatttggtagttagacatatagacagagaagatattaatatattcattttatagtttaggaaacagacttggaagggcaaataacttgtctaagatgactaagcagctgagtgagaaccacagcctatctgtggcattcagtctcagccatctttcccttgcttcataaggatcgttactctggtatcagttgctggactgggattttgggcatttataaatgtttttattttggatatcactgaatcacagacaatttcatcttagttaaaaattcatctgacgtgacacttgtctaaatcttaaaatattaaattttaatgtataaggatgttaataatctttatattttaagagactatgaagtcaagtctggctaacttagatctggaagtttttagctgtggaaagcaattctattgtgtacaggtttcagcctgtgaagggaattcattgaaaatgcatagagatcagaagaactaacacctttcttgcatggatttttcttgattattggcagttaacaataaaatgttattagatcactggtgcttctgtgtggggttgagttttttatgatatctcctgttagacccataagggaggctgtgagttgttttctacatccttggactatataagatcctcttttaaaattatattttatataagcacatgaaaatggaatgaaataatgagttgacataggaattacctacatattttggctgtacatttagtgcacaaaatatcccttttttgaatgccaaatggccaagtgtgaaaaccaatatttgttaaagctggagcagaagtcggtatcatcatcatagagtaaacttctggcatatgtgaagatatgaaatgttatccctgaagttattataatttattctcagaaatattagtaatcttattttaagagtaggacattatagtgcagtaatgataattttctcagtgctgcctgttgctagattgttcctatgattgctgtcatgcacatacagacactaaattgagggtcactttccactgaagttagtggaatacaaaataggtggaggaactttcttcctctaacgtctttatatgtgtctgtgtttatatgtgtgtgtatacaaatatgtatacacatacataatatctggagcaaaaatgattatgttgtacagaacttttggaggttttcctccttataaaattctgaagtggtagagttaacattctgcttttaatttatctccaaaaaaatgtgaagaattcccaaataagattttctcatagaagattcatggattttgagtctgagaaaaaaaaggaagaaaaaaaattcatggtataaaataactaaaaattaaatatagtctttagaaatgattttgtttagtataattaatactggtatgacaactgaatgcaattgaaattatgatataaaatttctattctgctttgtatttttcgttaaagtttttataattgtcatctgaaaaaggatttaatattcttcttaaattcattagctaactctctcaatattattacactattatttgcctatttgaaaattgttactttctttcgtacataaatagcattcataatcattgtgacattttcttcttgcattaatgtacatttatacttcatctaattgagaaaattttaacatacaaagtgacacaaaaagattttcattccaagttttatgtaaaacacctcaaattggaaaatgaatattcagatactgagtaaatttttttttttttttgagatggcatctaactctgtcacccaggctggagtgcagtggtgggatcttggctcactgtaacctctgcctcccgggttcaaattattcccctcccttagcctcctgagtagctgggactacaggcccacaacgccacgcccggctaatttttgtattttttggtagagacggggtttcaccatgttggccaggctggtctccaactcccaacctcaagggatctgctggcctcagtcttccaaagtgctggaattacaggtgtgagccactgcacctaaatgacatacttgaaaaaatattctcgggccgtgtgtggtggctcacgcctgtaatctcagcactgtggaaggttgagggtggatcacctgaggtcaggagttcaagaccagcctggctaacatggtgaaaccccatctctactaaaaatacaaaaattagctgggtgtggtggcatgcgcctgtaatcccagctacttgggaggctgaggcaggagaactgcttgaatccaggaggcggaggctgcagtgagcagagattgccccactgcactccagcctgggcgacagagcgagtctccgtctcaaaaaaaaaaaaattctcactttctgttgttgttgtttgtttaatgattaatagatgatttatttaagcaagaatacatagtcatcattgccagacttaatatgacaggttaaatgttggacccaattttccttcccagataagtttttctttcctatccatgtcagttttaaaaacataataccagaagaagaggggcccaattccacacagagctcccaagagtgagtttttaggagtgggtctgaaattaggaaagacacttgctgatcttgcataggtccagggaatcaaggcaggattttcgatgagccctcggcagttagggtaagcaggtttcagccaggctcttaatggtcaaccacttggcttgcgcccgctgggtttccaaaaatatgtcctgttcggctgggttgagggcatagtggccaggggcgaaggagtatactttgggaacgacatcttggcgacccagcgcataactcacttttttttggaaacaaggttggctctgtcttccagactggagtgcagtggcgcaatctcggcgcactgcaacctccgcctcccgagttcgggcgattgtcctgcctcagcctcccaagtagctgggactatgggcgcacaacaccacgcccagctaaattttgcatttttggtagagacggggttttgccatgttgcccaggctagtcttgagcctcctgggctcaagtgatctgcccgctttggccttccaaagtgctgggctcataggcatgacactgtgcctggacagatttttgttatactgtttagatatgatggtaactgaatgatcatgcaatctctgaccatgtgacattcagggataccaaaaatgacttgagatgggccaagggagaattggagaagcatactttggctgaatacttaggccaaagtataatttggaacatttcttttaaaaaatctactcccctatgccccccacttgcagtaccttacaattacagttaatctagtagcagatactggattgggatattaggtatttacagaccaaatgcccattgggatattactaggtaacaggcagtttcactctggttcattgtagattcatccagtaagcatttctagagaactgctatatgaaaatattgtggaaagtatcaactttttaaacttttgatgtcatggcacctagaagattattttctgatactcatattctaagggaattttgttttctgagatttgtttctgtggaatttctagttccccagtctgcactgaaagcctaaatcaagaggataatttgaaaggtaatgaaagtaaatcaattctagcttagatacccaagagagtaaatgaaatataaaaataataacttttaaaatgtctcaaaaaaaagctatggcaagctaattcagtttgacttattcatgcaatagtctgtctctgcttatgacataaagtataatatattttaggaatagtgtggttttcttcatgatgtcaaacatacaagcttatggatatatttaaaaattcttaattttctagattaatgttcagcactacttccatcttgcattggatgggggcagataattaataattatcagatattttcttatcaaaaacaaatttgttggaaaaaaaattttttttttgagatggagtcttgttctgtcgcccaggctggaggtgcagtggcacgatctcagctcactgcaagctccacctcccgggttcacgctattgtcctgcctcagcctcccacatagctgggactacaggcgcatgccaccacgcccggctaatttttttgtatttttagtagagacagggtttcactgtgttagccaggatgctctagatctcctgacctcgtgatccgcctgccttggcctcccaaagtactgggattacaggcgtgagccaccgcccccggccgttggaaacattttgaaggaactctttgtaaataaaatacatggcatgcctttctgttttactatacagttgctgatttatcctttagttggttactttgaatcatcattaacatctgttgtcaccataatccctgtgatcactagatgtcatactccattttatgttttattgttgccttggggagactttgagagtatgagaggtgttcatgcagactgctgctgagtgttgcatagagatggaataaagtacaaataccttcaggaacagactccaaacttggtctattccagcttcctttcattttttttttttaaacctattccagataatttttcattggtattctctgaaggaaaataagagaaatttcctcttagaatcccttctccttggatttgtaacctttcccagttcatttctgtggaagtacttgtagtccagcatagtaattctattcagatatgtatagttcagttaagtcacgaagggaaaggaagctttcgttgagggctatctactaggtggtacagtgctaggtaattaactttatctcaatccttaaacaactctgcagtggtaagggtgattaattcatcccattttgtagacaaggaaactgaatgttagagggatggcataatttgttcatgttcatataggtagtactttgggaagcagaatttgaacacagatctttctggttctagagctttgtgttcttctaccttgctatgatgttaagtaattagttttaacatgccacttaagtttaaagccttaagtagtccttttaagaaatcttttgttgctggttattctcatttaacactcctattttaatttccaggttcaggtgacctcactttgccagaaccgtgggtcttcatgaaataagagatttcatttggtttttgttttggtttgcatcctctctaactttaggtagaaattgctgttagggcaatcacctacctcactatattccactctctcttctggatattggtgctcagcccttttttgaaccgcaaaccttattaataaaatagttttcattctttgagcgttcctcttctcactgcccacccccccgccaccaccaccctactgactttgatgagctgaactgaaccactcttttttttcttttttttcttttttttttttgagacagaatcccgccctgttgcccaggctggagtgcagtggcacaatatcggctcactgcaacctctacctcccagattcaagcgatttctggctaatttttgtagttttagtagagacggggtttcaccatgttggccaggctggtctcgaactcaagtgatctgcccacctcagcctcccaaagtgctagggttacaggcatgagccacccgtgccaggccctgaacactttttttttctttttctttttttttttttttttgagatggagtctcttgttcttgtcgcccaggctggagtgcagtggcgcgatcttggctcactacaagctccgcctcctggtttcatgccattctcctgcctcagcttcccaagtagctgggattacaggcgcccgcaaccacgcccagctgatttattgtattttttagtagagacggggtttcaccgtgttagccaggctggtctcgatctcctgaccttgtgatccgcctgcctcggcctcccaaagtgctgggattacaggcgtgagccaccgcgccggccctgaaccactcttcatcaacttatctgggaccctgaaatgaaatagggtgacccattttctagctttatatgattttctggcttcatatgatttaaatatttttaccgttttttgtttgttttgttttgttttgtttttgagacagggtctctgtcacccaggctgaaatacaatggcccaatgacagcttactctagcctcgacctcccaggctcaggtgattctaccaccccagcctccagagtggctggagccacagccacgcacctaacacctggttcatttttgtatttttttatagagacggggttttaccgtgttgcccaggctggtctcacactcctgggcttgaccagttcaccctccttggccttccaaagtgctgggattataggcatgaaccaccgtgcccagcttttgaaaaacctgtacaataaaaagtttggactaatgttctttgagcccttaaaaaaatgctattcaattaaaaaaaaaacaaacctatagtgtcttataactccaaatcccatactgtcacccaactggtctgccctggtgaccaccatttcctgacaaacattcaaatcactcctgaggaattgaagaaattcacatttatgacccagtgacactggccttgtctcagttcctatagtgtgtcatactctgttctgcacagaagttttgctcatcctattcctttgtttgcagaggtcccttccccatcccctatctctcaggcagactcctcatctcagtttatttacgacttcctcagggaaagccttccacacttccctgacggatgactttcccctgttgtgtgtgctcatagcaccatttacctacttcgtatacttgtgtggttattttatgtttatttgtgtgattctttgattggtgtctgtgctgtcccaagattaaaaacttcatgagagaagaaaccatgtctttttcttgtttttgtttgccattgtatccccactgagaacatggtgaataaatacgtgttaaatgaatgaatggccttttttttttttttagctggaaggacataaaattcttacatacatatagtttttaagaattatggctgcagatattttggatttcatctctggattaagtcagaatgtcagacaattgtgtacttgcacagtagtactttgttcctttacataattgttttttcttaattgaactttggtagtgtgcccttggctcaaattggcatatgctgtaagcaataaaatgttgcattgattgtatggacactcttgaggacagtgtctgccatatcaagtactatccattatatcaggtaatatcatcaggacccagaggagaaatttctctctgatcttactcccagaaaaaaaagtgtgcttttcttgagcaactggtctgtttttgtctcggaagcactgttgtcttaggcctaacttttgtttcctgaagctcaaagtcagatttgtgactgacatctaaaaattagttaggggtttctggcataccctgtgtaagctaatctcagttttagtttcatcttaatctctagaattttaactgtgattatgtgattatttacatattttatagtttgttcaataaaatactttttttttttggaacagagtctcactctgtcggccaggctggagtgcagtggcacgatctcagttcactgcaatgtctgtctcctgggctcaagcaattctcctgcctcagcctcctgagtagctgggattataggcatgtcccactattcctggccaatttttgtagttttagtagagacggggtttcgccatgttggccaggctggtctcgaactcctgacctcaggtaatccgtccgcctcagcctcccaaagtgctgtgattacaggcatgagccaccgcgccaggcctcaataaaatattttataaatacctttaaggaataatacaaacacaaccagagcttaaataaataaatgtaaatcagtctgcttgctggttaagtaatgagttcagtgtttctctccgcacagaaagtgggagagatagatgaagaagaaaataaagcttattacatgttgggaaggatgctaggcactaagttcctttttttgagacagagtctcattctgtcgcccaggccagactgcagtggctcgatcttagctcactgcaacctccgcctcccaggttcaagagattctcctgcctcacctcccaagtagttgggactacaggcacctgccaccacgcctggctaatttttgtatttttagtagagataggggttcaccatgttgaccaggctggtctcgaactcctgacctgaagcgatctgcctgccttggcctccgaagtgctgcgattacaggcgtgagccactgtgtttggccagttctaggcattaagttctaattggttcatttggggactcgaaattctccattttattttattttattttttctgcttttgtcacaaaagcacagacattgcttaacaaagaggtctgagatgggatatgaatgttaagctcagggacatagggtcaacacttttgagtgcacagactgggaacctggcacagttttaacaatcccctcccctattttcaccatcccttattcctgtagaagtagagcagatgattacgtattcactgctatatggcttattacctttgtaggaattctaactgaagggcttggcatttggcctgactgaatatcagaatccctttatttttcgttccattgcaaaataattttttgtgccatcagtgaaataacagctatgcagtggcatatacagctctggagaccaggcattagaagactgtgagacaagaataactagaacgatgataaggagacactggaagtcactttagattgatgaccaaagatttccttattttgaccaggaggtcagatctcaagggtccttctgagtccacttttgattagccaaattgtcttttctttcagtttgactataggttagtcaaccttccctccacattcatcagggaatgttagcaatatgtcatatttttttcttggtgtaccattaagcaatctaaagctatgctgttacctgtaaccacttggattaattattttagattagttggttatacttctaggttttatggctttatcttttcagtcagcattattaaccaagttttggtagctttttcaagttttgtaacccccatccagggagatcagtgtcctctcagacactcccaggtaagcatgatctcctggaagacgtgagaagtctcttaaatcatctaattattacattggagctatataataactccagtatacctggagttattatgcatatatgcaagttaggttctaatgaggcaaatgtaagtaaatatgttgttgattcaggaggtaaaaattaggagagccatgtgtagttttaagaacaaaagaggaattacttgtaacaaaagtaagtaagaaaggaattctcagttatctcttgggtagagataccttgcatagagttcagcaaaaattccaaaggttgtcataggactatggaggccattaggctaattaaaatttataatattgcccatatatttgtactaagtctcattcctgaaggattttatatttgggttgaggctttgagaaattctaagactggcttgagcagtaaaacaaaccaagtaaaaattgccatggctgtaaatagtcaaaaaggggtaagctaagtttctgcaaactaaacaatttcagagggtgtaagaatgtattggataaaggatgaagataaaaagcactttgaagactattgatactcatcagattttaccactgataatttttcaagaggaactgtttatgaaactgtaaagagaaaatggagatacaaaaagccatccaagatgtaaatgccgaaggccaagttttgagataaacagaaaatcacgaaaactcatgtctggtggatcttccatggccccagtgtgagcagacagtattttccttgaggagaaatactagtttggtgggggtaaggtagggagttagtttaaggattaatcaagagaactatacatgtgctatttaggttgagggaaaagatcagaataggcatgggcaaagcctagactcaaatcaagttatctatcaagcaagctgacatattcagacagtttattaattacttagagaaatgcatgatcagcatagtgtcagctcctcatgtccctcatccgcagggtaacactgaaactaaacgggaccacatgataggtaacatgagtggtgggcactctggctgaggaacagtttccatcctgtagctaagtagttttttagcctacagctacatcctaaggagtgggcaaggtggtgaatctcagacctcatggaaccagggaaggtggatgagaaactgcctcccagcaggctcccacaaaatatggaggttggtaagaaatagccttgtagcagcacctcacaatactgcctatctttccatattctgaaggaacacagagcattctgccaaagcttaggtcagcctatcgttgggcttacgtaagtagcctatgtggaggcatgcgagttttccagggcacgagtacagagcagttatcctaccttatcatctatagtaaggaagaaacgaccgtgtgaattagtacaaaagcatgaaaagaaaaatgttataagtaatcatttcaaacatctaggaaattttgttctgttggtcttaggataagcattctgcttctattaagttgtttgctcctggactgcaaagaaatcctagagattctgacacagtcacttggcacattctgaagattgtctttttttgtggtgatcatattatcccaagaagtttgcattcatgagtaatgtcattgtactatcatctatcaggagtacttgtatagtcttttatagaggcttttgtgtttcttccagaagactcagtttctgatctgtagcttgtaacaggagcctttaggcaagcataaaaaaaaagcagaaactactgtggaggtaagactgaatagttgaggttaatttattttaatagccatcaatatcagagtggaaaaaagtagaatcctctattaaggcatatcagtttgtaaagatttaatgaataattaccttagaataagaacatcatgggtgacgagggtactgaccattttcagagtcttgaatttttataccatagggtattatgattttccccagttgtctcaatctagatacttagatctagagaaaaaatatttttaactattttttaaaataacagctttattgagatacatttcacttttaaagtgtacagatcactggtttttagtatattcagagtagtacagtcattaccactatttaattttagaacattttcaccactccacaaagtaaccctttacccactagcattcactccctatttttccctctaatctacctggcaactcctaatctactttgtatctgtatagatttgcctaagatataaaatcttttaaaattattgtttattaactgaacagttatttaccagtcattggtacaagaacatgaatatgctccttttttaaaaaggacataatcagtctattgtgtttatattaataaaacgtcacatatataattaattgactgaggaacttatctatttgatgtattacattttttaaagtcttgtgtttagtaaacaaaacagctcttatataatagtattaagctagttcaaaatctagagaatgataagaactcttaattatttctattacctcttctaggtatttcccaagatcactaggttagtatctgatacattactaggtgttcaattaagaaagctttattttattttggtgatagagctggaattagaatccagctttcctcccatggagtctccttctctttccattataccacacatgctttccacatgcgtccaaagctgacatttcaaagggtttggaagcagttcatagtgtgaattatttttctctatttcctctttctctcgcattttttgtagccatacaaaaatatacaagtttaaatctgctattatatgaatgctgaaatgataagtaggctaagggaaactaaaaaaaattttaaaagcttgcagtgttttatatctcgtaacaaatataaatgacccacatttcacacttaaataatgtatgtaaagtaggacatgagtttatgggcatttttagcatgtttactttgtttttaaatagctctagttaaaatgctaaatatgaagcagtgatttccagatgtaattttttttatgctttaaggagctcacgttgaaggagaggcgcagtaaaagaaaggataaacacttatagattttttttgtcatttgtgttttaaattttattgtggtataaatgtagatagcaaagtacacaatacttaaatgtataacttgatgggtttttacaaatgtgtataatgtatatatagtaatcacacagattaatatacagaatatttcagtacctcagaagtttccttaatacccctttttttgtcacttgcactcgtgcaagaggtaatcactattctgacttctgttatatattggtttgtctgttttcaaagtgcatatacatgaaatcatacagtactgtcttgtgtctggcttctttcactcctcattatgtctataagattcctctatattgtttttttgtagcagttgttaattttttctttgtagtattctatgatataaataaagcataatttatatatctatttgcctgttgatagagatttgttatttataattttttactattatgactacagctgtcaaaaacattcttatacttgtcttttggtgaatatgtgcactcattttctcggattgtaaggttttgtagtttataaaagttcaaaacattttaattgaaatagccagaatgccaagactgcctcataagcaattttcaagtctaagtgaatattacctctctgattttatagtagaagctggggaaaattccagtgactttacagccactttagggtcgtatcatatgcctcttctatgatgcaagagttatgggtattatacattcagggattcagtaaatagcaaggtgccatgctaggtgctagagatacctctgtaaaagacagtcatacaccctgctttcaccaatgaacaaacaagtcatttgacataatgtacagagtgcaatgataagagaaatgagaactagcagaggagtacttagaatgaagcatctcacctaaatctgggtagtaatgggagacatcttgtaggaaatgacatctaaactgcatccgaaatactgaattggaattagccaggtgaaagaggtgtggtgaggctggtgacatgagctgggcattgagagattttaggcactttttaaggcttgtagacttgagaaattgaaagtagctgggtgagcagagggaaccattgaagattatctttttattatagaacacctcaaaaagaatagaatgaatcctcgtatacacatcccagtttcagcagttaccaactcatggccaatcttattaagaccacgtccactatccgtagtggattattttgaagcagatttgagatatatcatatcatatcattgaagatttatggcaggagagtgacatgatcagttttgtatttaagaaattacacatacctggtaattctaaattacctttaaaatgcccacaccatagtttagttgtttttcatttgctgccatttatacatagacagttacctttctgcatgtactatttgtagtagtttgcactttttcaaactatagtgttttggaagtatgattaaatgttaaaattgttttatgtattcatctttccatgtgtatcggttggtttatttgcattttaaaatactattaatgaatattttggtttctatctataaaatgtcataatcaatataaaagtcagtttgtttctaggattcagcctccataatagcaaagatactagtatttggaaagaaattagatttatagttctactatgaatcttttttacagattcaagttgaggaattgttttgtggcttgagttttgttactatctgtgtatgaaaatttggttttttgtttgtttgtttacttagtgtttgttggtaagaattaatattgactggctgggcacggtggcttgcacctgtaatcccggtattttgggaggccaaggcaggcagatcacttgaggtcaggagtttgagaccagtctggccaacgtggtgaaacccccatctccgtaaaaatacaaaaattagtcggatgtgatggcgtgtgcctgtaatcccagctactcggaggctgaggcacgagaatcgcttgaacctgggaggtggaggttgcagtgagctgagatcgtgccactgcactgcagtctgggtgacagagtgagaccctgtctcaaaaaatatatatatacatatagatagatatattgctttttaaaaaatttatttttttcagattatgaaaaacatttgtattaaatatgaccaacagtactagttttgaataaaatgttttacacagataagtttaaaaaaatagtatgaccccaatccaaaagaaggacggtgacacaaacaggcaaagtatgcaagcaatataacaggcagggaaaattcaacttcactagtcatcaaagaaagtaaaattttagacctattaagctggcaaaaaaaaccaactgaaattccaccaccaacattagtaaagttgtagtaaaactaatctgctgattcactgctaaagatgatctaaattggtgcagcccttgtgcaaagcatcatggcgatacacgtcaaaattcatgagcatggtaatttctgtagaccagaaatctcactcttaagtaagccccatatcaagaataaaattcaaccaaagaattacttcatgcttaaaaatgcttattgccgagttatcggcaagcaatcaaatgcccagctctatgtgaattatttatgatataaaagaacttgatcaaatgaatatacagccatgaaatgtaaaatatttaagtacaaaatacaaattgtcgtatgcacaccaactaaaatttctgaaaatatgtaagcacaggaaagggaacaatacaataaagaaaaaagttatgattcaaatgaagaaatgtttaattatttgatactgatacagtattttttaacttaaaatgagacagatccttatgtgccttttgaggtttccctttaagccacatgcctgtattatctattgaaagaattattttttagaaataaaaataaaaaaagaataatttggccgggtgtggtgggtggctcacacctgtaatcccagcactttgggaggccgaggcaggcagatcacgaggtcaggagattgagaccatcctggctaacacggtgaaaccccgtctctactaaaaatacaaaaaattagccgggcgtggtggcaggcgcctgtagtcccagctacttgggaggctgaggcagtagaatggcgtgaacccgggaggcggagcttgcagtgagccgagatggtgccactgcactccagcctgggcgtcagagtgagactccatctcaaaaaaaaaaaaaaaaatttaagaactgtatgcatagggacaagccataagctgcaccaactggatcctagatcctctttcgccaagggcagcccattcttggttcttagattccttttattttaaaactatagctgtctatgagccactaagttaaaaataccttcctgtaagtcgagtgtttcttagagcattttagtttaattcctttttttgaagaaaatttagtagatggtaactattggagtactttgggatagcactgtatttattcatgcattcattttgtgagaatcagtgattttaatctaagaggtttgcaaacttcggctgctgataatggttcttacattcttaaaggaatgttaaatgaagacgaattcgcaacagaaaccatatatggcctgcaaatgtaaaatatttactatctgggcctttatagaaaaatttttcaagtgcttgtctaaatgaatataacataaatccttggcatatgctttttttcttttgaaaatctttctgtaagatttgttttagaatgatatttgaaaattaaaattttccttctatagagaagatggcgaattagaagatggtgaaatagacgatgcaggatttgaagaaatacaagaaaaagaagcaaaagagaatgaaaagcagaaaagtgagaaagcctacagaaaatcaagaaaaaaacataagaaagagagagagaagaaaaaatccaaaaggagaaaacgtgagaaacataaggttagttagaatctactttttattcttttgataaatgtttatgaaatataaaatactgaaaattagaaagtagaagtcattattttattataaaacatgtggattagatattttcatttatgtgattaaactttctaaacaaagattatatgaattatcttaaagatttaaaaagtaattaagttaaatcttttttttttttgagatagggtctattgtccaggcttgagtgcagtggcacaattttggctcactgcagccttgatctcccaggcttaggtgatcccccactcagcctcctgagtagctggaactacaggtgcacaccaccacacttggctaatgttttatttttagtagagacagggttttgccatgttgcccaggctgggctcaaactgctgggctcaagtgatgtgccaaccgtggcctcccaaattgctaggtttacaggtgtgagccaccacaccgggcttcaagttaaattttaacgcagattgaaataaataatattttaattgatggaagcttgtatacatggatattggaagattaaggaaagagagtttcattctctacagatacagattagcagcattggcattgtccatctatttattattcatttaggtatatgatcgagtgcttactatggaaacctttatgctgtatgctgagggttatagtagtgagtgaaatagttggctcttaaagagtttacattgcaatgggaaagctatgaaaaaaacaacaaggtactggatagagaattatgtggatttggggtagggaagaaggggaacctatgctgactgagaaatcatggacaagttggcagcaatgtaggagcaggttttgaaactccctgaatttcctccattaaaatcacatcaattaggataacacaaccaaaacccattgacaacatctacaaaaaaaggaagaaacaagttatctctaataaacctaaaaagtacaaatgactggagccaaacgatagacagcaacaagagcagtgtaacaacagcatcagtacaaatgaagcagagggaaaataaagggacttccagaaaccaagttgccaacagatattcacctcaaatggtcagtgcccagcacggaaacctcatgggcctgagaacagcaacagaaactgggagggggctgtgctatcaccagttcatgcatgaatgtaaggtgaccacagaaattggatggtgctgaaaagatctggacctgatgaaccccaaatatgaatcaaccaaattcctttttatgacagagtcccacactgaggaggtaactgctggaagtaaagtctacattgagaaacaggcatatagggccaaggaaagaaatagtcagataacaaatgggggaaggaagcagaagaggcatagctcagaaaatagccatatttttgaatacttcatgctaacaacagaagagataaccctagagctatgaagctaggaaagctttattggcccattccatccatttttttcacatgagaagcaagataagactatggtcacattccatagttgttattgtaagataaaagagaataatggagagtaagtcttccagaaaagaaagcatgcccacaaagcatatgaaaaatttaacctaatattttaaaatgacaaaaaattaagaaaacaatataagctatgctcaaacagcatagaataataacaaaacaaaacaaaaccaaaaggaagtacttaataaaattataagcagaagtgaatgaattagaatgaaaaccaatagttttttaaaaaagatcaacaacatatatatcattgaccaaacttatcaataataaaagggaaaagaaaaataaatgtatatatgctgagggtgaaataactatcaaaaaggaaattcaaatcataagaaatttatgtatataattttatgaaaataaatattaaaagcaagatgaaatggaaaattttctagaaaagtactacctaacaaaattaattctagagagtcaaaaagtctgagactttttggagtttgtaatctaccctaccaagaaacacaaggaccaaatcttttcagagtataattctattagtatttttcaggtgaaaggttttccttagagctggagctgacttctgatggtgactgagcaaacatggcttttaaatagacactatttattttaaatcctagccaagaatgattagatacttaaagttgaagcatttgacagcataattataaaaatatttctttatgtcacctatcaaatcaacaaagacaaaagcaataaaatcataaaaaccaaactccagaccatttaggaacaagatggaggaaagcaatttgtctttcctaaaataacatttcaggatggattagagaaaaacagagccttcccttgtaaaagcatcagagttcaatcatttcagcaaatttttactgagtttgtactagatctagatgctgggactgcaatgataataatacacagagccagtgttttcattgctaggaaatgtaagaactctttaaagagaatgctcaactcgggaaggtaatcattctgaccagatggaggagatttggtcccattttttttgaaattgtattaatacttgaaaaagcttactcttgatatcaattatcattgtacttgacatcaataatcattatcaattacttatgcttttcatttcacttttgttcaattttgtgggccagatttattttatttttgtaatttgtaatgttttggtatcttttagttttagggtactcatgcaatagaataagaactccaaagccattttaggtaaaaacaaattaatacatactctactcatgttctatgacctttcttggtgatctaggagccaattttactttctttaggtttagcttaaatgtagatcattttagagcataggggcagaatatttctgtttaggtcaaagggatgatgaggaaaatgtcataaagtctctgagcagagaggaagatagacttctcagaaaacctcagcgaagttggaatggtggtggcctttggggcaagaatttttcagtagtacttcagagtctcctggaataatataatctactggttggtacctctggctgaaacaagcttatctaattactagttaaattttcttccttttgcaaatgtaacatatttgtctttcccctcccttcagcataattccccatctagtgatgatagttcggactacagccttgattcagatgttgaacatacagaaagttcccataaaaaaagaactggtttctacagggattatgacattccatttactcaggtattgccatttttttgttttgtgataaaacatagatagcataaaatgtaccattttaacccttttaactgtacaattcagtgatattaagtatattgacagtgttgttcaatcatcaccacttatccatttctagaaattcttgatcattccaaacagaaactcagcacctattaagcaataacatctcgttttcccctgcccccagcccctgaaaaccactattctattttctgtttctatggatttgcctattctaggtatttcatgtaagtggaatcatacagtatttgttcttttgtatctggcttatttcacttaacataatattttaaaagttcacccaagctgtagcatgtgtcagaatttcattcctttttaaggctgaataatattccgttgtgtgtatatatcacattttgtttatccattcatctgttgatggacacgtgggtgttcatgaaaaaaagcttctaccttttgctattgtgaatcatgctgcttatgaacatgggtattcaaaaatctttttaagacttctttcagtttattggggtatatatttaggagcagaattgctagatcatatggtgattctatgtccaactgtctgaggaaccatgaaacttttccacagtggctgcactattttacattatttacaatgtttacatattatttacattacaataatgtaagtataaaaatacatttacattatttacataatgcctgagggtttcaatttctctacatccttgccaacgtgtgttttttttctttgttttcttttggaaacagaaaatgagtatgaagtggcatctcattgtggttttgagtattgcccttttaagagaaaaattaaactttcaattttattctttctggtattttatcagacataggctgtaaatttgaaatctttgaacaaaagaatacataatgtattagtttgctagagctaacataacaaaattttatagactgggtggcttaagcaatagaaatgtattttctcacagtctggagtctagaagccccagatcaaggtgccagcagggttggtttcttttgagggctgtaagggaaggatctgtgctaggcttctctccttggtttgtcactggcctccttctcactgctttgtcctaacatggtcatccctctgtgtgcaggaacccctggtgtttctctgtgtccaaaattcctcttattatagggacatcagtcaaactggattagagcccactttaacagcctcattctaatttagtcacctctttaaaggccctatctccaaatatacagtattttgtgctaggcaagttatgatgcttctcagagtcactaggaagtatttggatcagtgtgcacttatctgaaaagccccaaagtttctgagttctcgtttttgccagtctcactgttctggtctacaagagcactattttttctcctaatttggtgttcctaatctcttgtgagtttagaaaccaaaatactatttttgttagagttatttctatagtctgattcactgttgccgcctttatagttgagattgctaagtgaccattaaataaatgaggttttattaaaatatcttctcttaaaatttgaaaagaattatacactagttaataattttatctagttgggtaaatatcagaatgtttataaggtcaatatgtccagtgattttagagtcagtggttgttgctatttctcagaacattttataactgttcattaaaaatatttttaccacaagtgacaaaacttttaattcagcaacactgatatgtagttagatttattctttagaaatattcaaaagtcatttggagactcttacaatgaatgaaaagatgctaaggatgggcattattatttcaagtgagaagacatttgaaaatatcaagtaatgagacaggttctggattcataagttatcactgaaagtaaccccaaagaggaagttccaaatatttaaaatagtggcagcattattgtaataagtacatagccttctatgtggccactgtgggaggcaagatggatttgtatgtataaacaataatgcagttgttttaggtatctcacattttttaaacattatgcagttatttattgttaatattacgctgactattatatatccctgtagacatactgttttatttttgcttcaaaaaaatcagttaaagaaattaagaaaacggatggtcttttatatttatctacatttcatttccagtgttcttcactttttttgtagatctgagttttaatatgataccattttcttttagccagacgcactgcatcgtttagcctttgcttagcatatcttatagcacaggtttgctatcaaattctctcagtttttatttattaggccaatgtgtttattttatcctcattttttataacttttcattttgtcataatttcaggcttacaaaaaagttgcaagaatggtgcagagaactcctgtatatctttcatccagattccccagttaacgttttaccacatatgctttacctaatctttcttctctagtcttctcttcccttcagagagatctaatttgcctttatttatttatttgagacagagccttgctctgctacccaggctagagtgtaatttgcctttaaacctatctattaagtatttttcatacgtagaaatttggttctttaaaatcttctaagtcatttttatagtttcaagtttgctgctgaaatgttcatattgtcttttacttgaaaatagcagacttcagatacaaatttctatatctgaagtctgtatttcttttttttttttttttgagacggagtctcactttgttgccaaggctggagtgcagtggcgtgatcttggctcactgcaacctctgcttcccgagttcaagtgattctcttgcctcagcctcccaagtagctgggactacaggcatacgccaccacacttggctaatttttgtatttttagtagagacagggtttcaccatgttggccaggctggtctcaaactcctgacctcaggtgatctgcccacctctgcctcccaaagtgctgggattataggcgtgagccaccgtgcacggcctgaagtctgtatttctattgcctgttattttttgctggttctctttcatgtgatcctatctcttcataagccaatttttgttttcagttttttctattctgtgctgagcattttgtagaaataactttaggcctaggatgatgttcttttccttcagaaaggatttttacttacttctgccagatttctggtgacccttacaaactttattccaatttcaggatttgagacctctgagccactcagattcctgaaggctgggctgcagtctgtgattcgcattttgagatccccttataattgaggatggggtttactaagcttccaccttttccagactctggactccaccttttgtttccatagacaacagagacagtctaaagtgctgttggatctctcacctggttcttcctgatggggtgatactctcggagcaaatgcagctccaaatgctgcccacttctcaggattttcatctactccatgggtattggtctagtaatccttcactaatttgttagctgtctgatgtctacaaacggatttaagaaaaatattttgtctatcttttctactttttttaagagagacaactagtctgaattgcccagtctgctatttacaagaagagaaagttcagtaccatttcttccatatatatattttagagttgactcactgagaattaagattatatcctaattacatccaaaaatcccttttcttagataacaagtatctgctatataacttctacaattacagggcaaaatttgaatatactgttaaccccccagcagttaaattagagaacttaatttagcttcttttttcctcatcttttttcagggcctccttttcctttatttgtttccagtgattgctgtggggcttgtttttgttttacagaaaccaactctatccctgcagacattctagcagtttgtatagccaaataatcagttggcaaagtgattacaaaagctatctatttttgtggaatttgttgtctttttcatttatcttctctcggttggacttgaaaaaatacctgctagaccctcgcccatgagtgcgttttgttcatcccaatgatgaccatatgaaccataaggaatatatgaaccactctagaaaagcggggctgctctgtcacccttcattcatttcatgcttcctggaaaactcatacaacgtggtgtgaatgcgaatgtgaaggaccttagcagtccacactagaagtctttaaccacaaaaggagccctgggatggaacgtgcattcttaggggactattaagaatatttacagttgggaatctagggaggaggtaaatgaaaatttagggataattctacttaaggtaagaacacagagattattttgataaagctatgccaatcagagaactgaattaatgttaagaatttaaaacttgtatgagaagcatctaatctccagagaaaaattgatactcatctattaacaaagtaatcttcaatcataaagtgttgaaatatatcaagtattaatatagtcacagttttaataaaaggaaatataaccatcatttaactagttaatttaatcttcaacttaatctaagcaattattttttgttttgctttagttttcatagtggctttaaaaaatgtcagaaacactgttttggctacaatcataaattcccttttgaacttctgaagtgctagactaagaatggagttcataaactttaaaaagtactacttaaaacaaatcaaaaatatgatagtgtttttaaaatttaaaattgatgagtgaattggttttcttgattagttatgcattttttctctattttataattagaaagatctaatacttcattgcatttcattaaatacgtagtctcatgttggtattttgccagagtagtattttattttattttatttatttatttatttatttatttatttatttattttgagacaggttctcactgtgtcacccaggctggagtgcagtggtgcgatcttggctcactgcaacttcctttcacctcctggattcaagcagttctcctgcctcagactcctgagtagctgagactacaggtgtatgctaccacattcagctcatttttgtattttttggtagagacggtgtttcaccatgttggccaggctcttctcgaactcctgacttcaagtgatccacctgcctcagcctcccaaagtgctgggattacaggcgtgaaccgctgtgcccggccagagtagtattttaatatcacatttaaaatgcactaacctggccaggcacagtgggtcacacctgtaatcccagcactttgggaggctgaggcaggcggatcacaaggtcaggagttcgagaccagcctggccaacatagtgaaaccccatctctactaaatatacaaaaattagccgggcatgttggtgcgcgcctgtaatcccagctacttgggaggctgaggcaggagaattgtttgaacccaagaggcagaggtcgcagtgagccaagatcatgccactgcactccagcctgggcaacaagagcgagactctgtctcaaaagaaataaataaataaaataaaatgcactaagctaaagatgaattatttggtttggatttgtctagatccttaagttgtaattatgtgcaattttttctcgctttactaaaaaaaattgacagaggatacaatagaactaataaaaatatttcagtgaatagagacagacctgaatactgtcatttaataaacttctagtactaaagtgtattctttgttttcacatgctttagtaaggaagcaataaaactaatcatgtttgttgtaataaacagtttctaataagcaacttattcactagatgtttttcactattagggaaagctctgttttttctattagacccttgatatagacattttctttttataaaattttccacacatacagttttttattaaatataatgtaatttgagaattttccagtgttaggagaaatagtatgttttaccacactcctccaccccaagctatttaactatcttttccctattttcaaaaaggccttttcattttttggaggaaaaatttatgtatgattgtgtgtatttttactttttcctgtgtgtaagatactgagacatagaacatagaaagcaaaggctaaagcataaagataacaatatttaattatctcagggtaacatttaggcttttgaagttagtgttaagtagtatcatagataagtactgatcaagagtcagaactaataactgtcttttctcctttctccaaacttgctggggggaaaaggatgtcctgtgctactgtcaattgctatatataattgaaaaatcctgataatgattgtccattttcacttagcgtggacatatatcaggaagctacataacatcaaagaagggtcaacataacaaaaaatttaaaagtaaagaatatgatgagtacagcacctacagtgatgacaacttcggtaactacagtgatgacaactttggtaactacggtcaggaaacagaggaagattttgccaatcagctgaaacaatacaggcaagctaaagaaacctcaaatattgctttagggtcatcattttctaaagaatcaggaaaaaaacagagaatgaaaggagttcagcaaggtaagtttgaaattacagtctgtcttagaatgtgagaaccttattaaaacaggcagctatggagtaaaaacttagaaacttatccctgttcaagattagcttattcttgtagaacctaaattcattttcttttattttgtagaccttgagaacagaatctacaaatatttcaatctgtatgatacatgaatatttcagttggaaagatattctaatgatttaaaaatacataaaaatgcaatacaactttcttatatttttccccttgcttctgtgtcatgtcagtatacagttatctctgttgctgtatgtattgctttaaatttagaccagctgggaagctatacttttattaggctttaaaatacagcagtcatttttgctaagcaagtgtgcatggactatgaacatcttttaaaattggagataaaaacataatctaaagacatttctgcactgatcacctgtttatctgcaatattgaattacatggtccctggagagaccaggacaagttgccagctcttgacaataagtgaagaaactatgggtcatgtaagcctcaaatcagccttaagtattggctagtcaatgtatctgcttcaggaaaagtggagcaatatgagactgaaatgaagtagtgaggagccacactctgtataactaccctttaattatctttgcatacaggaatcagttatgagtaaatttggttatttctatgactttattttttctcgatttcctagcaggatttctttgaaaaatatgaatgtaggctttagctgaaataaagggaaaataatttttctacacatatgctgttgtactgagcaagtttgttcctgtagtctagatgttgtggtatcagggatcatcccacttggacaataagggtaatgcaaaaaagtcttgttcatcccttcccacctggggcttttcttttcaagctcctacttgtttgtgctcttaaagaactgagtattggccaggccaaaggcttacaccttaagtcccagctactcaggaagctgaggagggaggattgcttgagcccaggacttcaaggttacagcaagctatgttcttaccactgtattccagtctgggtgacagagtgagaccctgcctctaaaaagaaaaactaatttttgtaatttgggtatctttttacatacttttaaataccaagtttttcaaaaacaaaagaagtataatttttcctggagatatatgtgtatatatctactcaaaattaccagtggaaatttgatttgctgctaattaaccactgatacctacaatgtcttccttaaataggaatataatatttgattctcttaaaaacagaaaggcttgttaatgatcttatgctaaggaaaattaaaaagaataaaacttgatttcgcttctctagccatgtgtatccttgttccttgccttcctatgttgttaacatcccttaagaagcagtaccaaggagataagatacaaagatttaatttttttcattgaatctagaaggaaaaaaaagaatgcactgtatattatagactattaaaatgtgctgttccttataaactaataaattgaaaggtatgctgtttttcttttaaatttaagtacattttaacttttctaggtattgaacagagagttaaaagttttaatgttggtcgtggacgtggcttgccgaagaaaatcaaacgaaaagaacgtgggggaagaaccaataaagggcctaatgtgttttcagtatcggatgactttcaagaggtactaagaatttatgtataaggaggggaggagctttttcatcttttaatttatttgatggcaaagaaagcattgtgattttaatgatacttctctagtaaatgaaaaattaccagctcagataaaatgagtatcaataacctccaaaaaatagttgttaattagttgtgaaactaatttacagattttgctgactttgaaataaaattgttatgtttgaaagaacctcaaaataaaattgctaagtttaaaagcaaaaatatatcctctattagtcttcttttgtgcttttctttcctaggaatcatcttccccagatgtaactggcaatgaagtgctaatagctcaatatgtaggggggacaagaagggaggcagtggtaaattaacttcctttttagagttgaaaagattgaaagagaagaaagggggatataaatggttggaaaggtgaacttatgtatgttacatgttgtagatattcaataaatatatgtcaaattgagttgaactctgaacatgaacttttaaccttgtagtgactccctggattactgtggtccaattcctgtgttctactactgttctagtaagatttgattgaattatagaggcaatagtgggtcattaaaagctggagctttggctgggcacagtggctcacgcccgtaatcccagcactttgggaggccaagtcggacagatcctgaggtcaggagttcaagaccagcctggccaacatggagaaaccccatctctacaaaaatacaagaatttgtcggatgtggtggtgcacatctgtagtcccagctactcgggaggctgaggcagaagagtcgcttgaacccaggaggcggaggttgcagtgagccaagatggctccactacactccagcctgggtgacagagcgagactccatctcaaaataaaaaaaaaaaaaaagctgcaactttgtgtgagagctgagagggatagctatatactataatttgaaaatgcttggttttctgatctctcagtttaaagatagtgggcagagatttcttaatatgcactccttagtatactgtttcaggagatgttaacaggtgtgacctaaaaaaagaaggtcagacccaaataaatttgcgaaacccagcacatgccatctgcttttggagattctcagttgacattaatgtagtaaagcttgtgagcagcttaggcaaaaagaagcttattttgttcaacccatcatttactcaactacaaactatttttttccctacacacctactaacattcactgagccactcactgttccatggaacagcagctttggaattactatggttattattttagaattttggggtgactaaaaacctgcctgtcatcttcttagacaccagtagacctttagaatatgctgatttccctaacccaaactaatacaaatgctttctaagtaagcctgcacctatacccagttcttacaccctatacctttaaacaaaattagcttccaggaaagtgtgactttgagcaagttatacctgtctctttgcctcaatttgcttaatctgcaaaatgagggtatagtattaagttaactctaagggccccatcaagcacagcattttagatgtctgtagatctgggctatacctaaaagataatcatataacagaaaaataaagataaaaatacattatcagtcatgtcaatttattggctatcacgagagacatttcttatgattccagaaacaactgggagtgtgccagagcccacggaagcagttcatgttcaggaatggtctgcaggtggcccatccagaatagcatgaacatggaggccacagcagagtggccaagatagatccgtctctgtcctaggcctttcagagactatgagagtctccaaagccaaatcaattcggggtaccttcagattcatcataatttttttgaaaaatcaagagtagtcacaaagaagcaaactttcactgaattttaaaggcttcttcattttattggccataatactcttaaattgttttagtatttactgtacctattacatttttttgtaataaatattattttcctggtagatccttacatttcctctacctgatatatattaatattttatgctcttgtctcttgtatcaatatatcttctaaagtaaataagttttaaaatgaccaagtacagtaggtagcttggttttttttctccctccatctctccctctttctctccttcattcttgtatttttttttattcgcagtactgtcttgtaatgcaaagaatataggaggagttgcaaggcacaattcctgagttctgtcagtctgctaactcaccatatcttctgggcacttaattttgccctaaaaatttatttgttaaagttgctttagattttctatagtaccttgattatagtcaggtttcccatagctgtggacactgacatactttctactcatttaagtggaactaaactaaaaaacaaaacaaaacacttcctcaccacaatcctctattaaaacaatgaaacattatttggaagtaatgtatacagaaagagtaagttattaatgaaacgctaagtacaacttgttgcatttttcagggtgtgtgtgtgtgtgtgattacctaatttttttactttttaatttcagagttatattcctcaggttgctcattgatttttgcataatttactttctttggctgtttattttattttataacagccatgattctttgtatagaatgcctatgtgagctggtcatttatatctgcttattctaaacgaatctctaaacataaaaatgtttgtgaatcaaatttatatagatttgagacactttaaatgattctgtcatagtatattataagcaatttcattgtgttttcctggggtaaattaggtatgtttatatttttaaaacgaatctctaggattatctgtttactttgtattcttgtaccttttttagaattcttacagtaaaatgtgatttgagctgtgaatgctggggatcagatttcaatttagacatctattgcctcaatgtttgctgtgaggcaatctcttgttttcagtagattgaactttatgctctatcttttagcaaattaagagaaaagggaaaacagaaatcaaatcagaagagtaaatagtcattgaactcctatgatatacagggcacagtgcatgccaggtgcatgaaaaataatgttgttttttagagttgatgaatgtaactcattacatttagcatggctaagcatcatactctgccttgttacttaatcttatacttaaagcagaagttgaataggggactcaggagaagtaaggaaaacaagtagggctataagatttcttttcctttaattttcttaagtttttttcttaactttttatatttaaaagttaaaagtaatacacgccgcctgtttgtttgccctttttttcccctaaagaaagtacaaaataaccacacacataaaatctctaatcctgccatccagagacatacactgtaaaatatgggggtatattctttttgtcttttttcctttgcctttatttattattgtagaattgggatcaattttttacttcataaaatattgtaaactttttttttgttttttttttgtttgtttgtttgagacactctcactctgttgcccaggcaggaatgcagtggcgtgatcttggctctcactgcaggctccacctcccaggttcaagcgattctcgtgcctcagcctcccaagtagctgagattacagaggtgtgtgccaccacacctggctaattttttgtatttttagtatggacaggatttcactatgttggccaggctggtctcaaactcctggcctcaaatgatcccaaagtgctgggattacaggcatgagccaccatgcctgatctgtaaacagtttttatgatccaaagttgttgattttttaatgactgcataatattctaccacctaagtgtatcataatatatttgaccagtcttctagttttaaatgtgtagagtgtttctcgttttgctgtttgttttactatgtcagtattttattatatgactagatctttgtgtctccctgataattctttcaaaataatcccaaaaagtacaagttgtatgtcaaacaatatggatattttaaagtcttttataacatacctatcaataatatgagtgcatattttattgtgtctttgcccaaattgagaattgtgaatttttaaactttttataattttatttaaaaagttattcatcttcattaaaatagaaagaaataggcttttttttgcgatcactagtagcataagtagattactagacacatatctctctccaaataaatgaatagcatcagaatgttcaatcttgatcactttttgtagtcaatttgtacttttttccagatcaacttaatcatacattttgatacctattaatatttcatatgctgcattcaaatggaatttttttcttgcagtataataaaccagggaaaaaatggaaggttatgactcaggaatttattaatcagcacacagtggaacacaaaggaaaacaaatctgtaaatacttcctggaagggaggtgtattaaggtaaatttatagaggtatcataagtcattttaacttccaaaataatctttaaaattaaagtcttttgggggatggttaatttttttctcttctcatatagttgtaataaaactgggtctttaaaatgtatcttgcatggaaataccgtacattagagctcatttaattatgttctgggacaataacataatttgttgaaatcggatttgtttaaaagacacataatgctacgtggcaagtactgttcaaagtacaactaatattaaatgatttaatcctacagtgaccctacaaagtagttaatgttattatccccattttattcatggcaccaagaggttaagtaagttcccatggtagctcagcaagaaatggtgagtgctggttgccaattcaggcagtatcctgtgaggtcttgctcactgtgctgccttaatgcatgtagctacatccactgtcttgggcaggaattctaaggggtcatttgagttattatttgttcattattaaagactgaagataatgaccataattttaccatgagacaccatgtagaaaattcagctgttgtttctttgtttctcattgtttcttacctttttttcttttttcttttttttttttttgtgaatagggagatcagtgtaaatttgatcatgatgcagagttggagaaaagaaaagagatctgcaaattttatttacaaggatattgtaccaaaggagagaactgcatttatatgcataatatcctttatttaaaatgtatgttaaataaaatgctggggttttaaagcatcattgaggttttaaaaaataataaatacaccctataaagcctagtttggttttaaatttaaaacaacacattacataaacccagtctagtcaaactttgtacttcaaaagagcaaactgacctttattctttagggaaatgagataactgccctttggaaaaaattctgtgaagggaaggtactttaatataatcagcttaaagtatttcaagagattgtgcttcctgaaggagtagttggcaaaatacttattttattccataattattttacttaagttcgggagtaaaaaattatcattgtgaagattataagtcttatcaaatcttaccactcaatgatagatgctgtatattcttccccactctcccttgggaaatatatacatttaaattgtattcctgctcctacccaaattggaatttcactatatatagtgttctggtcctttaaaaaaatgtattctgcaatttttccatgttaattttcccccaaatatctgtcaggttgctcactacgacttatgactaatgaagctttcccccacagaattgaaactctatcacagacaaaatgtttacatatatggatttttcttctggacttcgtgtttggctccatggatttgttcaccctcatgtctgtcttgctttgctgtgattatttctgccacaacagccacggtaatatttggtagattctgatgtttatttttccagataaatttttaaattctgttgtcgtgtttaaaaaatgtgaaaaaaaagaaagtgaataaaatgaaaaatgcctgttatcatagatcaaaatgtcaaaaaatggaacgatgtaattaccagaggaatacatgatgaattggaacagaaaaatttcctgtctcaaaatccagaagcaaaaagggaacagattgaaattttgactccatgaaaaagcttgcatttgcaaaacaaatacatataacatgagctaaataataagataaataatgaagtgagaaagattatgtgtaatttatatcacttacgaagaggtcatatccttaatatatgagtttctaaacattgagaagaaaaatgagggaagagatacagataattcccagaaagagaaatgcaaatggtcccaaaacatacagaaagatgttcaatcttgttcctaataaggggaatgtaatttaagctacactgagataacatttgcagctgtgtcacgtttgcaaaaataaaaaaatcgtgacagtgaagtttgttagcaaggatgtgagaagaccttgatgctggcaatgtcaaaatggtgcattcctatggaggagagcttggtaaatgcaatatgcatttaccctttgacccagcaatcccacgttttgcagtttctccacaatagacctgggcagtgattactgatggctgctaaaatcatgaggtgaaaagttaattaggaactttacaactgatggatggagctgacaacacctgaaaggactgatcagtcttaacattactaaaaagaaacaaccagatattaaatgccttttgatatgatacagtagagagtatttgaataccatctatgaccaatattaaaattaacaaatgatacaaaaataaaagggaaaggggaacttctagaaatcagtaaaagtaacttgggagatgtattaactagatacaatttgtggatcatctttatgtcctgatctgaagaaaggaattataaaaacatacttttttaaaagtctggaaaatttgtatattgactggttactagttgaaattaacacattaattttgccagggtggtaatgaagtcgtgattggtaagaaaaagtattcctggccaggcatggtaggtcacacctgtaatcctaacactgggatgctggggtgggaggattgattgaggccaggagttggagaccagcctgggtaacatagtgagacacctcccccactcccataactaatttaaagaggaaaggggccaggcacggtggctcatgcctgtaatcccaccactttcggaggccaaggcgggtggatcacctgaggtgaggagttcaagaccaacctggccaacatagtgaaaccccatctctactaaaaatacacaaattagttgggcatggtagcgtgcacctgtaatcccagctacttgggaagctgaggcaggagaatcgcttgaacctgggaggtggaggttgcagtgagccaagatggtgccactgcactccagcctgagcaacagagcaagactctgtctcaaaaaaaaaaaggaaagaaacaatagtccttatgttgagaataggtatggaaatatttacaacaaatgatgaaagttgttgaacctatgaggtcaacatgagagggacttcattttattattctctctactttggtatggttaatgaccttcaaacaaacttagaaaaaaaatcctaagtaatgtcatcctacagagaaccatacttggagtatggcataaagcctttcagactttttttctatgctggtatgtatgtatgaatggatgtgtatatgtttatacacataattttttatttttgtgagacggagtttcacttttgttgcccaggctggagtccaatggcgcgttctccgctcactgcaacctctgcctcccgggttcaagcaattctcctgcctcagcctcccgagtagctgggattacaggcatgcaccaccacgcctggctaatttttgtatttttagtagagatgttgtttctccatgttgatcagactggtctcaatctcccgacctcaggtgatccgcctgcctcggcctcccaaagtgctgggattataggcgtgagccactgggcccagcctatacacataattttttagaaaaatgaaatctataatgattgtgaatattgtatttttaaatttaacatttacattaatatggactgtattttaatacacagtgtgttaataaggacctttattcagatgattaactcattgtcttatctttactgatttaaaatggcatcttcaccagaccctaaattctcatttgtacacagttctgcttctatactactcttatctattgtggtatttgattattcacctctgtaagagtatgtttgatatttggtaaggcaaatactccttcctttttaaaaaaaatgttgtaatagtctcaggtcagaagtgatttggcaaataataaaaacaaataaaatgtaatgaatttgtcctattcaagaaaaataaattttttcagatttgacatatttctttagaaagcaaatactttattctgtttctgaaagctttccatctattcttatggggtttttgttatatagtcatgctgtttgtaaataataataattttacttcatttacaatatttatacctcttatttaattttaattgtattggccacatttccagaagaatgttaaataatagtgactgtggcagacataaaacatgttttaatgatagtgcctttttgttttagcttgtggctgcagttttaaagtaagttttaaaaaatcaattaagaaagtatatttttattttactaagaggatttttttaaacctaaaaaagaaatctaaaaaagattttgaattttatcagttgccttttgcatctgccaaaatgatcatataatttttttcttgaccttatcagtgtttacaataataaatttcctaaaaccatccagctattccctgaacatacatcacctgagagtggtatatttttcactatacttctagatttaatattttctttatacgtttgtctccaaaatcctaagattagtctgtagttgattattgggatatttgcctttaacatgacatattaagcctcttaattttctttataaatataagctcttgctacaaaatttatataatattttattttattgtgaaaagtaacagagcttatgtaattaaaatataatagtgtttgctataatagtgataaatgttttttttcctttaaaaagtggctttctagttttaatagagaaaaaagctgtttgaatgtttttgtataattaaaatatctaaccttaatagaattaaaaataagctgatgtgattatagtaaattcagtataatatataataatacagccttattgattcagcacagttgtggttttgtgtgtgtgtgtgtgttaagaacacttagcatgagttctactcccttaacaaaattttaagtatacaatacagtattgttgactataggtacaatgttacatagcagatctctagaacttaactatcttgtctaacagttgtaggttttggtttaaaaaaaaattagaccttgattttacttggtcttttccttaatatttttatttacatgaatttccatgcaagttctatcatagtggagcaaaatgttaccagggagacaactgtaaattttcccatgatgatctaactaaagaaacaaagaaacttttggacaaagtgagtaatatttttgtaccttgattatgtctctccacaaatacatttgacttgaatcatattttataagtgatattttatgaaactgctgagaaattgaaagtttactattttatattttattctatttgagcaatattctttacctttttgaacctcattctgtttataaaaaatgaggagttagctatctccaaaccatttcaacttttttttttctttctctcccccttccctccttcccgtcttccctccttccctccttccctccttccctccttccttcctccctccctccctcttgcttgcttgctttttctttcttatttctctctctctctctctgtctcttttcttttcttttcttttggcaaggtctcgctgtgttgtccaggctgggtgtagtggcgtgatcttagctcagcttactgcaacctccacaccctgctccttgccaaccccctgccctgcaccgccccccacccctgcccctggggtcatcctcccacctcaaccttctgaggtgggcactaccatgcccagctaatttttgcattttttgtagagacaggggtttctccgtgttgcttgggctggtctcttgggctcaagcgatccagctgccttggccttccaaggtgttgagattaaaggcgtgagccactgcgaccagcccatttcaactttaatattatttttctactaaccaaacttaagtcttctagttttaaatgtgaggaaaagactcgctttgaaatagtaatctttgccaattatttttaggtgttgaatactgatgaagaactcataaatgaagatgaaagagaattagaggaacttagaaagcgtggcataactcctcttcccaaaccacctccaggggttgggcttctgccaacccctccagagcattttcccttttctgatcctgaagacgattttcagacagatttctctgatgattttaggaaaattccatctctttttgaaatagttgtaaaacctactgtggatttagcgcataaaattgggaggaagtaagtgaaaaactttcaaaatgacatcaaatatttttttctgaaaattatcattaagaaactaagtcatactccaagctaatcatgtaattaaacttggttagagatagcacatatctggcatgcacgcagattgttgcttccacctttgttttcggttcccacctgctgcttgccatcagtgctttcccatatggaatccttatacagcttctgaaacttctcagcatagtaatcctgaagaaccctgcctggtgggtggatttggcattttcacttgattatgaggctgcattgtcattgataatgccttcagattgtgggaaataggtctccacatatttgattattttgaagagcaattccttaggctattggcggaagacctctggatccagattttcattttctaacaccaccatttcagccctgctgccagtccccaagcgtctgtgcacctgggccctaagtcacattgttgagcattcgtttagtcctgacaactcaggaaagcaaggaggtctcagccaatgaggaacaagaaatctatagcaaatatcacaattcatttgaaccattaaaagtatttctactaatgtcaggaagataagtatgtccactattttggtaatattatatattgtatcctggtcaatgaaataagagaaataaaagttataaagattagaagtggagtggcagcctaattatttgggaagtttccctcaacccaaaggaatcaacagacaaaactattggaaataataattaaattagcaagatgtcaggaaagaagagcaacattcaaaaactgaatgtctttttatatgccagcaataaccaattacaaattattataaaaagttggatgtttatatagtagattctaattttactgtaaaaggttatatatgcctgaaaaagaggactagtaggagagaaccaataaaattttatctctgggtagtgggattaggggtgattcttatttatctttgtacttttctgtgtttttcaaaacagtaagttttagaacagctaacggtaagcagcaagtgggctaaaatgaaagcatgaggtctatttcgtgtttctacctatcgacgctatggaacaaattgcttcttaaacacacagtattctattctgatgtaaaaaaagtacttaaccaatatctgtttagaagtgttaacattcttgtttgtttctttttctttgaactaagaaatattattatttctgtctacaggccaccagcattttataccagtgcctcaccaccaggaccacaatttcagggaagcagtccacaccctcaacatatctatagttctgggtcaagtccaggtcctggacctaacatgtctcagggacacagtagtcctgtgatgcacccaggctcccctggacatcacccatgtgcaggacctcctggtctaccagtgccacagagcccacctttaccacctggtccacctgaaattgtaggtcctcaaaatcaagctggagtgcttgttcaaccagacacatctttgacaccaccaagtatgggtggggcttaccactccccaggctttccaggacatgtgatgaaagtacccagagagaatcactgttctccaggttcatcataccagcaaagtcctggtgaaatgcagctcaacaccaattatgagtccctgcaaaacccagctgagttttacgataattactatgcacagcattctatacataattttcagccacccaataactctggtggtaagtttacttttttgaaataatttattcctaatttaaaatacagtcctatttttcattaaaagcatgacagaaacgtaagttttaagtaaagctgagtaaaattgataagattgaaaccttaaaatgttttcagtttgccaaacttttgaaacaatagaattttagataacttttagaaatattttaaatgatataatttgataatccagtgtgcctgtgatgaaagctttcatttcttatgactggtgaagttttgtgctcactcaatgactgtctctccccatgttatacatgtagatgggatgtggcatggtgaatttgcccagcagcagcctcctgttgttcaagactcacctaaccatgggagtgggtctgatggcagcagcactaggacaggccatggccctctgcctgtaccaggcctcctccctgcagtgcaaagagctctttttgtaagacttactcagagataccaagaagatgaagaacaaaccagcacccaacctcatagggcaccaagcaaggaagaaggtgtgtcagaagttattaatagcatcttacctatttggatgggttaaaatttttaaatggccgaggcaggtgaatcacctgaggtcaggagttcgagaccaacctggccaacatggtgaaaccccatctctactaaaaatgcaaaaattaggtggtcgtgttggcatgtgcctgtagtaccagctactctggagcttgaggcaggagaatcgcttcaacttgggaggcagaggttgcagtgagactaggcaacagagtgagactcagtctcaaaaaaaaaaggattaaaaatgagctctgtcttctatttccaatgtatttcatagccactatcttgtgattgattgtggtttcagtgccattaattgcattaatacttaattgctaaaggtttgacttgaagcagtgaaaagatctgaagctagagttcaaggttgtgcagacttgcaagtaattaagccttttgctttttttttctgaagaaaataaatagaacaggaaaaggacaactttcagtttaaggattttgaattctagcccaatttcaaaatgattcagttattagagatatttttatgtcataggctctataattaaggatctgctataataagaaatatttttaaatataaaaagattatatggaaactaagtttatcttagtatttttgatactggtaagtatacaacagttagttaattcagtaaaggatgagaaaagtttaaagcatccagttctgtttatgaattacaaaactgatgtttggccactcttaaacatgacatttatgaaaaactatgtaaaactatgtaacgctaggtagctgcaagctattatatgagcatttaaaatatatatatttataatttttaaattatttttgtgggtacgtagtaggtatatatatttatggagtacatgaggtattttgatagaggcatgcaatgcataataatcacatcagggtaaatagagtatccaccaccttaagcatttatcctctgtgttacaaacaatccaggtatactcttttagtttttttttaaatgtacaattaaattattattgactatagtcaccctgttgtgctatcaaatactaggtcttattcattcttttaaacttttggtacccattaaccgtccccacttcctccctatctgccagctacccttcccagtctctggtaaccatccttctactctctatgtccatgagttcaattgttttaatttttagctcccacaaataagtgagaatatgagaagtttgtctttctgtgcctggcttatttcacttaacataatgacctccagttccctgttgttgcaaatgacaggatctcattcttcttatggctgaatagtactccattgtgtatatatgccacattttctttatccattgtctgttttttgttttgttttgttttaagacagagtctcactctgttacccaggctgggattcagtgacacgatctcggctcactgcaacctctccctcccaggttcaagcaattctcgtgcctctgcctcccgagtagctgggattacaggtgtgcaccaccatgcccagctaatttttatatttttagtagagatggggtttcactgtgttggccacgcttgtcacgaactcctgacctcaggtgatctgcccgcctcggcctcccaaagtgctgggattacaggtgtgcgccaccgtgcctggccattgtctgttggtggacacttaggttgcttccaaatcttggttattgtgaataatgctgcagtaaatgtgagagtacagatatctctttgatatactgatttcctgtcttttgggtatatacctggcagtgggattgctggatcagatggtaactttatttttagttttttgaggaactttcaaactgttcttcatagtggtcgtactaatttactttcccaccaacggtgtatgaaggttctctttcctccacatccttgcctgcatttgttatttcctgtcttttggataagacccattttaactggggtgagatgatatcttactgtagttttgatttgcatttttctgatgatgagtgatgttgtgcaccttttcatatccctgtgtgccatttttatgtcttcttttgagaaatgtctattcagatatttcgcccatttttaaattggattattgattttttcctatagagttgtttgagctccttatatattctagttattaatcccttctcagataggtagtttgcagatattttctcccattctgtggattgtctcatcatttgtttccttcacaatgcagctttttaacttgatgtgatcccatttgtccatttttgcttggttgcctacgcttgtgaggtattacttaagaaatctttgcccagaccagtgacctggagagtttacccaatgttttctggtagcagtttcatagtttgaggtcttagatttaagtatttaatccattttgatttgatttttgtgtatggtgagagataggggtctagttttactcttctgcatatggatatccagtttttcccagcaccatttattgacgagattgtcctttccccgatgtatgtttttagcacctttgtcaaaatgggttcactgtagatgtatgggtttctttctgggttctctgttctgttccattggtctatgtgtctgttttttgttagttcatttttttgtttttgtttttgttttttcttaagacagggtgtcactctgttgtacagtggtgcgatctcggctcaccacaacctctgcctcctaggttcatgccattctcctgcctcagcctcccaagtaggtgggactacagatgtgcgccaccatgcacagataatttttttgtatttttagtagagacacggttttaccacgttggccaggttggtctcaaatgcctggcctcaagtgatctgcctgcgttggcctcccaaagtgctgggattacaggtgtgagccactgtgcccagcttatgtgtctgtttttatggaggtaccatgctgttttgattactatagctctctagtataatttgaccaggtaatgtgattcctctagttttgttctttttgctcaggataggtttggctattctgagtcctttgtggttccatataaattttaggatagttttttctatatctgtgaagaacactattggtattttgattggaactgcattgaatctgtagattgctttgggtagtatggacattttaacaatattgattcttccaatccatgaacatggaatatctttccaatttttggtgtcctcttcagtttcttgcatcaatgtaagtgaacattttttgttacattttcaaagaagatattattaattcttcatttacctaacatcacaggagaatgaaggattcctaataagtgaatttcctgtacaatttcaattataagcattttaatagcaatctttcagccgggcgcagtggctcacgcctgtaatcccagcactttgggaggccaaggcgggtagatcacgaggtcaagagatcgagaccatcctggccaacatggtgaaaccttgtctctactaaaaatgtaaaaattagctgggcatgttagtgcatgtctgtagtcccagctactcagaaggctgaggcaggagaatcgcttgaacccaggaggcggaggttgcagtgagccgagatcatgccattgcactccagcctgggtaacagagcgagactctgtctcaaaaaaaaaaaaaaaaagtaatctttcgatagtcttaaaagttttatgttttcataaacaaagatattaaaacttttagataatagaaaattttattctataatgttatataattggtagtgttctatgggagttgttggctctgatacagaaatattttgaacagctaggtttacttgtgtttgtgttaatttttatggattttaatgcttttatgcattttatctctgctttgataaaagctgctaattatcattttttatctaatatctgttttccaccagcctgtctctattcttctactctccctctgttactattttcactctcatttaagaaagattttaagtatgctttataaatcatgaaatatatatataatgcttataaaatatattgatatgggaatgaaaagaaagtaaggatagaagtaacaaatactatgaggagtgaaattactatacagaaatatttaaagtaattgcagcaggtaaaagtgaatcacaaatccatctgtagatttccttgatgtcaaagagaagaaaagagatctagtgtctagaagtagttttttcagatattgagatctgagtaaaactttttgcaattgtgacataccatatgctgttttaatccacattctaccctaaataccaatgcttgttttgtaagcactgctttgttcaaactaaccctgtaacactaaagttccatgtagtaggcatgcattagtgagcagtgagatgaggtaaaaatgagaatatctaggatagtctgctgatccaagatactccaggatggagatacatatatgcatatacagtatatctatacatctgtattccatgttctgactcttacgttctggcaagaatgtgaacagtagataccttgtggccaattcagagccaacctgtgtatattttaatggagaggagggagaatcacccttctgaaacatcagtttgtaattccttctgctagagaaaagacttacgataggtaggcttctttaggtaggcttcttaaacttgcatctaatatgctagagttaaataggctttaagagtaagactcaaagtgttctcataaagtatgtaagttttaggatggtaggtttttttttttttttgagatggagtcttgctctgtcgcccaggctggagtgcagtggctagatctcagctcactgcgagctccgcctcccaggttcacgccattctcctgcctcagcctcctgagtagctgggactacatgtgcccgccaccgtgcacggctaatttttttgtatttttagtagagacggggtttcaccgagttagccaggatggtctcgatctcatgacctcgtgatccgcccacctcggcctcccaaagtgctggaattacaggtgtgagccaccacgcccagccagttttgttatttttaaagttaatgtttgaatagctaatatagtcacacaggtcaaatatctaaacatataataaagagtaaatgaaaagtctctaccccattcctcatttgctcagtttccattgctaccttaaccatcactttcagtgttttgttttctttttagtccattgttaacttgataaattcagagctaggaagcttaaggaatgcttgatttgaagagacctagcatattttagaatgctaacagcattttcctttctcctacagcccaccacacatacaacacacatatctgaattccctttggccagttggaaggaaaggtcctgccttttctctgactggaaggacattacacatattctagtatcaccccacttccttaatagagtataatgactgaatcgatagttttcttaccacatcttattttgttccagtattgaaatctggcatttttgttatgcattttcttgaagttagattatacttatttcagaaatagtatgtgttttttaatattaattaaggctacatataaatgtagccatattataaagaataatttataattataatataataattttattatattataagtttataatataaagtttataataagtttttgtctgcatttagatgatacagttaactggtattccagtagtgaagaggaagaaggaagcagtgtcaaatcaatactgaaaacattacagaaacaaacagaaactttaaggaatcagcaacaaccttccacagaactcagcactcctactgatccaagacttgctaaagagaaaagtaaaggaaaccaagtggttgaccctaggcttaggactatcccaaggcaagacattagaaagccttctgagtctgccccactggatcttagacttgcgtgggatcccaggaaattgagagggaatggaagtggtcacataggctcttctgttggtggagcaaagtttgatttgcatcatgcaaatgctggcactaatgtcaaacacaaaagaggcgatgatgatgatgaagatacagaaagagaactgagagaaaaagctttcttaatacctttggatgcctcacctggcataatgctccaggatccaaggtcacaattgagacagttcagtcacattaaaatggacattactctaaccaaacccaactttgcaaaacacatcgtgtgggctcccgaagacttacttccagtacctttacctaaacctgatccagtgtcttcaatcaatttacctctgcccccacttatagctgaccagaggctaaatagattatggaatacaaaaagtgatcttcatcaaaatacagtgtccattgatccaaaattagcagccaaagccaaaattaacacaacaaacagagaaggctacctagaacaatttggagactcacacggttcaggagctaaattaggagatcctagactacaaaaaaattttgatcctaggcttcacagactgcccaatacagagtctcatcaagtggttatgaaggattcacatgcatcaaagggtgcccctcacttacccagatcaaaccctggttcatcacagccctcaggggcaggaactagcaattctggttccggggctctgcctccatatgcccctaaactctcttcctcagctggccttccactgggaacttccacttcagttcttagtggtattagtttgtatgaccctagggatcacggttcatcatccacatcagagctagcaacagcttcttcaggagaaaactcaaagaaccagaaaaaaagtggtggcttaaaaagtagtgacaaaactgaaccttctcctggagaagccatccttccacaaaaacccagtccaaacgtgggagtcactcttgaggggccagctgacccacaggcggacgttcccaggagttctggtaaggttcaggtcccagcagtgcacagccttcctgttcaggcattaacaggcttaattaggccacagtacagtgatccaaggcaggcaaggcagccaggacaggggagcccgaccccagataatgatcccggtagagaaacagatgacaaatctctgaaagaggtttttaaaacttttgatccaactgcttcaccattttgttagctattgtgtaactgagcaattcttttcactcttgtgactatctcagtcctctgctgttttgtaactggtttacctctatagtttatttatttttaaattataaacacttttcagctgctagtatcagaaccacatgaagttatagcctctaaagcctgtggtattttatataatatttttataactttaagagactgtagtaattgacctaaaaacttatgttagcttcagtaaaagtacttttattgtaaataaacaatcatgaactcaacactctgcctgaatatatgccagttgtctttcataatcaatgtttagataaatgattgccactttttatatggttgtttagtttcaagcaatatgatgtacattacttttgagaaacagtattttgactaggacctctcttatttgtcagcacagaactgattaatatgtaatgctacctgctaattaaaatgtaaaatcaagtaaagaaaacattttaaaattacaattagcagagcagttcatgtttaagggcatcacttttattagtattggcaatattatttgtgtaaatgaagcatttgaatgtcatatctttttaaagtattttattgtatactgtatcatagaagttggaggtatataaatagaacattttgctaaagtgaaaaatttccaagttctctagcataactttttacatttaatttttcatatgaaatagcaattagttactgctgtgttacattgtgatgtttatgtatgtcaatgtttttgtctttaacagcataatttatattgctttttcaaatgatgtagctgcattaattgtgttcatcatgactttggcgatttttaacaaaatttttaaagacccagtgagagtctgtagtgattattacacggataatgttttaaatgtctaggttctgtatttttttcttaaatagcaagaaaatacagattgctagtatagtcaacagtatttggctatcaataaagaatctctttaagatctcacccggctggcattctgtaacagaggggattacctggtgttttaagtatttaatgtcctcatagtgtggaaatcccctaaattgattagaaattgtattttatgaaaaataacttgtattcattcttgtgtatttattacaatatataaataatggcaactctttgttttatacatatataatttataactgaatctaagtattagactgctactcatattttgaactgcaggtgtaggacagtgtttgctggtaacaactccaatgtgtattaataacttgaaaaggagcatttcactataaaagataatgaagtaggtaatgaaatcagtccttgaatgaaagcagtgcccttgagaagggatttttttttaaatatacagtaaaatatttcgtgggaacctaacactcacatagcatatggtttattaataatgcatatcctttctaatcacttcttcaattctttttgctgcagttctgtgctaaaatggggttgtggttaagtgaacgagaactctgcctacctaagaagttcattgtgttctaagtggaaggagagttactgaagggaatgtgaatttttaccgtttgtacttaagatacatttgttgtctaaaatggctctggataacatttttgggttaaaaaatgtaatttaaagccaccatagaaagtattttctgatttactgtccaaatgaattttgttgttaattgagaagtcaataaaatggattaaactgacagaaaaaaaacatatatatatatcccaaggtgtaatttactcttttgtcaggataaaatcagaaaaatggctgattttagtaaatgaaatttttagcaaatctttcattcatgtagtttataattattgtgtcaagcagtgctgtttacattttaagcatcatacaaaaaagataatttggcttgctaaacatcaaaatagaatccaaactcttaaccgaatatcttttttacaactaaaagagatattccaagatttattaaagagtcaggtttaaaagttattaatgcaaattatgtaatgttcatttattcagtattcttgagtccctgttacctcaattggtgttctagaggctattttacaagaaagtttgaacttagtttcaaatttgacaatatattttatatgaaaatgtttatgtttaaaataacttatttattatgcagcatttttattgtgataacgttagtttatgggatattctgtcatatcctgtaaacatagtttatttttcttcttttttcccattttctcatacaaattgaataagtagccattttcccccaatgaatacctcttcttttaggtcaattggtgtttttagaatccatgtaatttgatttgcactgttagattgaaaagtaagttacgttcctgttcttagaagccacacatttagagataacagaaataacttgagtcttaagagtatggataggctcatccaatgagatgtaacttagctattcatactgtttgtgatggaaattctatacctgtttactgtgatgatgaatacagtggatatagcagggggttgaaatggaacacacagaagatcatgacaattgagattcagcaactgctgtctcatatcttggttaagacctcattgtgaaccttgaacacaaatcagatgttggagtgatttcaaactctatttcaacaattgggtctgtttctatatggaccctctatttcccagctgaatgtttcaaacccccaaattaggctgcaaccgaaagagcctaattgtgaaatgatgtgcgcttatgtttctgtttatcctttagccatggaactttaaagagtagtgttcctcctacttactttaagctggaagaagagttgagtagtaaatcctgtgtgaacttttagctcagctactctgctgaattaattagaggtaggaaggacttacaagggctggaagtttaaagagaataaattcatattttttgttctgaattgatttctgtgtaatttatatcagtatctagttgcttatctgtgaaattgggttaatttttattgatcacatttgatgtaaagaatgaattatttttgtaaagtatttgtaaatataaaattgctttataacttgaatgaacataatcattatgctcccattagggtgcattaagttgtacaaattccaaaataacatggtatggtttgtatggtttagcaattttacgaagcttcagatgacatgcactggtgacacaacagtagaatttcctgagaggttgagtgaatattaacccatcaagttagcaatttccttaactacatgagtatcaggaagacaggacttccctgccttagagctatatagacttgggcctcttcaagatctgacttctctgcacattctatacaggttggatattgatggagggttaaaaatgctatgacagttcatggtgcatggtgtgtttgtttaaatcatagcatgtttaggcaaagtggccagctcattcaatataagagccaccagctcttagaaacaacagatatattcacacccagtctgtaatatgtatttcttcaggcatgtcacactgcggtcttcctgaaagactacttacttcataaaggtattatgtttctttaattaatggccactagaagttaggaagctcctagggaccaggatatgagatcttaaagaggctgtcagaatctcttcatttgcatgacatagaatctgtggtggagatgttttccctgatgtttttggagggttggactgtgttgaaggctgtaccttggtgggggtggtctgcagtcatgcagtccactgatagggtcccccaccccgcaagcttcaataattgagctttctgttaatttcttgaattatcttttcaaaaatggtttggcagcacttgatgacattatgttcaaaattaagtccagtaaaatatataagcatttgtaaactataattatagtttaaataagacttagtttaggaaatccaagttttgacatatataaccaaacggcctaagagttcaaagctattttcttaggtgttacaccttagcatttacataatgccttctccccaagcagtttcatgtggtttgcagaaagttttggcagctaccagtcactatattgctggagttttgtgtttgagtatgtcatttatgtcatttatcagcagtatctgccagttgtgacaaagccctccctattatcctgcctttcctggaaaggatacagacccaagaaaagttaacatctacatagtacttagaatttctaattttaaaataagaaacaaaaagcacatttaaaataatattttatgcttttggagacaggacccacatgtatctccttatttttatacttgccatagaaacaagcctagttgtaggcctacagtgggtgctttgttaactgcttgttgatggcttcctgacatccatccaaatgtcacttttacagatgctgtcacccgttaaacaggtgtggcagaagtattccatgactgcattaggaagaatgcaccttatgggttatatctcttttggtagacagcccacctgctcttttttgtccccaccctcagcccaagcaatgtgaagacagattatggcaacttaggagctccatgtttccataataattcataactttaagagtcctccagacttacaagattacttcatggtgaaagtttggattgatcaataatttattcctataaaggtctgcaggattttttctgtaaccagaaaagtaactgcatagccattctttttttttttttttaatttgttgttgtttttgtttgagacagagtcttcattcttgttgcccaggctggagtgtaatggtgcaatctcggatcactgcaacctctgcctcccaggttcaagtgattctcctgcctcagactcccaagtagctgggcttacaggcacgtgccaccacacccagctaatttattgtatttactagagacggggtttcaccatgttgatcaggctgatcttgaactcctgaccccaggtgatccacccgcctcaacctccaaaagtgttggggttacaggcgtgagccaccgtgctcagcctgttttttatttatttttttgagacagtctcactttgtcgctcaggctgaagtgcagtggcgctatcagctcacagcagcctccgcctcccaggttcaagcaattctcccaccttagcttcctgagtagctggaactacaggtgtgtgccaccacacccagctaatttttgtatttttttggtagagacagggtttgaccatgttggccaagctgatcttgaactcctggcctcaagtgatccaccagtcttggcctctcaaagtgctgggatcacaggcatgagccaccacgcctggcccagtctttttttttaattattatttatttttatttatttattttttgagacggagtcttgctctgttgcccaggctggagtgtagtggcatgatcttggctcactgcaacctctgcctctgggttcaagcaattctcctgcctcagccttctgagtagctgggattataggcatgcgccaccacaaccagctaattttttatatttttggtagagacacagtttcatcatgttggcccggctggtctcaaactccttacctcaagtgatctgcccgcctcagcctcccaaagtgctgggattacaggcgtgagccactgtgcctggccagtcttttattttaaaataaatacttagtcctaacctagtgaattatcaatagcatttaaaattccttctatcctgataccatgaacagtaattttcccttttaagttatgatttgactctaattttgggtcttgtatctggtctttaaacacctttcgttaccctttggaatagaacaatcatgctactgttagcaaaattattgtaggcataaggaagagctgtgagttcaaagaagattgtgagttcttggaatagtattttacagcgttgtttattcttgaccttcttgttttttaagcttagagtttataagaaaaaagtgaatatatagctaattatagcattttagaaaaaattagctctgcagatagtcaggccccatacttcttggctcattactgattttaataccttcatgagagtattaaggttgaaaggaatggtgaaatttgcattatcagaggtctgatatgtaatttattgtaaagaaattaaatatatagaggctcaattaaaaaataaccatattctcaaacctccattaccactaatatcttggggttgtcaatgatagactatatatatatgtatgtatatgtgtgtatatatatatatatatatatatatatatatatatatatatatatatatatatatataattttttttttttgagacggagtcttgctctgtcacccaggctggagtacagctcacagcaacctctgcctcccaggttcaagcaattctgcctcagcctcccgagtagctggaattacagacgcctgccaccacacccagctaatttttcgtattttttagtagagatggggtttcaccatgttggccaggctgatttcgaactcctgacctcaaatgatccaccgacctgagcctcccaaagtgctggccttacaggcatgagccaccacacctggcctagactataccttttatacactttttaaatagagaaagtgaaaaatgataaactaaccattataaaatagaggtttgagtccacctgtattttacagaaatttgccctcaaatgtttgagagggaagtcacatatgatagaaaaatatcttttcaagggtagaatgatatttccttataaaagtgacaatcaaaaaagactcatttgtatacttgccaaagtttaaaagttttttacattccttaccctaaacccactgccccatccacccagaattcagaaagggtttggcatagatccagggctccagggcccaggtcattttgttattagtctagggcttttgtcctccacagtctaggcagggcatctttgtatgtgtgttgctggttggggccagggacgggggcaggcgggagttgtccaggtttaagattgtttgttttccatcagatccacaagcaatatctgtgggctgaaatccaggttatacctattcactatgactttttttttttttaactttctactgtaattatttcagttccccgaagttgtatctcaaatgttggggaaatgctgccttgactattttactttggaaggttttactagatatcagtttagtagattaatgacgttgttaatctgtctgctcaaaagacaccagcaagggggtatactttgctgaactgataaattattctattaaggactaacccagtacttggcaaaattaggaataacttttcccctccttctttactaataaattttccaagttgcatactgttgttgcaagtttctgtaatttttttctgtatacctttctattgtctgaatttaaataaaaatgtttctaataatatc
